United States Patent 10,407,724 (METHODS AND COMPOSITIONS FOR SCREENING AND TREATING DEVELOPMENTAL DISORDERS) - sequence listing, part 90

SEQ ID NO: 2617 - DNA, 377951 bp, Homo sapiens
attattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcacgcatgagtgataaaggatgcattagccatattactgttcttcttgtgtttttgaaaccaagaaatattcagatttaagtttatacatctttaaagcataaaaaatgcaactgaataatttatgagcagtagcactgagactacttaaaaagaatacagcagtatttgaaaaattacatactaaaaatgcaaggttatatatgcaagaaaaaagacaaactcaagacaatatttcaggatctataaacataacagtccagttggaaatttccagctttaaatatgacatatgctgatgtgaatgacaatagaaaaaatctgaataatttagggacatatcaaggtcaaataactccctacttttccgccttttgtaataaattaccacctcacttttccagcagtaaaccaacctctaagtagaaagattctaaacataaacagataaagattatgtgggatgccctctctcaccactcctattcaacatagtttggaagttctggccaggacaatcaggcaagagaaggaaataaagggcattcaattaggaaaagaggaagtcaaattgtccctgtttgcagacgacatgattatatatctagaaaaccccatcgtctcagcccaaaacctccttaagctgataggcaacttcagcaaagtctcaggatacaaaatcaatgtgcaaaaatcacaagcattcttatacaccaataacagacaaacgcagagccaaatcatgagtgaactcccattcacaattgcttcaaagagaataaaatacctaggaatccaacttacaagggatgtgaaggacctcttcaaggagaactacaaaccactgctagatgaaataaaagaggatacaaacaaatggaagaacattccatgctcatgagtaggaagaatcaatatcgtgaaaatggccatatggcccaaggtaatttatagatccaatgcctccccatcaatctaccaatgactttcttcacagaattggaaaaaaaatactttaaagttcatatggaaccaaaaatgagcccacattgccaaatcaatcctaagccaaaagaacaaagctggaggcatcacactacctgacttcaaactatactacaaggctacagtaaccaaaacagcatggtactggtaccaaaacagagatatagactaatggaacagaacagaggcctcagaaataatgctgcatatctacaaccatctgatctttgacaaggctgacaaaaacaagaaatgggaaaaggattccctatttaataaatggtgctgggaaaactggctggccatatgtagaaagctgaaactggatcccttccttacaccttatacaaaaattaattcaagatggattaaagacctaaatgttagacctaaaaccataaaaaccctagaagaaaacctaggcaataccattcaggacataggcatggggaaggacaccaaaagcgatggcaacaaaagccaaaattgacaaatgggatcgaagtaaactaaacctacagaatgggagaaaatttttgcaaactactcatctgaaaaagggataatatccagaatctacaatgaactgaaacaaatttacaagaaaaaaacaaacaaccccatcaacaagtgggcaaaggatatgaacagacacttctcaaaagaagacatttaagcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcaatgtggcgattcctcagggatctagaactagaaataccatttgacccagccatcccattactgggtatatacccaaaggattataaatcttgctgctataaagacacatgtgcatgtatgtttattgtggcactgttcacaatagcaaagacttggaaccaacccaaacgtccaacaatgatagactggattaagaaaatgtggtacatattcaccatggaatactatgcagccataaaaaaggatgaattcatgtcccttgtagggacatggatgaagctggaaaccatcattctcagcaaactatcgcaaggacaaaaaaccaaacaccgcatgttctcactcataggtgggaattgaacaatgagaacacatggacacaagaaggggaacatcacacactggggcctgttgtggagtgggggtaggggggagggatagcatttggagatatacctaatgttaaatgacgatttactgggtgcagcacaccaacatggcacatgtatacgtatgtaactaacctgcacgttgtgcacatgtaccctaaaacttaaagtataataaaaaaaattatgtgtaaaaattaagataaattgaaaagtagaaaaaattatcctatattattttgagttgctgtgatatatatgaatatagatatgtttaataataacataagtattttactgcttcatcctgttttcaactttatatgatcttcctttagaaaatctacttttttatatatactttaagttctgggatacatgtgcagaatgtgcagatttgttacataggtatacatgtgccatggtggtttgctgcacccctcaacccaacatcgccagatattgtgggatctggccagcagccctcaatgcaatggggatctctctttgttcccagacagatcggcaggtcgagaaataacagacacacacaagatagtgaaagctgggtccaggggggtcaccgcattctggtcccgcagtaccaacaatgcactggatataccagcatttattactaagtttagtgagggcgcgggtaggttagtgagggatttagggtcatttcattatgaggtgagatggtcacatggggatgaagtaattctttaacataacatctgtatgcagaagtacagtatacagaggtaagaatttacaatatagtgtgtgcatcagtaatttctaacagagccttaaaacagaaacagtctttctataacctatgattagcaagatattaatcagcagtaacagttgcagcaaaagctggttacaaacaatccatagaagcaggacgtgaagctagacaaccagttagaccagaaattctcagaagggagtatgccttaaccctaaacagacctagaagacccgtggcaagatgagggcgtttatagccctatcttatccatatggacaggtgcccctcatgcgtccgtttataaactctccacaagggtcgcattccattcccagagctatgaacatctgcttttctgggataggaatcttggtgatgtgaaacctccctgactgcacgtccattcataggctctctgcaggcggaagcacatcacgcgctgttggctcattctggcagtccaacctggcattgtcttaacacaatcctgcatgcaattttgtatttacaataatcaggagcatttcatcttttattccgtagcaatagtttcacggggtctgcctacatcaacccatcatccacattaggtatttctcctaatgctatccctcctctagccccccagcccacaacaggcccccaagtgtgtgaggttcccctccctgtgtccatgtgttctcattgttcagctctcacttatgagtgagaacatgtggtgttcggttttctgttcttgtgttagtttgctgagaatgatgctttccagcttcaaccatgtccccacaaagaacatgaactcatccttttttatggctgcacagtattccatggtgtatatgtgccacattttttaaatccagtctatcattgatgggcatttgggttggttccaagtctttgctattgtgaatagtgctacaataaacatacatgtgcatgtgtctttatagtaaaatgatttataatcctttgggtatatcctagtaatgggatcactgggtcaaatggtacttctggttctagatccttgagaaatcgccattctgccttccacaatggttgaactaatttacactgccgccaacagtgtaaaagtgttcctatttctccacattctctccagcacctgttgcttcctgactttttaatgatcaccattctaactggtgtaagatggtacctcattgcggttttgatttgcctttaactaatgaccagtgatgatgagctttttttcatacaattgttggccgcataaatatcttcttttgagaagtgtctgttcatatcctttgcctactttttgatagggttgtttgtttttttactgtaaatttgtttaagtcctttgtagattctggatattagccctttgtcagatggatagattgcaaaaatattctcccattctgtaggctgcctgttcactctgatgatactttcttttgttgtgcagacaatctttagtttaatttgatcccatttgtcaattttggcttttgttgccattgcttttagtgttttcgtcatgaagtctttgcccatgcctatgtcctgaatggtattgcctaggttttcttctagggctttagggttttaggtcttacatttaagtttttaatccatcttgagttaatttttgtataaagtgtaaggatggggtccattttcagctttccacatatggctagccaattttcccaacaccatttattaaatagggaacccttttcccatttcttgtttttgtcaggtttgcctaagatcagatggttatagatgtgtggtgtttctgaggcctccgttaagttccattggtctatatatctgttttggcaccagtacaagttacctcacttgtatgtttattgcagcacttctcacaataggagatatgaaatacacttaagagtccatcagtggattattggataaagaaaatttgtacacataaacacagaccatgcaatactactcaggaataaaaaagaataaaattatgtcttttaggtggaactggaggccattataccaagtgacaaagtcagagacagaaagtcaaatattgcatattttcacttgtaagtaagaactaaataatgttaacagtgaacatagagcgtggaataataggcataggagacttggaaagtggggaggtgacgaatgagaaattaccaacgggtacaaagtacagtatttgggtgatgtttacactgaaggagtgaacttcaccactgtgcaatatagccatataataataccacacttgtgctccctaaaactataaaaataaaattaaaaagaagcagaatatgaaaaaattgacataattcatagaaaacactaaatattaatttgaggtacttagtttattaaaagaagatcttttcatacttgtttcctggtaatgaaaaaagtggatatacatttttccttgtgatattataattgtaaaagatgtcactacaatgataaatataaatggaaagtataattttccaattaatcatttataagaattgttttccataaggaactacaaagggactaaaacatataatttttttggttctaacacgacatgtagtatttataaacatgtagaactatccagttctggagaaagaaagtcattctttaaaatatgttttcaaattgctacaattttaaaaaaaggtggaaagacaattttcaatactttgcattatattttgtttgaaagatatactctaggctaattttcaactcatagagaaggtttatattttactttttagaattttggaaataataactgcaccattacattgtaagtttttgatcccttctttcatatggtcttggctcctgagatacctagatgctcagacatctattaagcaaataaataaataaataccatacacttcaaggtgagacaaagctttgtaaaatggtcttcataagtagcactacacaagaaaataatataaagcattctatcaaatttcccaataataacaagaagtcaaatagatttcatcgcttccttcctttcttcctattttccttccttctctttcttttcttctctctccagccttacttctgttttattttttccctctttcctccctttttcctctctcttttctcccatttttctccttatgtattctacaatgaatttatgctgcataattttacagttcatatagcttgtaactttgtaaaaatgaagaaaacatgtaggagagctctgatagagacacagccctcaaaagcaaacaatcttcttttttcctttcttttttttttttttttttttaagtcttgggccatagttacaacaaaactgtaccagtggtggtttataaaatgcaagagaaagaaagatgtttggcattttagggacacatttgctagtaccatcctgatttttaacatgaggttacaaaaaaaacctattttacaataaaacctgcagaagtcactagtctgatatttaatattagagaagtattaagatttggaaaattatagaatttcaagtataaagataatgacagagaaaattaggaaaggataataggaggagtaagaacttgcttttatgcatctgagtttagaaaatccatctgaatttttttaaaaagacatgaagtaaacgcaatgagatatggaagatcctatgtgtcttgtgaaataatggctcataagacactgaggaaatggtcaatagacaaatctaagcacccatctcagcttgcacagtacattgctggtttctatgggttgtcctagacctttgttttcattttaattgctttagtgtttactacttttaagaatgtcctgattttgatgctatagtcacctgatgaatacagaacccccacaaggaggatgaagaaagtagataatatctaagatcaataaaaagactgaaacttttgttctataactgaacatgattgtttaaaaattatgtataataacaaaattagccaggcgtggtggcacatgcctgtctgtaatcccagctacgctactcaggaggctgaggcaggagaattgcttgaacctgggaagcagaggttgtggtgagccaagattgtgccattgcactccaggctgggcaacaagagcaaaactctatctcaaaaaaaataaaaaataaaaaaatatatatatatgtataataaaacatatgcactctgtgtaaactagtatgtaaatatttttaaatttagtaacttatggagtttaatcatattgccatttgattcttcatattttttttttgtctcttgaagttgtgatgcaatttaatatttttggtgattgttaaaagaaacttcttcaggtatatttttaaaaagacaaatatttgcatttaaactaaattactccttcttgattataatttctaagcagagatcgcccttgtgtaatcagtagtatagaagaggctcaggtaactaaaactataaatatagttaacagtgtactttctggggtcagcctgcctgacttggaatcccagacccaacactgactggttatttcaccttctgcaaattgatgcacttgtgcaaaatgatgttaactagcaacgaggtaaaccattggcttgttgtagatttaaaaaaaaaaaaaaaactttgtaaaacccttagccatttatatttgtccatagtttgctctgctatgttagattgggaagacaaaggaaaaatgttcattttcttccttcaaagtgtttaataatctcaagaaaagacagtattgcgtaagaaaaattattaataaaatataaaatttgatataatgactaagagagaaaattccttaatctccctgataaagtcataaaaattttcaaaatgaaggagaatttgaggtgagaccagaaagcttaggaagagttgaaagagagcaaaggcaataatttgtgaaaaatatacattttacaagaaaactacatatcattcagtgatactgaaatataatatgcaagggcaaattaggtgtccatgtacatagaaataagtgttcatttagtttcttaaatgattaggcaccactgagaaattttcaacagcgagttatgtgtggaatattttaaaaatatcaacctctgggaaaagttaaatatagattgcaaaattagaagagacatggtatttatcacccttgtttggcaagattatgacaaataatattacagtaggattaataatatttcccgaaactctcagaaggtatatggctagtgaagagtagaattaaaacacaattctgttattaaactgcaggtgttctgagaaattctactgcatttattgaattttaatttgatatatacctcagatccaatgtaatcttttgatttttcttcatatatcatgtgataaaagagttttcagtgggaaaataggagaatggtagaagtcagtgaaggaaaaagagagaggaagttgggtcacagccatattaagctgatgcctattaaatatcaaggagtcaatcattgttatttttttttttactttgcctaccttagcaatgttatatctatatgtaactatttctacaataacattttataaatacatgcacatacaggtaatatggctctgtcaaaaagttgatttttttgttgacttttatagaaaactatctttatagtcaagtatgaagctatataaacatagttatataattacaaagtagcaatttggctattctatatcctgtgaatattcaaacacatacagaaacatacatggttctgtatttatagtgttaagaaatgacaagttaactgcaacttgagcattttactcaaatttggtctaaaataattattctaaagccgtatgaaatcccagaattcagctgggattagagggaatgatctagcttgttttggcaggagaatatataaaaggtaatataataggtctctttcctactcagcaatcctataaaacaaaacaaaagttcctctgcctgcagtagtgtatactgagatgaaagttaaagattctgttgtattcttcaaaacgactgatcttggttcctgagccagtatgcctgttctgattaaacattttctggcaaattctcagagatatatttaaaaatgtcatactcctggttaaaaaaaatctgtattatttatctaaacatctttatttactttaccatatttggttaaaaatgtaaactgattctaaaatacaattcgttgttttcaaattatattacctaaatatgctataagaatattagacaacttttgaagttagtaacttcgagctgattttaatcatttattttgagagtaaactatttgtacatttattcattttgtgtggttgttcttaacggtagtcttgattttcttagttgctatcattattacaaacctctttctctgtttttgataagctagattattaaatgaaggaaaattaatggaaaatataggggaagctaagatatggaaacctcttcaaattctcaattatataacaatacataaaagtatcgtataaattatctcactggtaaggtaaggcggtacttgagtcttgcacatcctaaaaatgaaatgctattttaataatgataaataattcaaagatcacttaagccattgtaaataaaatattaaactttgaaatgtattttatgcactgcttaaataaattgacaaaaatatttctaaagaaaatttaaaaatcatccagagtacttagagtgtagaattcttaatctatattgtttcttctgctaaaggtaagagctatcgaatagcatatgtcttcacttttaaaatacaccatattgaattctgtaagcttagtctggtttttgttaggataccaaaggcatgaaaagattcgatagttaaaaaattcaaactgcagccagattacatatattctgaggcatgtatatctcacatatatgtttttgtgtgtttgtgtgtgtgtgtacacatatacatataatgataattcactttggataaaaaggtatgttttgtctcttagttttaaaattattataattaacagtctaataattaaaatgatatagattaaaaagtcaattctcagtgtatatcataacgaatagctacttcatcatgtatactttagacattttaaaactattcttcacaagctaatgtgaaattcatgttaagtgcatattcacatcaaagtcacttttacattaagtgtttactgcaggcatgctttacaatgtccacatgatcatcaaggcttgagtgaccatttgaggtttcatcttgcattctatttgtgcaggtagtctttcagtagatctgacattgatcatctgtcaatttgattttctaatcttatgagactcattgtaaacaaaataactaaatgtatgcaggcccacagagaaaacacaacagctctgcattttatttctgacagaagcattcttttcaatcaagcttaaaaatagaagaaaataacagtatgttttcactttatgaattcttaccaaacgattgggtccgaggcatttagaatttaaaaacaactaatctaaatagaaagagcctggcttgtgaagttttaaaattagacgatggaaccaataacgagcatatgttaatgaagacatgaaatcatcacggcattacatctatcttagtcagagcctgtcagtatgcccattgcctaataaattgtatccctagtcacagtttataagacacaagaagacattttcagaacctacaaatgaagccaatatgtgacatttcaaaactgctgtactaccacaattagtggaaaatatacaaagtaacaaatacgacatttatttcacaaagagtggcttaaagacttgcctagctcatcagcttcctatgaaacattgtcaggtaatatttatgtgtgtcagggtgggagggagacggatatggtttaggtcagacgctgggggaaggaatgtattatttcaaatacggtatctgggaaatacttatttgtctgacaaaggtgcatcattatacataaagaatagttgccttcctaagcactgacacaaataaatatttatcttccgtacatagatgacttgcattaaaatttgtaaattttttattgcttaattgagaagcataatctctgaatattaatagacaacatggagagttaatgaagtttttgtcataatgcagtacatttctccaacattctctaataaaagtatttgtagctaactcaaaatactggtgggtcctatataattaatgcatcgattaaatatgaactacaggttatatcaataatataagactttttcttgaattataaatcaaaaagagataagagctgatgaaaactatccacatttacttttaggatgctaaaaaaatgaagaatgcatctagaaattgtattctatgtaactcagatggattctatctaactcagatgttatatcacatcttcctctgagtgttctcccacagctgtggtgtgcactactgttttttgtgaatttcaaggcaccttctggtttctattacatgaattgctaaaacatttaccatgctgcaggtgtctatacatgttatcctttgacttcctcatatacctttccttactaaaattctacaactttgcatcagcacagtgtttgctagttaattcttgaagttttttctaaaattccccacagaaaccattaaacatggattgtttcaccataagaaaaactaaagaatcaatcttcctgatattattcaaaacagattactttttcctacaattacttttctaaactgatacaacataatgtgtatttcttcaaactagtcaataagtagaacaaaatcaccagttttcacatttgattcagcacgagctttatttgctattcatgaattggatttacttcctatataaatatttctcccaatctttcttaccatttggtcaatgttaacaatggcacttgattcttgccaagtgaaaataattttaatttattatcttctacttgcatacgtattcgttttagatcacgtctatatttctgttttattatttttactatggctagatatgatattttggatgcttatttgtgcttataatgaagttgaagtttcacataattttattcctctttacaagtatttttatcaaaattatgaaaccctattttacatataattgaaaattgaaactaattatgaatttcccttacttaataaatatttgtcaaattttgctcaatattatggttcatactgggcaatggtaattacaaaacaaaaaaaaaagaacgatgcagaccttgctttgaacaagttcacaatgtggtagggaaaccaataagccaacagatgtaagtagtagtcatgtacccaatttcacagaaaaagtctgacatgaacatgtatagtagctgcagaataacctggtgtgtgtaatctattcatcctaaggcaaggagatttttaactgatggggtacttatcagcaaacagtcgagagagaagacatgaacattcttctgtaaaatgacaggaagcccaagtgctggaatgactggacaaaggaggtgaatggtgaaatatggaaagggacagtcctaatcaaagtcttattaatgaaggccatgaaccaaccaagctgagtttggattattcccttaaaactatattaaaacaggccgggcgcggtggctcacgcctgtaatcccagcactttgggaggccgaggcgggcgaatcatgaggtcaggagatcgagaccatcctggctaacatggtgaaaccctgtctctactaaaaatacaaaaaaattagccgggcgtggtggcgggcgcctgtagtcccagctagtcgggaggctgaggcaggagaatggcgtgaacccgggaggcagagcttgcagtgagcggagatcgtgccactgcactccaggctgggtgacagagcgagactccgtctcaaaaaaaaaaaaaaaaaaaaaaaaactatattaaaacatcacaaggatttatgaaagggagttaaataatcacattttgacttttggagagatcatagctgctcacaagactggaccctgggagaccaattaggaaaccatggcaataatccaagtgagagacaatcagaacttcaactaagaccgtgacagtgacatggaaaaaagagggaagcattttaatgatagatattaggaaacagagtctgcaagagcttttgacaattgggaaacagaaaagcccaggaatcaagtaggctacaccagaaatatccaaaggccaaatggggatactgtggctacatatatgttaaatattctatgttacactttaattattttaacttttaaaacttttaatttgtatggtagtattgatctaaatgtttttctttatcctacttctttaatattttaaattaaacctctggtgcgtaatattgagctataatatttactatattcattaagcctcaggcatacttttttacatttgccgtgtcagaaattggaatgcaccttatatttcttcttactgttaacatattaccagcaacacaaagcccatttcatgtttgggttttcccttatttcttaatccccatcccatctgcttcctttcacaggaaaccatttgtaatgtgtttgccgtacgttcttcagcatagatatagtcttgtaaaatatagtgtgggttttgtgtattttcagttccattaagggttttgtaaatcccatctctgtcctactttactcatccagccttgtttggggaccaatctatgtcacatatctggtttattgtttcatattgctatacagcatctcatagtgtgatttactgtattttattaatccattcttctggagatggatacacaggttgctttcaactccctaatgccatatacaccatccttgtatagatctttgcaataatttctcaggagtatatatccaggagaggaatacttgcctgtactttttaaatatatttcttcctcaaagagtattggaaaatttatttgactatgaatataaaaatatttaaaattattctcccattattgaataaatgggattgtggcaacaggctacctatgtgcataaaataacacgaatgtctattttactccttatgccaaaataaatcacagatggataagtattcaaacactaagaagaaatgaagtcatattaatactgggagaaataacatgggaaaattgaaaataaatctgtccatttttctaggttccctattatcatcctccttcacgcttgttcatctctctgcagtcaagtctcctcacacaactgccagatgattattttaaaacaactgaccaataatactcttgcactgttataaaaatctcagtttaaacattaacttgcactgcaatgcttcctgactacccagtctaaaataccctcccaggcaatgtcttctcaccctatttgaattatctggatagcttttattatttattattttcttccttatttatttcttgattttttttctcacacctctccagaaataaaagcttaacaaaattcacaatctttgttgtctaatttgtcactgttttctcaggacctagaatgtgcagggaatattaacagtgcatttgttgcataaataaataaaagggcatatacatatatatagagagagttttttggaacaggaagctttgtaatatcacagtttagaaatatttcataaggcattgagttgcattcttttaatacttgaacatatttctctgacttcagtgcaaacccacaaaggtagtatcggacatttaaccatcaagctgaagccaaacttatatttaacgagctaatatcaacatgttgtgccctatggggtaatgactgacatgtgcttaacaaatcgtcaccaccacagggtagggagatgattaggatcagttttctgccctaccatatcctcaatggctctcagttatttcttccgtgttttggagagaatatttctctactttgtttctttgactattttctttcaaaaataaaagaatctttttttctcattacattttatttgtaattgctgaagctacttaattttacattaattttcaatgtttcaaaataagttgtagtttatgaacaacaaaaaagctcactaagcttaatgacagtatttacactaatttgatgattggcttacttattttctgtaataaccaagaaaacagattagcttataaagcatataaggtggccaggtgcggtggctcatgccttgtaattccagcattttgggggacccaggtgagtaaattacttgaggtcaggattttgagaccagcctagccaacacggtgaaagcttgtctctactaaaaatacaaaaattagccaggcgtggtagcacttgcctgtattcccaactaattgggatgcagaggcaggagaatcgcttgaccctgggaggtggtggttgcagtgagaagagacagcaccagggcattcctgcctgggtgacagagtgagactccacgtcaaaaaataaataaataataaataaataaataataaaataaaatatataaggcagtgtataaatacatagatacatatgtgtgtgtgtgggtgtttgtgtgtgcctgtgtgtgcgtgtgtgcataatgatgattaattttatgtgtcaacttggctaggccatggtgccatagtatccactttttggtcaaacatcagtttagatgttgctatgaaggtaattttttagatgttattaacatttaaatcaggagacttagagtaaagaaaagtgccttccacaatgtgagtgagcttcatccaataactttaaggcttttagagaaaagactgaggtcctctaaaaagaaaagcattcagcctctaaactgccttccaattagagctgcagcattaacccttccctagatcttcagcagctggccatgcaaatatcagacatgccaacctgcacaatcccatgaaccaattccttaaagtgcctctctctctctgtctctcctctatctctctctctctatatatatactgttactctctctatatatatgtattgttactctggagaattctgactaatgcatgcacatatacaggcagatagatacataaaccataaacagatacatagaaagatacatggatagatagatatataataagaaaatatgtgagcaataattctttttttataaatttaactatgttagttgctaatttccagacttatatcctaaaatgtaaataatacattgaataaaccactttaatggttgcatattaacttataaaatagatttttgctaatattacatttttattgagaatatattcctatcaaaaatttgaatgagcaaagtgcattggttccatgtgtatttattttctacatataaaaattgaatttatatttatatttaaaaatattaaaattatctattatctatatttacattgaagttacaactctatgaatgataaattaatactttggaagtaatgaaagaaagctcctagaagaaatctgatattttgaactaacaatgtgagaaattcacattatctcaattaaagtattttattgatatttgggacatctaatgaccttctctccaagaccttgaggacagaaaaatgaattgtttctgaaaattaactgtaaattcattatgtaatggattggcatggtgctacaaagtcacttcaaagatgctgtccaagactgtcagatctggctgtaatctgttaaacacagtattaacatgtctggagaacgactgagcgaattgaaagtgggggtcgctgagaaggaaggtgaaaagaagagccatggaagcaatattaggcagagtcttcaagcagattctaaggaggagtaaacgctgatataaaaaactccactggaacaagcccagtattaaatatgccaccactgtgcatgtggatgctttgaactttctttgtgtaataaagcatgcaaatcacataactcataatccttaatatgtattgagttctcagctcacaaatacagtgcatagcacattacatacaatagtttatgtaagcttcaactcaactagatgagatgtgtactattgtctccatttcataaaaattatctccattttatgaaaattcacttgctaaaaactgcaaagttaatgagtaacagactaatagtcttaaaccactgtgtctgacttcagagcccatgctcgattactctgctaagctaatattttccagattcagattctaaattcaacaagttcagttacaattataattcaggtttacatttacttgttcaaagaaagaatgtgtgcttgatggagagtatatctcttcagactttgatgtggttctatttcttgtcacaaaataatagactgttatacatttataacttaatattcggttatatttgatttctcagtagctttcccaaatagataaaatataataactcaagaatagacaccttctattcatcagaaattttagttagcaccatgaatttagtaaatactattttgatcattagaaaatgcacttggtgaaaataagcataacactgaaagtaaaatgcaccaaaccttacacagcagtgatgcactcactctctgagttctcttggggcaaaacccagaatatgacctgaggcacattttctaatctttgtttcttccagttcattcaaagttgaaaattgttttcatctttattcagcattattttccagggttatcttctgaagtgttagttttattatatttaaaaatagaatttcctctgggaacacatggttttcttaaaatggtatttttttcacttttttatttcaatgatagagaagtgtaataggcatttatttatatcagttgggctagcaaaaacttgtatgattagaccaccttctccagtgttatatgggcaccataaaagttactatgagcctctgcaagcatacatgattttcattaagattattaagtggttagctcctgacaacttagggcactcacagggagcaattaactctttggctactgccatttagggcaggagcttggccagagtcaaagaatctgggctgcatagaggaaaatttattcatggagcagctaagcatagcttaacgtactcagggcttgttggccacccttccccagaaatgttttatttcttttggtcctttcctcttttttgttttccctaagttttttgttattgttttaaagatgctacagaaggggaaagtggaaccaagtaagtcaatacagttttgttttgttttttaacgcattaactcaatatttgttgaatgcctccaaatcaaggcttggtattaggttttagtaattccatggaaaaaggggcattgtgcttattccctatgctcacaagttattctctagttggttaaaatgcagaaaattatacaaattttgtctgtcatttatttatggcaactgcaaacatggaagtttcttcatggtttggcatttgagttcttgaatattgagtatagtcaggattaaatcaatatcaatgcccttttcctttctaaatagtaaaatgttgcaaacatttttgtttaaaagggccatttttaggccaattaaaactattaagttaaaaactgagaattatttttaaaaaatctgaattattaacaattgcaatttttgttgataataaaaacacactttatccactagtaatattgtatttccttaatcctgctaataatataaactgaatcattattacctaaatattaagttttaaataaaaacttgttagaattgataatataaatatagtatgaaaattaactgcaaagtaatatatatcaaaattaatggcaaaataatatatatcaatatgttgcatgcttcaatattcatttcatatgtattttagaaatcacatttaataattttaggcagaatgattgatagacatatactcatatgatatagatgatatgagtatatatatgagcatatatacacatgagtatatatatcaatagtttctaatattatgcaattaactttgaaaataacattaacctttaaggtaagcaatggtcccttattttaatattgtatactaagtaattacaaatagttcaacatacctgatttctgaaatatttaaataataaagatttttaagctcattaaagtcataagaattaaacagaactaataaatcttattgaaccataaatctcctaaataataagactggtagtgtattaataaggtaagagtgttggacctgtgaaacacctttacgttttctttttaaaaataaataatcacactacagctgttaaaaaatcatcatatctgatcagttgtaagaaaacttaaacaaccacgtacaaaggaaacactatcctcacagtgccattgaagaggaaaaaaatgttgatcattaacatgagaataaacatcacctccaacaaaactagtatgagtatctctagatttatggccaaaatcttttctaaacaaactgaaaaatcatacaatttcatttgcaattgacatttcatggccctatgtatatgctagcagacaatgggggaaaacctcaaaaatcgaaagcaatcataagtacttcatgactaaataaagattctctagcaatcccccaaatcctgtatctcaaaggaggtgaaaattatattatttgtatatccaaggaatataaagcacatgttgtttttgattcaaacagaatgaatatccttaagcaaatgacagagaaaatttagtgaaaatgttttatatataataagtaaaaataactggttaaagaaatgcttatgattataattagagatctttgtagttgtgttcagctaggcagtgtttttatctagtaatagaaaaataatttctaggtggaatcaagtataacttaccccaaccattagccaaggaggcttgcaaccctaggaggcttctgattacggttaatgtctggacatgcctagcgtgtatcactttgtttct

SEQ ID NO: 2618 - DNA, 34911 bp, Homo sapiens
gcggctgggcgaacgggctcggcgctcaggtggctccttcttcgcttctcccgatccccggcggtgccaggcacggtgccggctgccgagggaacgcctttgtgcccggtgctgggaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggtaggtgcagagcgggaagcgagcgaagtgcggcgtctacgccgccgggagcccccgaggcttgtgtcggatctgagcaggggccactctcgctgtgtcctggcacccttagcccctggtctttgcaggttcgcagatgctgctgctctgattccgaatgaagggctactagtgctgtcgctgtggtttttaggtgtttaaggaagaagtggacgaaatcatccgtttggttatagagaatacctttccttgtgtgtgatggctggcaagagtagttcggggatggggaggggagaagcaatgcccactgtcttcgctcagtacctcatgtacactggggtgtcgttctctgggacccgtgcccgacctggacgatgtgaaggaggccgtgacctctgggaggatgcatgtttttaagaacgactctcccggcctaacgcaaggaccttcgccctgttttcagcccaattgctgttcgtttttgctgcttccctggattaaggagccatggtcagggtctattcagaggccagccggcaggcggtccccctgtgacctaaccatcccctgcacctagcaatcctccttcctggaatttgtgtaacctcttattagcataacgaaaacaggtaccttggcagtcacttagtgactaacaagttccctttggtttatgggtccaaacccttctctggcttaacttctttctgaaaccaagtttaccaagatctgttgcttgaaacatctggtgctccccatggaacgtttgagttcagtctaatgacactttaacaccagtttccacaaaaccactttacccaaagttccttccaggggacttttaaaattctgtcttggctcaaactttagtgtttgcaactggtaacgatcaaccagtggtgatcaactaatgttcttcgggtgttgtttttgtggggcgcattcttatgcaaaatgggaattggggctaaactggtttgtttgttgctcttcagaattgccgtttgtgtaggctgttgccagacaagcttctccaccctcctggaggggtcattgtgtggaagtgctcggtgattcactgttatgctgatctgagcccttcctcttcctggggaccggaaccaatggggtgggggccagtgagagtcttggagggatccttctgtgttcaggatatactgtgggaggttcttccccactcactcatccaatctggaccccatggggtctgtctcacctaaatgctctgccctctaataagtgagtacttgtgcactaccaccattcctggttctgtaacacagagttgaaacctagtgctggatgctgtaccagatggcactctgccacccacacccgaatgccaacctgtgtgcaaagtgcacagggacctggagggagaagagaggaagctgttcagtcctcggaaacttccctcccggcatcacctgggagacaaagtggccttcccttggctgtttttttgtttgttttgttttaaagacagggtcttgctctgttgcccaggctggagtgcaaaggtgcaatgacgactcactgcagcctcaacctccccggctccagcaatccttccacttcagtctcccaggtagctaggagaactggcgtgcaccaccatactggctgattttttgtagagacaggtctcgctatgttgcctaggctggtctcgaactccttggctcaagtacccatcccatctcagcctcccaaagtgctgggtttacaggcatgagccaccatgggtggcctagactggcaggcctgccttggaggcattttttgagcctaggccagccaaaccactgtggaggctctgaatccagctttcctaggggagagagtgaagttccccgagaaccattctcctggcagtgccttcctggctgggctggcatgtgtgcaccatgttcactgctgggatgacctggttacattcaatctggcaaaaatcagctgtccagctccttacagttgtcacggccagttcacttttgttgccttttacatcaaccttgtgtggtgcactggccaggcacccttatatacaatttgtacttaagaaaaatagggctgagtgcggtggctcacacctgttatcccagcactttgggaggctgaggcaggcagatcacttgaggtcaggagttcgagaccagactgggcaacatggtgaaccccatctttactaaaaatacaaaaattacttgggcgtgattacacatgcccgtagtcccagctactcgggaggctgaggcacgagaatcacttgaatctgggcggcggaggttgcagtgagccgagattgtgccactgaactccagcctgggtgacagagtgagactctgtctcaaaaagaaaaaaaatgaagaagaagaagaaaactagaagcctaggttagggatttggctaaagccacatgtcagtgccaaaagagagaccagagcctgagtctcttgactctcagactggcacattaattaagtacctacacggtactcaagctcttgggacatctaggacgtctcagtgcatctgggatggggtgactcagccttccactgcccaggctaatcactctccagtgctagattgtgccattcataatgaagaggttgcaatttggaaccatgactttggggagaaaatgggctggaaaaacaacactggtctttgcggtcagctagacctgggtttgggagtatcacctgctagtatgccctcccataagctgcttgaatcactccaagcttcagtgtctcatgtcaagtgggagaggaatgtgtactccagggggaggtgtgctgattaagtgggaaaagcccatgggaagagcagcatggtgcctggattgtagctgcgctcttctgccctccgtccttaacccaccctccttcacctgtccccactcactggattccttttggcttgtctgcatatctagtttggttggttattgaagaagtggggtatgctagacccagactgcctggttttgaatcccagctctaccacgtctgtgaccttggacaagttgcttatcctttctgtgcttcattctgtgtgcattcccatgcacaatgggaatcagaaggggcttacctcagagggttgatgtgagaattaaaaagttcattccatgtaaagggcttagaacttgcctgtcacttaagtgcttagttagtaaatgttagctactgttaacttcaaagagacgaagtgctttgtcccataggaacataatttttaattttaaaaaatagataattccggtggcttacatttgagttgcaggagttttatagtataattttccataatttatgtacatatgcaaaaatattttggagtaggggattttccaagtatcaaaaggagtactgttttggtttcacttcttactggggcttatcatgatctgaaaactgactctggaattccccagggctgacacgcttcccttcataaccacagtcattcacaacggatgaagcatgcattcttccaagtaacacacaggttaaacaaagaaatgaacagtttttgtagaattgaatgtgtaaacgtatggaacagctgcctacagccagcttcagtatttcagagagctgttgccactttgaaactgagagggcttgtagtcattttgatgtggtttcctatcctggtacagagaccctctgctgggtgaggggtctggtaagacctcttgattaactgcctgaagaaactgttgggctgggccgggtgtggtggctcacacctgtaatcccaacactttgggaggccgaggcaggaggattacgagatcaagacatcgagaccatcctagccaacacggtgaaaccccgtctctactaaaaatactaaaaattagccgggcacggtggcacgtgcctgtagtcccagctactcgggagcctgaggcaagagactcgcttgaacctgggaggcggagggtgcagtgagccgagatcgctctactgcactccagcctgggtgacaaagcgagactccatctcaaaagaaaaaaaaagaaaagaaactgttgggctggtttcttcagggcacagagagaatctgatccagtcaatatttaattttttttgggacagggtcactttgcctcccaggctggagtatagtagtaccatcacagctcactgctacctcaacctcctggactcaaacaattctcccacctcagcctcccaagtagctgggactacagacgcgcaccactgcttctggctgattttttttttttttaatagaaataaggtctctctgtgttgcccaggctggtctcaaactcctgggctcaagtacaggcatgagctactgcacctggcctcaatatttaattctaagagtaaaggaaagagaaagaaggtccttgattgttaaagtaaaaattgtttttcatttcagaataaaaaatagtccctaactcctgggcaattggacaagagatgaaatttcagacatttgcctgtttttaactcacagctatgttacggaaatagtcttataattacatacattgcgtttatgacaagcgttcacagtgggattttcattttgtttactaaaggaagttgtaaaggtgcactattgtctttgtatgggaaaggatgtcataagttactgtatgaatttgctagggctgccataacaaataccacagactgggtggcttaaacagaaatttattctctaacagttctggaggcaagaagtccaagatcaaggtgtcagcagattggcccttctgcgggctgtgagggagaaagtgttctacagctctctcctgccttttggtggtttgctggcaatctttggcattccttggtttcttctccatcacctgagctctgccttcatcttcacatggcattctccctatgtgcatgtctgtatccaaatttcccttttttgttgttggggtttttttgttttgttttgttttttatttttgagatggaatcttgctctgtctcccaggctggaattcaatggcgcaatctcggctcactgcaacctctgcctcccaggatcgagcgattctcctgcctcagcctcccaagtagctgagattacaggcgcctgccaccacgcccagctaattttttaatttttgtagagacgagggttttgccatgttacccaggctggccagatttccctttttataaggacatcattggataagggtctaccttccttcctatcttaacttacctagttacatctgcaatggacccagtttccaaagtatgggggttaggagttcaacatgaattttggggacacagttcaatctataacaatcaccatcttccttccatcaattcttggggtgttcagcttgcttatgattaaaagctaactgagctgtttctgaaagcagctggtctatatggaggatcatttgcataggacttggtgtgtgctcctgagaaaatctggggttttgctggcttgatgtgcaaccctgaggaagcttggctcaaaccatctttttccagtcagtatttcccctccattagtaggttacagagaaatcatctttgccaagtctcttgtatcattctccttctttccatgacccctacttctcaacccacacagtgggaaatgagcatgcagggcccaagccctgacttgaggcaggctggtctaggggtcttgtgtgctggccctggagtcagaccagctggggaagatcccagtgccacactggctgtgtgatctggggcacacttcttaagtgctctgagccttggttcccttatccgtaaaatggaatagtaagagcaccttagggaagtggtggtgaggattgaatgagatagtgcaagttgagcagggttgatacactattaataattcaggtggggcttgtaccgcttcttccccaatttactcccgtccattgtgttgtcaggtgcaggtttccaaagcacaccttggttcgtctctctgcgttttgtgggatgcctcctctagctcgccattgcctacttattcagtattttgtcattcagggctgcccttgtggcttatgtgacccagcccccagctgctcttgctgggcctctccatgtagccttctttccaggagaaaactttcttcatccctttgcccaacaaccctatgatctcctgccctttagtctgttcttacctttgcccggaatgccttcctttcattcctctcaagtcttttatggttaaattctcaaactcagctcaaccatcacctcatccataaaacatttcctgttcttccctttgagccctattgcactctgtaacatttcttctataggacttggcatcctctcctttgaactgcagtggctggaatgtggagactgggtcttggctttcacctgaaatagcacccagggacagggttaggagcagaggtcagttcagccagtgtctgtctgttgagcacttatcattcatgacattgtgtttgcagaacttcaaagataccatgggtgtgaaggtgtcttgggtccttcaaggcccgagtctcaactagaaagtaggtcagatctgaaatcctgatgggccatctgactatttaatgccaactgtctgagtggatgagggcagtggaaagcagactttcaggctagcattataattaatcaagtggtgaaacttgggattgcctaaagttatatagcaagttagtgaccttgctaggaatagaacaggtcactgttcttaagcactgagtaaaccataccttctgctcactataaaacttcaaaggtaaaaacaaaagtctgtctcgttcatggcagccttgtgataggaagagtttattcttaaaatcttgttgcttttttttttttttttttttgagagatagggtcttgctgtgtcacccaggctggagtgcagtggtgcagtcatatcttactgcagcctcaaccttctgggcacaagccatcctcctgccttagtctcccaagtggctgggatcacaagcatgcaccactgcacctggctaattttttaaaaatttgtttgcagagacaaggtcttgccatgctgcttaggctgctctcaaactcctgggctcaagctatcctcctgcctctcctcctaaagtgctgggattacaggtgtgagccaccgcacccggctggatctatgttaatattcaaatacaattccaggcagctgaagcctgcctaggctgaggtacatccctgagttgtttttggtggagttgcaggtggtggttggcagaatgtgggcaagtcacagaggcaagacgtgatcttttgaaattggggagaactgggttcctgtctttatctgtcagagttctccagaaaaacagaatgagtagaatatgaataaataaatacacatatacacacagatttatttcaaggaattggatgatataattgggaaggctggcaaattcaaactctctagggcacccagaaactctggaagctccgcaggagctgcaatgctacaggcttcagggagaatttcttctttatcaaggaaacctcagttttgctcttaaagctctccaattaattggatgagacccacccagattattgaagataatctcctttacttaaagtcagctggttgattgtagatgctaaccacatgtacagaataccttcagagcaacacacaggttagcacttaatagaatgacttaagaacaatagcctagctccttgacatttaaaactgaccatcacgccatccagctccacctcttcctgggaaaccatgatttccaaattggtaaatggagaaaattaacatctttcttgaagagttcttgtgaggattaaatgacactgtatgtttaagggctggtacagttcctggcatagtaatagatcgtcaacagatgattcgcttttattgcttctgagctccaggtcaaacctccaggacaccccttgtcttctagaggaaattaccaaagactggaatccactttagcatgaaaggaacccttccctccccaagggggaggtcatactggaaatggttgaatgaattggggcagttccatgttgagaagatcagactgaggaaggatcatgatcaccaacttcaaatatttgaagagctgttatgtgaaagaggccttggacttgttgaggaggcagaactctaaatgccaactgaagttctgctaaagctcaaccgcaggaagaacttaatttcttagcttctctctctttttttttttttttttttttttttttttgggtcttacctttctttagagtttctccaagggtctaagggaaatccagtgacaaaatgagagcctcctggggcactagttaaaatgcagattgccaggcccacccatctaccaccaggctgaatgaatacctctggagttttccagacccccaggtggttcttgtgccatcccaagcttaaggtcctctgccttgacgctcctcccccagggctcctcagtgtccggcaatacctgaatggaaggagtgtctggctgaaagcccttctatgaatttaaggctcagagcagttaaaaaactgggccaaagtgacttaccaggtacttaaaagtcaaagcccaatttccctagctccttttattattttctaatatattctaaagaacatctctctggatgggggtggaggtaggttggggaatggggatctagcatgcaaaaacaatgaatgcagaattagcttgcacataagtgcagtttaaaattcatgcttaatgccaggcgcagtggctcttgcctgtaatcccagcactttgggaggccaagacaggaagatcacttgaggtcaggagtttgagaccagcctggccaacatggcaaaaccccgtctctactaaaaatacaaaaattagctgggcatgttggcacacacatgtaatcccagctacttgggaggctgaggcacgagaatcgcttgaacccgggaggtggaggttgcagtgagctgagatcacgccactgcactccagcctgggtgacagagctggactccatctcaaaaaaaaaaaaaaaaattcattcttcagttctagaacaggcaaagctgagctaaaaatattagcgaggagaactttctgaaaagttctatatcgtggttggggtgtcagtttacatgggtgcctccatttgtcaaagtgtgcacctaaggtttctgcatttctgcgtgtataaatcctgcctaaaaactattaaagaagaattgagtggggaggggtgaaggtattgatgataagagtgctgatcattgttgaaactgggtaatagttacatggaaagtgcactgtataatcatacagtgattctgtattctgtttacgtatgtttgaaattttccataataaggaaaaatacaaaaaacatcatgtattttgaggaccagttggcctattctgcctgctgggataatttaacactaaataaatgaatcataaatgatactctttactgccgcccccatggaacatgggcctcttatgtcctagcttcacctacctagtggatatctgccaagtttttcagctgtttctctgccttctccaggggactttagaagtaagtttagactatttctttttttttttttctgagacagggtctaactctgttgcccaggctggagtgcagtggcataatcagggctcactgcagccttgacctcccaggctcaggtgatcctcccacctcagcctactgagtacctgggattacaggtgcgcaccaccacgcctggctgatttctggtatttttgtagtgatgggtttcaccatgttgcccagggtggtctcaaactcctgggctcaaatgatccacctgccttggcctcccaaagtgctgggattataggtccatatcacattttattatggaaaatatcaagcatttattactagtggagaaaatggaggtggataatgcccccctccccatcatgtagcttcaacagttaccaattcatggccggtcatgtttcatctttaactcttgccctctctgtccgcccctctattcttttgaaacaaatcccagacatttcttagcaaggagaagagaaaaaccaagcattgttcctttcttactcttccactacttccattaactcaaaaccgtctgtaaatattttagtatatatccccaaatcataaggactcttctaaacataaccacaatgccgttagcacacctaaaagaaattcccaaggattcttttttgtttttttgaaacggagatttgctcttgttgcccaggctggggtgcaatggcgcgatctcagctcactgcaacctccacctcccgggttcaagcaattctcctgcctcagcctcccaagtagctaagattacaagcgtgcgctgccaagcccagctaatttttgtatttttagtagagacgggatttcaccacgttgaccaggctggtcttgaactcctgacctcaggtgatccgcccacctcagcctcccaaagtgctgggattacaggcgtgagctaccacacgtggccaggattctttatttatttattttattatactttaagttttagggtacatgtgcacaacttgcaggtttgttacatatgtatacatgtgccatgttggtgtgctgtacccattaactcgtcatttacattaggtatatctcctaatgctatccctccctcctcccccgaccccacaacaggccccagtgtgtgatgttccccttcctgtgtccatgtgttctcattgttcaactcccacttatgagtaagaacatgcagtgtgtggttttctgttcttgtgctagtttgctgagaatgatggtttgcagcttcatccatgtccctgcaaaggacacaaactcatccttttttatggctgcatagtattccatgttgtatatttgccacattttcttaatccagtctatcattgttggacatttgggttggttccaagtctttgctattgtgaatagtgccacaataaacatatgtgtgcatgtgtctttatagcagcatgatgtataatcctttgggtatatacccagtaatgggatggctaggtcaaatggcatttctagttctagatccctgaggaatcgccacactgacttccacaatggttgaactagtttacagtcccatcaacagtgtaaaagtgttcctatttctccacatcctctccagcacctgttgtttcctgactttttaatgatcgccattctaactggtgtgagatggtatctcattgtggttttgatctgtatttctctgatggccagtgatattgagcattttttcatgtgtcttttggctgcataaatgtcttcttttaagaagtgtctgttcatatcctttgcccgcttgttgatggggttgtttgtttttttcttgtaaatttgtttgagttctttgtagattctggatattagccctttgtcagatgagtagattgcaaaaattttcccccattctgtaggttgcctgttcactctgatggtagtttcttttgctgtgcagaagctctttagttcaattagatcccatttgtcaattctggcttttgagccattgcttttggtgttttagacatgaagtccttgcccatgctatatgtcctgaatggcattgcctaggttttcttctagggtttttatggttttaggtctaacatttaagtctttaatccatcttgaattaatttttgtataaggtgtaaggaaaggatacaatttcagctttctacatatggctagccagttttcccagcaccatttattaaatagggaatcctttccccatttcttgtttttgtcaaagatcagatagttgtagatatgtggcattatttctgagggctctgttctgttccattggtctatatctctgttttggtaccagtaccatgctgttttggttactgtagccttgtagtatagtttgaagtcaggtagcgtgatgcctccagctttgttcctttggcttaggattgacttggtaatgcgggctcttttttggttccatatgaactttaaagtagttttttccaattctgtgaagacagtcattggtagcttgatggggatggcattgaatctatacattaccttgggcagtatggccattttcacgatattgattcttcctacccatgagcatggaatgttcttccatttgtttgtgtcctcttttatttcgttgagcagtggtttgtagttctccttgaagaggtccttcacatcccttgtaagttggattcctatgtattttattctctttgaagcaattgtgaatgggagttcactcatgatttggctctgtttgtctgttattggtatataagaatgcttgtgatttttgcacattgattttgtatcccgaggctttgctcaagttgcttatcagcttaaggagatcttgggctgagacgatgggattttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagcttttattagtttgagatacgtcccatcaatacctaatttattgagagtttttagcatgaagggttgttgaattttgtcaaagctggccaggattctttaataatcatcacatatctagtcactgttcaaatttcctgttatctcatgaataatttttcatagttggtttgtttgaatcacaatccgacaagatccataccttgcattgtatccagctgtttttgcatgataaagtagtattcaagcagacaggtgctttactggatttgtatgcagtcagcttctgccagcactgctgttgtaatctgtgtgatgcagtgtgaagcgagcgggtggggcgggggggaaagaattcaccctggatggctcaatggaagagacttaaatgaatgacttcttacagccatgtggtcaggggcagacagggacgttggagtgcccagaggctcccggtgagaagggatggaaggaattgctggagcccaagatgaggggctgtcatcgtggatcatggaggaaatgctctgacctcccccttggctatacctgtgttctgctctagccttcccctggtgaacccagctggaagccagccagcacaggagccctagagtttctcagggacacacatggacctggaggggcaaagaagaaccagtactgtggccaagagctggctgtgaaataaaaatgcctgccgccaaatcctggttctgtcatttactagctgtgtgacttaaggcaagctgtttaacctctctgtgtctcagtttcctcctctgtaataacaatacctaccttacagggatgccgagcagcttcaatgagataatgtacatagggcctggcctacagccagtgctcaatcaacacaagctggaattattacaaaccactattaaaaaccacccaggccaaacaggacacagtctctctttatctggctccatgtttctctctagccctgatgactctagcttgccttcagcctagagacaggcctcagagtgctttggccttaccattctccctctgacgtcatccttctcataggcaccacactgttctttgtctttgaaggttcttccaaccctagaggtaaaagcaggtctccatccctcctcctccagatgaataaatgaaaggcctagctaaagcagtcgaggctgttcacaaagggtattttcaggggcaaaccctctaccacatgactcagatcccagtacagcataagcggcacacttgccagttgacaggggcttcagagactttgcaaggagaaaagaaaaggccagctttgctcctttcttcccctttccactacattactgattcagaaaacctttgcgcaagactcttctgctctgcttcttacccgggtggcaaaggtgaatggctggagggcaggtatcatgtttacagccagtaggaaagaaaagacccatataatttgtgattttagatagaacaggataagtgccataagagaaaacctagaagacatgggattttagagacaggagcacccagttttggttaaagggcccaaactgagaacattctggatcctcacagagcacagatgggtcagttaccagccagagggatgtggtagggcaggcctttccagcaggtgccagttctgtacaagtcagtaggtgtttagttgtgactaagggccccagctcacaagtttacgatagcttcctgtgtggcaggtgtgaaaatgtactttttttttttaattgtcccagccccacaagggtaaaagtcacctgctcacaaataaaaagtaacttaatgatgggtttaacttgtctattctttaaataaagagcatgaactataaacctcaagactacgcaacagaactagtaaaacatactctgtatctcagctccatgtcattgagttgagaagaaaaacagaaaaagaaagcagagataataattactggctactagggctagctggttttgctttctcttgaaatccggattgagttattggcagttaatcattaattgcaaatcttcagaatcaaaaagcagtagcaaggagtaattcatgtttatatagcagcttacacatatgaaggggctatttttaaaatgaatatctgattttttaattttttaattatttttaattttttatttccaaacaggtggtgtgtggttacatgagtgagttctttagtggcgatttgtgagattttggtgcactcatcacccaagtagtatacactgaacccaatttgtagtcttttatccctcacccccctctctcccttcctgcctccccccaagtccttgaaatccattgtgtcattcttgtctttttttttctttttttttgagacagagtcatactctgtcacccagactggagtgcaatggtgtgatctcggctcactgcaacctccacctcctgggttcaagtgattttcctgcctcagcctcccaagtagctgggactacaggcacacgccaccacacctggctaatttttgtattttaagtagagacagggtttcaccatgttgcccagactggtctcaaactcctgacctcaggtgatccacctgcctcgcctcccaaaatggtgagattataggcgtgagccactgtagtctccatttccatccaggttgctgtgaatgccattaattcgttcttttttatggctgagtagtattccatcatatatatattatatgattatatgcatataatatatatataatatagagattatatataatatatatagagagagattatagatatatttctatctcacaatttctttatccactcattgattgatgggcatttgtgctgataccacatttttggaattgcgaattgtgctgctataaacatgcgtatgcaagtatcttttttgtataatgacttcatttcctctgggtagatacccagtagtgggattgctggatcaaatggtagttctactcttagttctttaaggaatctccgtactgttttccatagtggtttacattcccaccagcaggggagaagtgttcctgaaggggccgttttcaactaattccttaaaatatgaattagatattatcttctcatttcacacatcgggaaactgagggtcaaagaggtttagcaactggcccaatgttacccagctactgggtaggataggtctttttactcagctgttttgaacttgggacctcctagccactaggctgttttgggctttgcagactgcacattatattacacttgattctagccaaaaggccaagaagcaattgcaaattatattacaaattccgtaggccttttttactttgtaaatattacagtagtaaatcctccactcctccctgccttgagattctccctctctctccctcaaggtagaataattgctaactgttacaagttgggttctctgggaagcagactctgagactgcctttagtgtgaaggaggtttattagggggagccattgggatcaataactggagacaggcaggattagacagaagcagaagtcgaactgtgatgcaggctggcagaacccagcacctgggctgacatggatgcatcagacttgtcccacattgggccaagatggccttgtctctttaccctcgcctgacaggtcatgggatgtgggcacactgggatgggtgtgaccttaggggaggcgactcttggctgctggaggctggctgcccacaggtatgtgggaatagccacaagtcctcctttgaaggggacctgggctgcacatctccccatgcatcccactagccctggaggaaatgcttcctctcatttatcacttacaatgcttgttgtgtttattatatttgcttcacaataggctctcaagaaagaaaagttgaatgaatacaggaaggaccatctaagaagatacttattcaatacctaagtctgtgcaggttgaagtatttttcttccctcagtctgtggaattcagtctgccatccagattcttgagagtggccgggcgcggtggctcacgcctgtaatcccggccctttgggaggctgaggtgggaggattgcttgagcccagaagttcaagaccagcctgggcaacatggcgagaccccgtctctaccaaaaaaaaaaatgcttcttaagagctatgcagtctcttcttccccttcttaagagctatgcagtctcttcccctgtggcctcaggtgggtcaccatatgggatagtcctggtttatgcttgttgcccagcctaatggttaatagtaccctcttaccctctcaaaagtggatgggtttggtgataaattatacggtcacttattcatagacctttggagtgtcagagctggaaggggccctctaaggaaaccaggttttcaagactgatgtgacatggtccccaggtcttggtgtcttcctctccctacccggctaaagaagaaatatccactgtagccactaccttccttcccttggctctttcagttgctcatctttaagagcaggcaggcactctaacatttcgaatctgtccccacctcagtccagagttgtgcccctactatcttcatattcaccccctcgtttcctatgtacgctgatacctgcaagactgtcctgctaatgagctgtgtttctcaccttttaattagcaaatattaagaaacaaacccaaggtaggtggggtgtgaggaaatgggtttgctcacataccagatggcagtgtaggttggaacagcctttttggatgtctgttggtatatcccatgaaataagtttaaaaagttgtcagaacagtttcttcagaaaaacaaaaaactcctggcacagacagaattcaaggggatttctttcaaatattccaagtatcaggaattccaatgttaaataaagcttcccaattcttttttcaaaaccaggataacagtgataccaaggcctaaaaaagcacatcagagaagaccctgactcgctcttggcctgcatgactcagtccttttggaaggctgagtggagaggatcacttgagcctagaagttttgaaaccagcctgggcaaaacagcaagacccttatctctacaaaaagtaaacattagccaggcatggtggcatgtttctgtagtcccagctactggggaagctgagaggtgagaggatcacttgagcccaagagtttgaggctgcagtaagccatgatcaccagttttcatctatcagattggcacttttatccattgttggtaggaattataattggcacaaacttttttgaagggcttttcagtagaatccatcaaataaaaaacacacatatccattgacccagcataaattccaggaatgtatcctacttgcacacgtgtgcaaagaagtatggatgaggagattttaatatctgttacaagaaaagattagaaacaactatgcaccattaagaagccagttaggctgggcgtggtggttcatgcctgtaatcccagtactttgggaggctggcaggtggatcacctgaagtcaggagttcgagaccaacttgttcaacatggtgaaacctcgtttctactaaaaatacaaaaattatctgggtgtggtggcaggcacctgtaatcccagctactcgggaggctgaggcaggagaatcgctggaaccctgcaggtggaggttgcggtgagctgagatcgcgccattgcactccagcctgggcaacaagatcaaaactccttctgaaaagaaaaaaaaaaaaaagaagccagttaaataaactatggtaagaggcaaatgagtataccattcggatattatctatgccttgaattcctttgtctccttttttcacatagctagctagctctttcacttaccataacttgcagttatttcattagttcacttgtatttttggttccctctctctttagaatgtgagatctggccaggagtgatgacccacacctataatcccagtgttttgggaggccaaggaggaagaattgtttgactagcctgggcaacatagcaagaccccatctctacaaaaaaaacaaaaatagaatgtaagatgtgaagggggcagggtctgattgtattttttactgtcgtattcccagcactagtgttgtatttgatactcaatttaaaatgactgactgtatctcaaatacaagtcatccttattggtgaagcattctcattaaattcatcagcaagaatatcaggtatcaccattattatttagcattatttgggaagcatagctaaagcaattagataagaaaatgaaataagaaatttaaatgttagaagagttgaaaatattaaagtttatatgtctatgcccttgggggcaaaacacaaataaacagaaaatttaatgggagaaattctgggctaaccctttgctgttgccttagccaaagtgattttgctatgtaggcatttttaggtgaaccttttagctaaatataatttcaaacttttaaaaatggcatatatataccctttacccagatttacctatttatgtcttgcctcatttagctatattaataacgatgtctctctgtatacatatgtgaattgaaaccattgcatccctcatcacccagatacttattagtgtatatttcctaagaacagtgattttcttttctatacccagttatcaaatcaggacatttaatctgaatgtaaggctactatctaatctacagtccattttcagaatctgtcagtatgtatttgccgagtctctttagtcacctgtaatgtggaaacactcctctctcagtgtttcttcacctttagattgttgaagggcatcaatcagttagtttgtaaaaatgacccccaatgttgatttatctgatgtttcctcaatgattagattgagattatgaatttttggtgagaaaatcacagaaatggtattgtgtcctccatatcaggagaccacgatgttggtttaacttcgtattttgatgatagagttgaccatttgatttagatggtgtctgccagatttctcctgtagtgttattatttttctttttgtaattaacaagtaatctgcagagtgatactttgagactctttaagtatcttatttctcataaaattttcactccttaaattaagcatccattgatggttttctaattcatcattctccttttatatttattatttgtattctactataagaaagatttcctttttccttcatttatttgtttatatttgagtgcactcattgattcttttattcaactcattttattcaatgagttatgatccattattatattatacctaattttggcttcctgtagtgtgaattttgatcatacagaatttctctgcctccagtccttctcttcctgagttttcagacaagacatcttacatacctttgttaccaattcattacactcaaaaagtttccccccacaaaaaaagccttcccagactaaagtttgcttgatcaatttctctatgggcttgatctgtatcaaccacttgtttccctgttattatttgtgtaatataggtgacattcttgtgtttgcatgtttgtgtgtgtccatgtgtgttgtattaatgcacatattacagatttaggggactttgcttcatggttctaaaatagatcatttgatttcgagattagaagtttctctctctaccactagcaagtttttaaacaaagttagctgcctcgggtatccaaagtttttaatttaattatattcagatttaacaaccacaaaaaaccttaccttggcaaaagatgagaggtaaaaagtgatcagtcaccttttcttccttccccagatttatataggaatcagtattgttgcaggaaagaacaatctatcagaagtaagatctctatcaaagtcttaggatattgtgtctaagagttcagctattcaacaaatatgtagcaagggtctgttatgtgccagaatctgggttacgaagtggccaacagcaggaaccaagcagacagagcccttgccttcaaaaaactagcattctagtaggacaaacagcaaacaaataaacatggtaatatatcagctggtgctaaatgctatggagaaaaaataaagcaagataagggaaaaagattttgatgtagttttttatatagagagattaagaaagaaaactgagatggtaaatatttgaagagacctggggtcaggaggataagagggttgagagagcttacaggcagaaagggctgcaaatacaagggctgtgaagtgggagagtgcttggtggacctgagaactgagccttgggacattgctatgtttggatatcaaggggatgaagaatcagcaaagcagaagttcttgatgaggtaggagaatagagaggtacttggatgccaggtgaagaagctgtttccaggaggagatggtaactaagtcaaattttgctgatgggtgaagagaaaatacactgagtacagatactctttggaggtttttgctgtcaaggggagcaaaaaatgggatggaatctgaagactagtgtgggaccaagggaggggtttttaaaggtgggggtatttgtgtatgatagtaggctgatgcgaattgtccagtagatgagaaagaactgttgatgcagaagagaggggagagtagcaggagcaatatcttgagcacatgagcagggttgtaacggaaatgtgcaaagggagagactgattgagctaggactaaacatcatctacagtgtctagagggaaggcacagtgtcagagttaggcacaatcagacagagaagccagtaaaccaagtggaccagcagaacatcagcctccttttttcttatcttgccttgatttttatcctttcttctggcatctgtaaattgccatttcttcaaccttcacttaaaaatgtttttctgtggtttggtgggaaaaggatgtgccagtgtgtcctgttcctggaagaaacagaaagagtgaaaaagtttgacaagctttaatgttatagggaaaaaatacatccagagagcttttaacatgatagttgaaactatctgaatatgcagtacactctaaatggtaaccatatttgaatgtttagaagaattctctagccttttaattatttaggtctccttatttataaagtaaattaaggtagaaggacttatctgggtaaataagtatagatctgtggagatgttttacatttatcattttcctgattataaaaggaatatggcggggcgtggtggctcatgcctgtaatcccagcactttgggaggctgaggcggacggatcatgaggtcaggagattgagaccatcctggctaacatggtgaaaccccgtctctactaaaaaataccaaaaaaaaaaaaaaaaaaatagctgggcgtggtggcaggcacctgtagtcccagctacttgggaggctgaggcaggagaatggtgtgaacctgggaggcggagcctgccgtgagccgagatctcgccactgcgctccaccctgggcgacagagtgagactcaaaaaaataaataaataaagcaatatgtgtttgttgtaaaatattcacagttatagacacgtataaagtgaagtaaactctttcccaccctgttgccaaccttcagagagaaccagaattaatagtttataataatagtttccgccgggtgcggtggctcacgcctgtaatcccagcactttgggaggccgaggcgggcggatcacgaggtcaggagatcgagaccatcctggctaacatggtgaaaccctgtgtctactaaaaatacaacaaaaattagccgggtgtggtgccgggcacctgtagtcccagttactggggaggctgaggcaggagaatggcgtgaacccgggaggccgagcttgtagtgagccaagatcgtgccactgcactccagcctgggcgacagagcaagactctgtctcaaaaaaaaaaaaaaaatagtttccatatttgatcagtgtttgcttccaattagctgtttgatcaattttcttttctttttttttttttttttttagtatttattgatcattcttgggtgtttcttggagagggggatgtggcagggtcataggataatagtggagagaaggtcagcagataaacacgtgaacaaaggtctctggttttcctaggcagaggtccctgtggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcagggggttgggagtaaggttatagattaacagcatcccaaggcagaagaatttttcttagtacagaacaaaatggagtctcctgtgtctacttctttctacacagacacagtaacaatctgatctctcgttcttttccccacatttcccccttttctttttgacaaaaccgccatcgtcatcatggcccattctcgatggtcactgtctcttcggagctgttgggtacacctgcagaaaggctgtcacttcacacttggaagattgcacagcagccaggcagaggcgctcctcacttcccagacggggcggccgggcagaggcgctcctcacatcccagacgatgggcagccgggcagaggcgctcctcacatcccagacggggtggccaggcagaggcgctcctcacttcccagacggggtggccaggcagaggcgctcctcacatcccagacgatgggcagccgggcagaggcgctcctcacatcccagacggggtggccaggcagaggcgctcctcacttcccagacggggtggccaggcagaggcgctcctcacatcccagacgatgggcagccgggcagaggcgctcctcacttcccagacggggtggccaggcagaggcgctcctcacttcccagacggggtggccaggcagaggcgctcctcacttcccagacgatgggtggccgggcagaggcactcctcacctcccagacggggcggccgggcagaggcgctcctcacatcccagacgatgggcggccaggcagagatgctcctcacttcctagacggggtggcagccgggcagaggcgctcctcacatcccagacggggtggccgggcagaggcgctcctcacatcccagacgatgggcggccaggcagagatgctcctcacttcctagacggggtggcagccgggcagaggcgctcctcacatcccagacggggtggccgggcagaggcgctccttacatcccagacgatgggtggccaggcagagacgctcctcacttcctagacagggtggcggctgggcagaagctgtaattttagcactttgggaggccaaggcaggcagctgggaggtggaggttgtagcgagccgagatcatgccactgcactccagcctgggcaacattgagcattgagtgagcgagactccctctgcaatcccagcacctcgggaggccgaggcgggcagatcactcgaggtcaggagctggagaccagcctggccaacacggcgaaaccccatctccaccaaaaatacaaaaaccagtcaggcatggcggcgcgtccctgcaatcccaggcactgggcgggccgaggcaggacaatcacgggagcccgaggcagggaggttgcagcgagccaagatcacggcagtagagtccaggctcagcaatggagggagaccgtcgaaaggagggaaggagggaggaagggaggaaggaaggaatcaattttcaacagaaaactaaaactgcctgctggcaacattaatttccaaatctaatctaactcatgagtattttaaattcaggggctttataagtgcatgttaatttaaattgcacagattagaacagcctgtctcaggacaggatgtaaaactgacctttgtttctgaattaaatgtttctttgatactgaaatattgaaatgccggtcttagcttttgacttgtgggttttcatggtccctgaacaataagcacaatgcagttttaaagactgtttgcttatttgatgaaatttcgtacttttataggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgaggtaagcctgtcagaatattcaagccttgccgttttggttttaatgtagattttgtggcattgacagtttgtgtcaagaatgagcatgtaaaacagtatgctctactattaacaaatatgatatatgaaaatacctatgtctttaagttatgggagtagtaatttgatttataaatgaattagcccatacaattgttttctctggttaaactcaagattttgtgtgtatgtgcacacacccccttccaggaccttgctagcaggttttgctagttatgtttgccaaggcaagtgatgaagaaatggggaacctaggagtcctcaaccagccacatgcacaggtagccaggctggcctagtccaggagagcaagccgaggaccaaccctacagccaatcacccatgatgtcagctaaggcttgggctgaaatctttgttcagtctcctggcaggcctggctgaaccgttgggcatccatggtccagtgggaccacctccttaactcctcattgcctaaccttactctttggctgtgagaagaggtgtacaaagatgaactcccggagccaggctgaagggatggatgctttctgcgatctgtgcttcctcctcctttcatttgggctgtactctgatttctcttcagccctgctgaggtcctgcccacaagcatggcaaacaggcactcgagatatttaataaccacgtggcacttccacctggaaggcataccctcaggggtcttgccctgacggttttcttaggcatcacctgctttagcatgtccccttcccagaatgtggagtttagggctgtgttttgaataccttggaggatggagagtaccatgccctgacccttctcagacagctgtcatcatggtagccctggccatgtaatattacatggaacattacttattttgcatgaaatcagaaaacaggtttgttctctttgcctgcctaccactcccttgcccctccagcttccacctagagccccttggtgaaatctagggcaggtcccataaattctagatactaatgaaaatcgctctggccatcccagtgcagcaattgataagaataacccagtgtgtccatgtacagttgctcacacctataatcccagcactttgggaagccaaagcatgcagatcgcttgagcccaggagttggagatcagcctgggcaacatggcaaaaccccatctccacaaaaattacaaaaattagttggtgtggtgatgtgttcctgtactcctagctatccaggaggctgaggtgggaggatcacctgagcctgggaggtcgaggctgcagtgagctgtgatcacaccagtgcactccaacctgggcaacagagtgagaccctgtctcaaaaaaaaaaaaaaaaagtataacccaatgtaatttccaagaacgctgaaccaaaagttagctgggcgtagtggtgtgtgcctgtggtcccagctgtttggcaggctgaggtgggaggatcacttgagcctgggaagttgaggctgcagtgatccgtcatcatgccactgcacttcagacggggtgacagagcaggaccctgtctcaaaaaagaaaaatccaaaacaaaacacactgggctaaaattcagcatctttcctcagttttgtgtggcctgccctgctgatttctctggggttgagggtgtggggtgctaagaacataggaaattgtttctcttgaccacgcgatacatttaaatattatacaactctttgtcacgtgggcaccttttcgtgtataggttctttggagacccctggccccacagctgggagtcttcctcttgacaggggcaaatgcatctccactgcagctggtcctttaggactcttccctgaatgttccgtggtatacatgcatctcacctcttcaggtggccctctcaaccatttgctggccgcctagcacctggaaacatgcccttagacccttttccagttccctaactatggctcttgcatggtttctcatcgtttatatttcccaggcaaaaacaggacactaagcttctgtgtccccaaactgcggaaaacacacactgagttctaagtggtctccttgaggccctttttgacattcttcagatgaaggggagggggtagagagcacaccccaaggaaccctcccattttcactctgaccagtggagctttaacccttttgtaaccctcaattgcaacctggcatttggcaactgcctgttcttttttcccagctggtattctccccagctcctctgacttatctatttcctaattaatggatgcattgtatggttttaccactctccccacagcatacatactgtattgtcaaatcattacccatggacttttatattaaaatactgacagaaccatatatatgttgaagaggacaacatttctgcccacttccctgagtattcacagctctgtttgagggaaaagatgttttcactagtctttcacttatttaacactgaattgtatattgcctttctcccaggtatgtcttcgtctttactccctcactgggcttcccagaaaagcaagaactgtaacaaactaattcactgctaggcacagactaggcacttactaaatattaatgaggagacaaatgaagtagggagcttccttggagagaatttaaaatgtaatttgacataggacaaacatcaatttggacaaaacttttcagaaacatattaatcattcaaagccaggcatttgtgcctaattcttatcaggcttggttcctcattgtgttatctccatgttcctagcctgagcatttacgtcacatcttcgtgtacttaacactttttttttttttgaggaaggcggcgggggagacaggatctcactctgtcacccaggctaaagtgcagtggcgctgtcatggctcactgcagcctaaacctcctgggctcaggtgatctcccacttcagcctcccaagtaactggggctataggtgcacaccaccatgcccagctaattttttgtattttcagtagaagtggggtttcaccatgttgctcaggctggtctcaaattcctgggctcaagcaatctgcccactttggcctcccaaagtgctgggattacaggtgtgagccactgcacccagccacatttcttatagtagctctgacaagatatttctgttcttttattgggctattacttagtaggtgcttttaaagcttgttgaaataaaacagaaatgagttagaccagtgaatcactggcatttccattcttccagatgacaactctggaagaatatctaggaaatggggactggtacaattctagctaccctttagaaatcagaaccccagtgggggccccaaagctagatataagatctgaatgcacactaccatcaccatcaagaatcctcggccaagagaaagtacagtctggaaaatgatataaacactggttcttgaaaagaaaaatgcaaaactgctccccaaaatgctcaccttttaagaattaaaaatgacataaatagccatgagtcagcatatgcaaaagtcaggattcctagtcctctgaaaaagactctaaatcagtgtttaaattgttcataggaacagaatctataaggcaagaacagactatcatgaaaaaagaaaaagatctagaaaagagcccaaatgaaattctagatatgaaaaaagtcattttcattgaaaattcagtggaagtgatgtgaacagctaaggaaaagggtaagttggaagaaagatctaagaaaattatctagaatataccagagaagatgcaaaatatgaaagcaaaattgagacaatgatagaagagaaaaatctaagttacttctaataggagtcccagaagaaactataaaatatgaaagataagcaatatttaaaatgagtttatggcaaaatatttccagaaaagtcctcagattaaaggactacacagagctcctaacgaaaacaaattaagtcctagacataccagattgaaacagaacgtcaagaactaagaagaaacattttttaaattacctgagatagaaaagtttcattataaataacactgagagcaaacttaccagtagtaataaatgccataagacagagtactgagggaaaacattaaaccttatatttttaccagttaactcatcatttaagcatgaaggcaaaataattccatgtaggccgggcatggtgtctcatgcctgtaatcccaactctttgtgaggccaaggcaggtggatcacctgtggtcagtagttcaagacaagcctggccaacatggcaaaacgccagctctactaaaaatataaaaattggccaggcgcagtgacacatgcctgtagtcccagctattcgggaggctgacacacaagaatcaatcacttgaacccaggaggcggagattgcagtgagctgagatctcaccagtgctctccagcctgggcgacaggacaagactgtctcaaaataattccatgtaacaaaaactgggtttactgctcaggtcctctctaaaaagaactctgaagagttctttcaactagaaagaggctaaagcataaaggccaggagtgagatgaagcatcgataaattggttttaaaaaaacaaattggagtaaatgtaaataagtattgactgtaaaaatattttttgagacgagatctcattctgttaggctggagtgtggcagcgctgtcacgactcactgcagcctcaacctcctggactcaggcagtcctcctgcctcaccatcccggagtagctgggaccacaggtgcacaccaccacacccagctaatttaatttgtagaaacggtcttgttgtgttgcccaagctggtctccaactcctgggctcaggcgatctgcctgctttggcctcccaaagtgctgggattacaagcgtgagccaccacacctggccaaaattatataattgtgtaaccaactgggagggctggctatggaggggcaaaataagctgaaactaacaattagccaaaaattacatggaagttgtttatggtaggaatagaaatactgattagctttggacttttaagtatgcatgttgaaatactgagtaccataatcagagaaataggtcagctgcagtggctcacgtctgtaatcccagcactttgggaggcctaggtgggtggatcacttgcggtcaaaagttcgagaccaacttggccaacatggtgaaaccctgtctctactaaaaatacaaaaattagccagacgtggtggtgcacagctgtaatcccagctactccggaggctaaggcaggagaatcctttgaacctgggaggcagagggtgtagtgagccgagattgcaccactgcactccattctgggccagagtgagatccgtctcaaaatataataaaaagtagaacttccaaccaaggaacataatagcataaaaatccagtgtggaaataatacctggtgatcctttaaagataaagcctaaagccccaaccagttcagtcttttatgtgaaagatgcactttttgtgtttctctacagagacatctgaatgggacagatacttctttctctctggaagacttattccagttgctttcatcacagcctgaaaattcactggaggtaattggaactttggcttttatcctcgcaggaacatatctgcactgaccttttggtgaacaaatacaactcctttacttggatgacacagcagtttaaagtaatgcttatttttacagaagcacttcagcttagaattaaccaaatatgtatagcattcctctttccaaataatcccaaaggtataatcaaatttagactagtcatggaaaacagcgtggagatttctcaaaaaactaaaagaattatcaggtatttatccaaaggaaaggaaatcagtgtatcaaagggacacctgcacccccatgtttattgcagcaatattcacaatagccttgtagttttagcgcttagaggcatttaaacagcctctctcctccagactacttcactgtagtttattatccctgaccctccacaatgtgattaccaaccgctaggatgagttgcatcttattataaagtagcaaattacaagattgtaacattagactttttaagaaaatccagtcagcttttatactaatccatcttaatttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattcaggaatataggtgaataacaaataaggcagcatagcaaactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgttattttgccagaa

SEQ ID NO: 2619 - DNA, 10859 bp, Homo sapiens
ataatgaacagcattttattggggacagccaataatgtccacaatgctcttctcatttacctgttaatattaaaatatgcatagctttgtgaaactgcttttaaaaatttaggggatggtgatcttttagacaaccaaatatttatagaacaagattcacacattttatgtgtaaacattacaccaagtatttggatacaaaaagtatttattttataaactttatatttaaaatagaattgtaatctgtctactcacaaaacctaatttaaaacatgatacatttatctctctagccaatttgatgttactgttttacaaacaacactcattttgtaattgttttatatcaagaacctcaactaaatgtttgttttatcagaaaacatttcccttttattttaaagagtgctttttaaatgaaggcaccaacaagaactactttcagatggtacagaatttcttatttcttgaagactctgtggttgaccacttcttcattagttacctgcagcaagacaccttcctgccaaaggaaaaaaaaagtatctgaagaagtttatcatgtttgtccaaaagaacctaaacaacttcagtggtggtcttaggatcaaagaagactcattggtgtatagagtaagccctgagtatcacattcctgtaaaggcaataaagccgggcaatcaaactgatcatatctaaggaatgaatttcaacagccaacctacaactttctcttcagggtaagacactgaactagaattaccacatttaacccacctatttagtactggatacataccaggcttcataatgcagacaagacacttcactcaagtatgaactactatctgaaaatagattcaaccatttttgccctaccttctttcagtctcatcctgataagcatgtacagttacaaccataaatacaacaaatgtctttaataaaaacccctagttcactcaaaatgtttgatccaagaaatgtgaatacacaagggtgtaacgatgggaaatctcatgatttattgaacttgcagcctaacttttacctaccattttactaccaacaccactgaaggaaccaagaaaagctttattaatgatcacttggcttgcctcagctgttgaaatgaagcactttacagtctttgtggcagcagaatatacttgtccatggttcatatcaatgctaaaattccggcagggaaaaaaatgatatgttaagcacccaaatcttcacatggagggggagggggtgggaaaagaaggaaaaaaagggaaaaacaaccaaaataatttaagtaaatgacagattggaaaacagggtttataaaaattattctcttgagtttataaattgttaaactcaatttatagctatgttaaactacgtaagaaccactatactgaaagaccatttaagagtattagtttatcttttagggaggaaaattaagaaaggaaaagtaaataagatcttacctaaagaagtttaactgaagcttagaactattttgctctacaccctcagctttcgttggcatccttataaactactgtagttaaagttttgtagaaacagcacagttttttaagactggctgaacttagtagccgtcaagagttctcttgtactagacctgtgtccctgaagagtacctcgctggggttatttcctttccttgcattgaagaagcagcatctaaaagatctaaaaaggtgtttctccttgcagagatatcccttaagttatctacataatttaatcctgatgaattgcagacaacacacttacatctgaccagcatttatcttatacaaatataacaacagctttgcaacggaccttaattatactacccactccttaacttatttaaaataaaaagtctataattacacaatttcctttagaattattttattaaatcataaatgtacaacagcttcttaactctacacacgcacttaaatttttttaaaggaaaaacgttatgtcttattacaccatgatcctggctaatagcttttcaaaactttgagaaaaatcttaaaaaaggtttcacatgtcacctgaaacttacaaatttaacattatcaaagaaggaatgcttctacactcttacaaagaccactagaaagaaacaacaattaaaaagctaagaaactgtctcaaaggcatttttttttacaatccttcctccacagtaaggtaatgttattaaataatccaatccattcacaaaatggctctctgcatctgctctggtgtcttctgccatatcactgcatatttatgcatgactgagataagagtttccttaacattgttatttcgataacctgaagctgttctgttacctctgggctctcatcctctcctatttatacagtgaagcctgtttcaacagaagtaaagagtaaaaaaaaaataggttatgaaattatccatctaaccagattttaaggaaagataacatgatcctaaaaagcttttactcctgcagctatgtctcccaagataataataattgtaaaactcaaaagctacttacccatggcaaataggaagaagctcagtatcggctcctcccaccataacccccacttcctccactgcctcctggaccatagtttcctataattgttggaacagcaagagaaaacaaacttactttgatttcccatgatcagcctaacactacagttgattctattttatatccatccagtcttttaaacaagcagatcctaatcctttgcagccagttagcagaattactcaggagataaattactcgggttcatagacatttttatttcgtggctgaccctattcttttaaataaagggtcctttcaccctctcatcctcatttggactgagtaagggatttttttaaaagtacatcaagcccaagacaaagctagtttactcctagctaaaaacctcaaaaataagctaagcaatggtttgaatcatggtttaaggatttaacttcaaagaccctcattccaatgtataccacttgcaatgtgggttgcaactgtatttagctgtttatgagtccccaccagaaattaaactactgaacacccccacctccaacatccctaatcccaatttgatgtcataactgcttgctgagtacttctgtggagatttatgcaaaatttctttattttcactaagaccgtacatggagcactgcccacagtacaaactacttagtatgttatcttccctttaagtcacaaaaggctaatcctttaatcacaaaaatctgaataacctcaatttttataaattacctccaccatatggtccccccatgttcctgctaccaccaaagtttccactcttcattggaccgtagttagaaggttgctggttataatttccaaaatcattgtaatttccacttccataatttcctattaaaaaattggaatactcagaacaatacaaacattaaaccaaggacttaggacaaagctcccataaaaacaaataaaagcaaacacttatccacaaattttatgggcatctagtgacaaacatggaaacaaaagatcaagtgttacaaagacattaattccaaattcccacataaaggttgcaggtgaatttattacctcctccatagttgtcataaccacctccgtagcccccaccctggttgccatatccaggtcctccaccaccatatcctcctcttcctcctccataaccggggctacctccaaaattgccacctattataaaataagcctttaagtaatcacttaatattttcaataccattttgaactgtctcctcacatccatttccagctttccaagtttccatgtgaaatatttaatgaaattcctctaaaatagcttcaaggactgaataactatccttggtaaacatttggtggctggggttactcagccaaatggataacaccatgtgcacacagttaaatacctgtaattccacagctttccctcaaaactaaaaatcttaagtatcttgaaatacttcatgtatattgtgggtaaggactgtgaggctagactagtagtgtgggctagagggaaagtaaaagagcacttcctcctactggcccaaaagataaagtttctattatgtctctctacgaattacatatcttaaaacaatgttctcggttgggcacagtggctcatgcctgtaatcccagcactttgggaaggccgaggcggacggatcacgaggtcaagagattgagaccaccctggctaacacggtgaaaccccatctctactaaaaatacaaaacattagccggacatggtggcagcaacctgtagtactagctactctggaggctgaggcaggagaatggcgtgaacccgggaggcagaggttgcagtgagctgagatcacaccactgcactccagcctgggcgacagagagagactccctctcaaaaaacgaaacaatgttcttggctgggcgcagcagctcacacctgtaatcccagcagtacgggaagttgaggcgggtggattgcttgagcccaggaattcaagaccagccagggcaacacagcaaaacccccacacctctacaaaaaaacacaaaattagccggtcatggtggcacaccccgtagttccagctacccaggaggctgaggtgggaggatggcttgagactaagattgcagtaagccaagatcacaccactgcactccagtctgagcaacaaagccagaccccatttcaaagaaaaaaaacagacccaacactccacacagtatgttctttactgtaaatagaagtgcggacataaacaaaaatttacactttcacatactgcaaaacaaaaataaaaaaaaaaaaaaggctgggcatggttgctcacgcctgtaaccccagcgtttttgggaggccaaggtgggcagttcacgaggtcaggagttcaagaccagcctgaccaacatggggaaaccccgtctctactaaaaatactaaaattagctgggcgtggtggtgcacgccggtaatcccagctactcaggaggctgaggcaggagaatcacttggaccgggaaggcagagattgcagtgagcagagacgcgccactacactccagcctgggtgacagagcaaggctccgtctcaaaaaaaaaaaaaaaaaagaaaccatattaaaaaaaaaaaaaaagcttgtgggctgagtctctaacttgtagttaaatacaagaactcagcttcctctaaaattttaattataaaaagtagaacagtgagatacactatttagtcatgcctattgagtggcaacaccagaaatcaagtctattaccagctcagttttaaatgtcccttgttacaaaatctgtcagtgtgtatcagccttttctgtacgccaatgatatatcacacttcatgtttaatggtagttcacaaccttatctgcagccaggagcacactaaacattttggaacatttccgtaggttacgctttttgaaagttatcctgggatgcttcccatctagttacgggtttagacatatttcatattttttcctacatataccacccccttaggttttactctgttaaatccagtattctgtacttttccagagaagcacgtacaaagatatatctagatccaatcattttgcttgagaaaagatgagatactctgatggttatctttacattttcatttaaaatggcactctattccttaggctataacagctaagatggcaaaactacttagaaataactggaccactatcacccaagccatttatagacactaatataaaatgtttaaaaactcaaaatataaatgaagtaaatatacgatatagttaagtattagtcacataaacaaaccaaaacgtagaggaaaactgacctccaggtcctcctccatacccattatagccatccccaaatccacgtccactgccatatccatctgttaggggccaaaaaaagattacgtttactataaactgttcagcattattgctaatattcattttcagttctcttactacctcagcacaataattaagaaccgcagaaaaggacacaccagtgctaccagtttacccacaaaacatgaaagcatataattaaatctaccgcctaaattttggactcttaacaagtctcaatcttagagattccatcctatttatacgtaagaatgacacttgatgggggtcaaagcttttcggatgacacttcatgttacattattaatccagataaatacaactgttattaatacaactctattaacttcttgtctggccaaatcacaagagcttgccaggatacaatctatttgaagtcttaggaaaattgacttaggttggatttcttgattctactaatgaaaacctaatcatatttaaaataaaagcacactcatcctttaaacacgtagaacttgaaactcaccagatcctcctctaaagttacttcctggtcctggtccgaaatttccaccgccaccacgtgaatccccaaagccaaagttgcctacaataaatgccccagttagaagcaagcccttatatatgaacaaaaataaagaagaaacagaattaaaattacctcctcttccactcctagaactctgaacttcctgcatttcttgtctagacaaagcctttcttacttctgcattatgaccattgatggtatggtatttctgcactggaatgaaaaattcagactccttttaaattaaatcaacaatattaagcagcttcaaaagtttacctttcaataaagttacagatgttaacatacacaaaattgaatacactggaaaaaaacagtacatttgtggttagacacttacatacgattttatccacaggatcatggtcatcaaaagtaacaaagccaaagcctcttttctttccagactgcctatcagtaattatctcaatggtatcaatttttccatattcctcaaagtaatctctaaggtgatgttcctcagtatcttctttaattccgccaacaaacagcttcttcacagttacatgagcccctggttttccagattcctaaaatagtggtggggtaaaagtcatccaaacagaaaaaaacacaagcataattcaaagcacccaaccgtagtaccatacttcgcttgtatccaccttaaaactaccagatataaaatagcttttagggacctagcttttgaaaaataagctagcttaagaaaatggtccagaaacccaacacacctttaataagagaaaaaatcttgagttaaaactaaattcagaaatagtttctgattttcagcagggcagcgttcttcatgttaatgcacaagacagtcattgtttgcttacctctcttgctacagcacgttttggctcaactactctcccatcaattgaatgaggtcttgcagccatggcagcatcaacctcagccatggatgaaaaagttacaaaaccaaatcctcttgatcttttgcttgcaggatccctcattacctttcaaaccaaagggtaaactttagcatttaatctcattatagcttataagtgaagtcataatagaattttttactatgctgatagttatttcctccatgattcacttaacatacagctaaaagactaatatccagtaacaattcagtaatttacataccacacagtctgtaagctttccccattgttcgtagtagttcctcaaactttcttctgtggtttcaaagcttaagccaccaataaagagcttacggaactgttccttttctctctgcaaaggaaaataccatttcaatttttatttacattttcctctttgtatgcaggaaattaaattcttaaatatgaggtgacctgctggcagagtacctttttcctctccaaaggaacagtttctaaagttttctggggggaaaaaaaaaacttacatcaaatttaaaccatatgttaaactgcatattagttgtgttacaccaaaaaattgcctcagctgatctacacaagtttcaaagtcattaatgcttgatataaatttactcaacattaaattatcttaaattattaattaaaaaaaaaactttctaaggaaaaataaacaaatgtagaccgtgattatcaaaggattattaaagaatctttaccaaaaatttcaaccctacaacctaaaaacgcaaatttctatttttaaacatcagaaaataactcttggttcattacttatgacccaaagtttttatttcactattcaatatctgaaaagtatcatttattttcccttaactgccccctctggtggtgattctaagtatctcagccaaaaaaacacaactttttacaacaaacactaagtttctccatatgactctcagttacgaaaatatttaaagatatgcattagaaataaccttaaaaattactcttataaccaggacaaattaatttttatgaccagcagcactcgaagcttaaaaagtttaatttttggtggacatgtctatatttgatatatgacaatacagaatatgaattactcagcttaaccatatgtacaataaaatacattcacgtggcataatctctaagataacaattactgaaagctgaagcttacttgattggccatgtggcaagcgacaggcacaaaacaattttccaagtcaataggaaaaacctcagagctgaaatctttatatgctgtactacacagctgtattctgggcacttatgaatgttaaggaaacctgtcttaaaagttaactaggttaaaaaacctcaaacgagagaaagtgatatccaggaccaactgctacaaacgcataatgcaaactaaaaagtcacacgtaattttcaatcaattattttttgttcctagcaagcagcattaattgctgctctcatcccagttctacggagctctccctccattcgcatgctcccaactcctaaaaagtagtggtaaaacccagttcagatttttttcctgtagttttcatgactcgtaaaaattaaagaaaaaattaactgaaatgatcaaactagctcctatgagacacaaagcagtcttttgaaatggttacttgtcacgatagttattttcattttttcagctagtttttattcttaattgtcgtcagcacataggttatctctaaactgaaattacggataatgtacatttataacaagttttacaaatcactaacaaaaagcaaaaactcattacttacctcacaatttatccaaacttacccgatgtccactatcgattttaaacaatgttattttataaacgtgcttagggtcaaagaaaataaccaggtagacccccttcgcttgagaccttatgcttatcaatgtaatgttcaaccaagattgcaaacaaaatgagaaaagtaacaaagttcaaatacagagcggcccaggcccaaaacagttttgcacatcaatccatacgcattacaggaaggagcctctgaagccatgttttaatcgaagtataactaaggacaaaatcgttatttcactttcctcgtaatcatctataaaggtccatggatctgtcccgtaagggttaaacttctcagtaacaacattacttaaaatgagtcagctctacaacttaaacggaatccttaagaacagtaaaggattctgacgcgaatatccctcccccgcccagaaaaccaccttcgtccctgcccctcgtggccgatggcttccaatttatgtttattttgccgcggttcatctgtcgttttactgactgcagacccagataaaaccgttactcaaaggaaaaaaaagacaggaaaaacataaaatggtttctttgtcctacggctcgcattgaacccggcccgacgccctgggtggtgatatcttctctgaaaccgggcccgcaaacccggagcaccccccctccccgctcttcggtgtggcttccgaacgcaatggcgccatttcatcgaggggaaggctgagcgcctttaatgaggtgcgcaggactctaaagatccaagctcacaaaacactccaaatccacctcgaaacgatatgaaaacagcccgagaagaaaaaaaaatagttaaccacttctacttcttgatagagaaagcacactaagaaaataaaagagttataaggaaaacgctgagaggaaggcgagccatgaaaatggcggccgccaaatccggttcccgggagagagggggaggggaagctccgcagcctcgctcacgaggacctgctgcccgccgaaacgctcgccgaggagacgccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacctccatcgcggactcagtcgcttcagcccgatttcccgcagccgagcgagatgagagagatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccact

SEQ ID NO: 2620 - DNA, 10859 bp, Homo sapiens; identical to SEQ ID NO: 2619

SEQ ID NO: 2621 - DNA, 450742 bp, Homo sapiens
aggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcccagcccacacccaccccttgtgaaccaaagctctggatttgcgcttcgccttgggctcgcttttgaacaattgtgtcccatgcaatgcccgtggttagcccagagagcgcccagagcctccgcacgggctcgccggtgctcgctcgaggggcgcgtggccaggtccggcccttgctcccatggacgggtgcaggaggggaggaggcgctgtgtgggtgctcccccagcgcctccctgttaccggccggctgcgccgctcagccgggcctgccacctgagttttagcgggagcagtcatgtcgcctaccgtattgcgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggttccgggcacagcgcgcctcagtctgcattgggctgacaccagagagcatgtggggattttcctagttgccgaagaagatattatttgacgttgctgtagttttgtgcttacttctcttggaatctgcagtggtgcaattctccccttgttttccccccttctctttgaaaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacggtaattcattctagattggggattcatttaaaaatgtgtgttttccactaagaagggattagagtccacatgcccaccctggtatgaatgtgtgtgcctgtttggtagagagatagattgtggtagaattccctgttggtagaattccctgttgcctgttccctccgcttgctgcttcctctggaatgtggcattggaaaaacaaagcactattttaattcctagacctccaggcaaattggccgttctagtgttttatttaataatccacgttctgactaattccacactataatcccagtctagtgcagttggctgctttgtggaatgacagttctctttttttttggagtagttttttcatgaaggcaaattgcctaagtttgtttagattgtgacattattgacttgatagggaggtcacatccggagctggaacagcccatcaatgtatcaatacagagggactgcagctctgttatttgtgtatatagcatcatttgacttgattccttttacactctggcttttaaagatggatgtattacaagatcactttgagctttaccttctattatgcttccatctgatatgattgttaacaaaagaaatattaaaaggccagatgtgatatggaaagacaagcctgagtctcattcctcatggtaaaggaagttggactggctggtttctatcgttctttctagttccagcattctgtggtaactgacagaggagtaagaaaagttacccagtgttggaaaggcaaataattataacgtgaaccatgcaagcaaaccaaggattgactgtagaatctgcggcttatttttataccttgcagcttttaaaacccaagcgtctgcattttccccataagtgaaattactcaccaactcaaacaggtcttttttttttttttttgtccactatagcaaaacatttggtggagggttggggaaaagagaagaagattgaattaattggataacaggtgttctccttttgtggagttattcattccaaccccatcttagataattgagaattcactttttccaatcattggtttttgtttgtttctaatgagacactctagatagctgtttcatcctatgcagtaattgacaatggcatgagacttactttctctgatgtaatttggtgttgctctcaaaacttgctagcgctgttgcttgtcacaaaaatgggtgaagcaatgattggtctaaataggcaggcaggcagtgttttcatgcgctatggtaatttttataatttaggtatagtcaaggtatttgttgattcatgcttagccacacaattttccgtagttgtgcactcatttgttttaagttacaatcaaaataatatcctgaaattacagtccctgcaaggcataattaaccacttcttctcctgttttcccatagcctttttgttcatagagctaagatagcacttacaatattgcagttatctgagttgtaaatgtgccacagtctccttatcttaaatatgggatgagcttcttcagaacaaggacatgtttatattcatctctccagcacctagcagtttgcctggtacatcatgtgttctcagaaatgtttattgagtggatttcaggtcataaaaatgccctctaattgtataggcaggaggtaggtaggaatccttcactttgtgagtcagctgggggaatcagagaggttatgtaagatgcttaagggggaaccgagagccaggactcaaatccaggccttccaccacccaccctcagtaaacaaaaaaacacgtagagaatgagttcaaatgctgtaggttttggttatttatttttttccttgaatgatctggattatccattttgacaaaatttatctgataactgctctgttctgtcttgctctggccttagaaggaaacatggcccaagcactttaacctctaatccacacttaaacagaagacgtgagcacccttctgcccactttctctctaagtcctggttctatcaaccagagcttgctaggatgatggacacgtctagggaatgtctactcattatttgctcaagcaacattgaaccactgtaagtgcttctgaaatgacctacagttagaccagagacaaccatccttcctgggccagccaagcttgactgagtctcccaatggcaggtttctagactaacaggtgtgacttacagacatcaagacacctgcttctctcccatttacctgcttccttttccatcctaaaaaacaggacaagctacattaggaaaccaggaagttgcaatacccacatgtcctctctgtaaaacagccgttggcacatttgatgttcacggacttttagagaaaacagtatgaaatgctctgtggggttttcttcaggtcacttttcctctttgagggttagtttcttcttctttaagagtagaaagttgaatcaagtaatcccaaaggtcacttctaacatcaccattctgtgattatttttgttggtttattcagttgagcaagttgaaaggagaaaaagattagaaataatttaatttggcaatatgtagagaagaaataattaaggctacatggtgcagcctgtggttatctgataactactttgagccttctgttaaaactattctttatacatttctataatcctttcttatttgtaaaactaaatttactatattaaggggaaagatttgtggcatttcttgttcccagtgaggaatgcagtggtggaaaaagtatgcaatctccaaaatgtacaaagtgtttagaatttgggggtttaatagccaaggttccaagcatttttattctcaccactgagtatgtttcacagctgaataactcttatggtcaaagtgttccctgcaattcatccaacaaattcccctttcagtttctctctggttcctcattttgctctttttttccacttctttagctccactcaacttcctataacatcccccacatacataagccatatgccagtagtacactgccaccccccacccgccccaccaaaggcaggagtcagagcttcacaacctccttactcagctcaatcttttctactttctgaggtttattcattaccattgcttttccaagttaagacacaatgagatatagaagcaggtcgaatcttttaacgatattgtttatcgtttacgtctttttctcacagactttctgaccaccatttggaacctcaatgccatgcatttaggtgtcttaaagcctctttaaatattttaggaagcaaagcagcatattagcaattttatgtatcccatcccacagtgtttggatgtgtgggtattggtaagtagttgtactgttctgtgacatgggcactgaaaggagaatgataataatgcaattacttactggcaacatatgacaaagatcactaagctcctaggtcatctggattcccatagcaacaagtggtatacactgtttgcattatttgttcagaactgatacttttcctgatttattggtctgaagcttgatgcatatggaggcctgaaaaataaggatgtggcatacagacaggctctcctggtgttatcaggcatctatgcatgtgatatgcagggagaatttggtggatggaacttaagccggtaccaggggggcgggggaagagttgggaaaggacgccatctgtgcccatgatgacaaatgccatcatggagacttcattcggggtcccttttatatatttagtgaagcagattttccatttcacactttctagatatatttgtattgcacagatgtcagggaaatatcatgtgtgtgaaagaaaaaaaaaagatcaaaattcacatccatggccagggattgtaattcaatcattttgtcctgaaattgacatccatttaacgtgcatggatgttccctgcttttgcttttgctttgggggttcaagtcagagcagttggagaaacataaatctcagccctacacattgttaaaattcagagatctaggttaaggggggaaaagatggggagaataaaattaaacatataagaccttgccatcagtgccgtcagtaccagagctgatgaaatcaatcagcaagtgattcctcatcctctttcctgtaacacacagatgagctgaagaaaccacaggacgcagtcagtaagtttttatcctcaaaaggacttctttttttctttaccgttattcataattccttgtgccatcaaaacttaaaactacttaatgacgttttccctctattttgaatataaattatttttgtagaaatgagctttttgaaattggaaaaaaaaatcgttttgaggattgttgccagctttatttccccctgcctacccccagcattgtccttggtgtcccctctacatgaccgggcataggacctgcatataaagaggatgatgataaggaaataattggcatacaaatggtactgtgatgtatgacatttataaaaccgctccctgactccacatcccccatgatggattttctgtttctttttaaagaatatgcttcaaaaaggttgtcccactggccttcttcactccctccatctcagcctctaaagacatattttattgtgacatatttgattttgacaaacagcacattgaacatatatgaaatatatgaagcaaaatatgacacacacccaccatgcagcctgagaccagaagatcaccatcttatttgaagctacttttgtgtttctgccacctctcaccttttgcctgtcttgagagcacctcgatcaggtatcagtcactcgttcctgtcactcccctccctgttgtcattagggtcaccaatgatctctacctggtgaagtacaagggcacagctttgctgatctgagcagcatttcccatggggctgtgggggaccactcttttcttaagcacctggcttcttccaggacaccagattctcctggtgttcccgcagcctctctggctcttctctctcaggctctttggatggcccctgagtttttatcccgattgatctcaactgaattttgacctttaaatgcgggtacggggattccccaggccttggctctcagacttcttcccttcttacttaaattccttctctcaacactgtcttcatgctcatgattccaagtttatttcgtcagccctgactcattcccagaactccagacttgaaaatgcaaccgcccagcatctccctttgaatggcacgttagcttaaaattaacatgtgcaaaatacaacccccgatttttgctccctaaacgtgcttctcttctggtgtcctccatctctctcagggacaactctgtcctttcagttgttcaggtcaaatacctgtgagtccctctgacttttttctcacccagatccagctttcaataaatctctgtcccttctctctccctctccatccagcacagccatccccgtctaagcgctagtaagctttcctaactggttttctgtagtccttgcccatctgcagtctgttccctatacagcagcccaaacgagcctttaaaagtggaagtcttctcattcattcattcattcaacaaatactgcctagacatctgctgtgtgccaggcattggtttaggtgctgggatgtagcaggatcacagtgcaaaacagtcacaagtccttgtcctcctggagtggacattgtgttacttctttgaccatagccctgttcaggatgaaacccaaactccttactttgcctacagggcttgccttgccactctccgagtccccagttgtccttgctcttcctagaacgtgccaggtacaaatactgttcccttgacctggagggacggtcccccagccacctgcatcctgaccccctttatcagatatcacaccctcagaaaggcttattctgaccacacacaatgtgctctcttccatctgcttgtttgcttgctttttcttcataccacttagcaccacgcaatttgttacatagtttctgcttatgtgctattctctgtctccccttctaacttgtaatctccattagagcaggaacctatttgtttacccagtgcctggaaaagtgtctggaacatattagacaccacactgaatgtttgctgactgaccgaatgatgtaacaggtgctttccttaactgaaatccaacctcagaactttctctatgtccacattatattggataaatcccctctatttatttatttatttgttttattttttgagacagggtttcactctgtaaccgaggcttgagtgcagtggcatgatcttggctcactacaacctccgcctcccaggctcaagtgatttttctgcctcagcctcctgagtagctgggactacaggtgcacaccaccacacccggctgatttttgtattttgtgcagagatgggttttcaccatgttggccaggctggtctggaactcctggcctcgagtgatctgcaaatctgagtgatctgtaatcccaaagtgctgggattacaggtgtgagccaccacgcctgggcagataaaacccccctaaaagctgctggattagagtttagatgatattttcaggtctcaggatcctctgagcatatatcttcccttttccatgcactatttttccctcccctacaaggaggtggctggggttcttccttcctgcctggacattttgttggtcctgaacttccgtgtttttctcctggctggtgttctctaacagttaaagagagtggctagcttgagcttgtctttgcttcctcagcacccagcaagtagacccggcaactcaattattgttgagttgaatcacttagttgttgttattgttgctgccaggacttgataaaaactgttctttgcttcctctgggccacactgactttgtcatcttgaatgtgagcctgtcagtcctgtgttcaaagctctcaggagtggccaaagtacgcacaattccctaggctggcatcgtcgggctgtaggccttggccagctcatatccccatgcactcttttgaccctctgtggcagccaagcaaatcattttcccatttctcccaacatgctctgtgcttttccgtagttgtgtaaacatacagtgatatgtaaacatatagtgatatgtaaaatcactatattatacatatagtgatattttatatatcactatatgtataataaatgatgctattttctgctcttagactccccatccctctgtaaatgtaaccatttttaagatctaacttaaaccttacctcctagcagagtccatcactcagtttcctaataggatatgatttatctccctacagaattctcctggaatgagtatcattatttgcttattcttcactctcctgtctttcagcctccctactaaatgctgagctcctctaggttaagggcttgtcacacttctcttagtattcctgaaactacttgcctcagtatctgcctcagcaggtacttctttctccgaatgtgaaatgagctcaaggaacaacctaagagttgagaaggtctgcatttcgttgcttctagaatgctatacgccatgttgtgtccacaaaatgcgtaccccaaaggtaagtagaaagttagaagaggtgcactccacaaggacagatttttatttgtttgttgattcttcaaggacaaagaacagtgctcttcactcagtaaccatttgaagaatgaatgaagtacatagctggcatcttaaatttctaatacccttgttctataaatgagcaaagccgaggactgcagagctttcccaggttcacaaggtcagaagtagagcccagttttctgcagcgtgaatcctgtctttctcctgatctccacccctgccatgaatagtgtcagaccggagcgagaattgtcccagtaactctttccaggtgatgctcactagtgttactttcttaccaatatctgaggagcttccttctttaggcaaggtctaatttttaggtcatctgaaagaagcaagagtagaaattgcagaatttcaaaggactcagagacccagaaaggggggtttattggcagtgctcctctcctgctttagaaacaacttttaacagcaagtagcaaactttttgatgagacctctctcataagaactttgcaagcactatccatcctgttgtcgcaataaagtaaaatttatctttcttagaaacatacattcagatcatggtgtgacatccttgagaaaaatagcggaaattcacaaattgttattttctcctttctcccaggaaaggaaaaaaatatcactatatgtataataaatgttaagcttcgagattctaaagagaaatttgaccaagggactactaaatcacaaatctaaaaataagtcctatatatctatacacaaatatgtataaaactacatacacataacatatataaacacatgcatataatttttaaaattctggttattttcaaatcattttccgttgcttatttattccgaaaacatttcttgagctattatgtgaaaagcatttcggttcttttgtgtgtgagatttttccatctagacaaaaatctgcttatggttaaaggtgaaaatgtccaaagacaaagcagaattaaatccctcccatgcagaaacatctaatttgagaaggcaaaatgaaaaagttgtagcctttaagggtgattattttattttttgcactattcatggagcatctattttgtaccagacgctgggctgggggccattaccacgatgaatgaatccacagcacatttcttgtctttacagagtgagctcctcaattttacaatattgcttccggaggagctactcacagttcggtcattaaacagaacattgcccttgtcaggagcttagaaatcatcgtgacattcttggcttaaacttaattttaccaaaactgagtgtacctgccgttgaccttgggtcccttagggccaaggcactaggtctgcttgccgagagaccactgctgtaggaacatgctctcctgtgaccctgcgctttgacataagttgcctttttccaggggatccagagagtcttctggagcagggagcactttctgtctaaatattgcatatggactttaatgaaaagctgtgtccttgcccatctgcagtctttgcccattctgaggttcagatttggcctgaaagtcaagtttctgtggtttttgcctggtcaggacccaggcagagtgaatgatctggcttggtgcacataattagcaggtggatgaggccagggtggcagatgtttccagaccacactggacatgagccccagccctcttgcctgcctgatgctgtggaatagtggtaccatagcccttccaaccgggtgggctgtgggctgggagtggaggctggaagaccaggccctcctctccagaagtctgtgtcctgctctcagttaaacggcacatattgtcttattctagaatgtgttttagtttcttggagaaagtgtttaatgaaccatttaagctatatagagaaagttgagagattatggcaagagagagaaaacaaatctaaacccaaattgtatctacaggtgtgggagtgattgggggtgggtaggaactgaagggaagcatcaagctctaagatagaaaaccttcattctgtgctcctgactccgtcctttttcaagtgttcatttgtgtctactaaacgatgtaatcgacgcactatttttatagaaacatgaaactttgtggtagatatttttttcttcactgttagaactcctgcctttgaaatttcattttagaggcaaaagagagtgaacggctttgcttttacatttagcacatgttggtataaattcgcaaatagcttttgagggatccagatattttatttttcaaatctgttttttcaaagtgctattagcaggtggaactcatgacttcaggcaattttcaggcaatgagctcagtgagatttgaaaattagctaagccatttgtagattcatagaatgctgtctggataaggaacctaagccatggtcccattcaacccactcattttccacacagtgaaacacgttgtgagcacacatctcccaggaccacagaacttatatttgttaaacctgaaagaggaacctgtctctgagcttggggcctcatgctctgcagcactttttgctagctcttttcaggggctgtcctcagggtgcaggctggtggcatcaacgatcgaggtgcaaagtcagtgctgggataggggactgggagtagccaggagcttaccctggttgtgccttatcttcaagccaattattaacagtattgctagttcttcacatttttctaagcaaaccaaaagattgtgtttttaagataaattttataattttaagattttttttctcactcaacttaatgattttacaatactcagtgggccaaaccaagtataactgtaagtctccaatttgcaacctctgctgtaggaaaactgtgttttcaagatgccttagtttggggtgttataccaaataccatagactgagtgacttataaacaacagaaatttatttcttacagttgtggaggctggaaatccaacccagtgtggtcgggttctgtaagagcccccttctgggttgcaggctgctgactccttgcaccctcgcttggtggaaagagggctagggagcattctggggcctcttttataagggaactaatgccattcatgagggctccagcctcatgacctattaccttcaaaggctcctcctccaagtatcatcacactgggagttaggattccaacatgcgaatttgaggggtgcaaacattcagtctctaacagaggatttctatgaatggaaaaagaccatgatcatggcttcgaataactaaaatctgaatgtggcagaggggcttggcacctcctgacttgctctgagtccagaatgaaaagtagcgggtagaagattttgattcaataacaatatatattttctattactcagacttattcaagaagagtgaggcattggtcgggtgtggtggctcacgcctgtaatcccagcattttgggaggtcaaggtgggtggatcacaaggtcaggagttcgagaccagcctggccaatatggtgaaacctcgtctgtactaaaaatacaaaaaaaattagccgggcatggtgtcacatggctgtaatcccagctacttgggaggctaaggcaggagaattgcttgaatctgggaggcagaggttgcagtgagccgagatcgtgccactgcactccagcctgggtgacagagcgagattctgtcttaaaaaaaaaaaaaaaaaaaaaaagagtgaggcattaatacgaaagttgccactgaatggagccaagcggccttttgtaagggatgctggaaaggtctctgctggatggaggctggtcctgtcccatcctggagaagtgaactcataacttcctcagtctaagctcaaggagaccttgctttctaacctggctttgtagtcatcctgaaaacctccaactgccttaacatgccatgggaaatggtccaaaagctttgggggacaaaatccatgtaaatgcaaggcgtgcgtgtatatgagtttgttctcacttttttttttttttttttttttggtttttactcaccactgtactgacgaggatcactttcctatttaaatgaaaccctaccagcttgagtctccttggattcttagggattgctccttcccttttataattgttctattttctcttgtccataaagcattgtgcaaaccttcttcatcatctatatctcttccccaccactagaaaaattcctctctttacttgatttttgctacaacaccttagaaatgttatttttaaaatataacacatatatatcattgtctaaagcaagggtctgcaagctgaattggctggccttctgttttcatagataaggttttattagaacacagtcatgccagtcatttacattgtgcttaaagctactgccatgctataatggcagagctgactagttaagacagagaccattagacccacaaaaccttaaatgtttactaactagccctttaagaaaaaattgacctaactgctgatttatatgaaaacaagtatacaggtataccttgttttattgcatttcactttattgcacttccatagatactgcatttttcttacaaattgaagatttgggcaaccctgagtccagcaagtctatcggtgccattttttccaacagcatgtgctcacttagtttccttgtgtcacattttggtaattcttataatattttaagcttctttattatgatatctgttatggtgatctctgatcagtgatctttgatgttactaatgtaattgctttgggacatcatgaactgcacacatataacatggcgaactcaatcaataactgtggtgtgtgttctgactcttccacccattggccatgccctcatccttcttccttgcctcgggccaccctattccctgagacacaacaatatggaaattaggccaataaataactttacaacagcctttaagtgttcaagtggaagggagagtctcatgtctctcacttgatatcaaaagctagaaatgatcaagcttagtgaggacggcatgtcaaaagccgagacaagtcaaaagctaagcctcttgcaccaaacagttagccaagttgttaatacaaaggaaaagttcttggaggaaattaaaagtgctactccaatgaactcctgaatgataagaaaacaaacagctggccgggcaaggtagctcatgcctgtaatcccagcactttgggaggccgaggcggatagatcacctgaggtcaggggtttgaggccagcctgaccaacaaggagaaaccccatctctactaaaaatacaaaattagccaggtgtggtggcgcatgcctgtaatcccagctacttgggaggctgaaacaggagaatcgcttgaacctgggaggcagaggttgcggtaagccgagattgcaccactgcactccagcctgggcaacaagagtgaaactccatctcaaaaaaaaaaaaaaaaaaaaaaaggaaaacaaacagccttcttgctgatataaagaaagttttcatggttttggatagaggatcaaaccagccacacagcattcctttaagctaaagcttaatccagagcaagtccctaattctctccaattctatgaaggctgagagacatgagcaagctgcagaagaaaagtctgaagctagcagaagttggttcattaggtttaaggaaagacactatcttcaaacataaaagtacaagatgaagcaacaagtgctgatggagaagctgcagcaaattgtccagaagatccaggtaagatcattgatgaaggtggctacattaaaaattgattttccttttttttttttaaagacaaggtcttgctctgtcactcagactggcatgtagtagcatgatcacagctcactgcaacctcggcttcctgggctcaaatgatcctcctgcttcagcttcctgagtagcaggaacaacaggtgcgcaccaccacattgggctaattttttgatttttatgtagagatgaggtttcactatgttacccaggctgggctcgaactgctgggctcaagcaatcctcccacctcagcctcccaaattattgggattacaggcgtgagccaccgcacctggccaaaaatagattttcaatgcagataaaacaaccttctattggaaaaagttgccatgtaggattttcatagctagagagaagtcagtgcctggcttcaaatcttcaaaaaatacattgacttgcttgttaggggctaatgcagctggtgactaagttgaagccaatgcccatttaccatatgaaaaatcctagggcccttaagaattatgctaaatctattttgcctgtgctctgtaaatggaacaatgaagcttgaatggcagcacatctgtttatagcatggtctactaaatatttaaacccacttagaaaaaagattccattcaaaatattactgctcattgacaatgcacttggtcacccaagagcactggtgaagatatacaaggaggtgaatgttgttttcatgcctgccaagataacacattctgcagcccatggatctaggagtaatattgactttcaagtcttattatttaagaaatacatttcttgatgctatagctgctgtagacagtgattcttctgctggatctgggtagagtccattgaaaaccttctggaaaggattcaccattttagatgccattaagaacacttgaggttcatgagaagaggtcagaatatcaacattaacaggactttggaagacattggttgcaaccctcatggatgattttgaagggttcaatacctcagtggaggaagtcactgcagatggaatggaaataacaacagaactagaattggaaatggagcatgatgatgtgactgattgctgcaatatcatgataaaattttaacagatgaggagttgcttcttatggatgagcaaggaaagtgatttcttgagatgaaatctattcctggtgaagatactgtgaacattgttgaaatgacaacgaaggatttagaatattacataaacatagttgataaagcagcagcagggtttaagaggattgactccaattttgaaagaagttctattatgggtaaaatgctatcaaacagcatcacatgctacagagaaatcttttgtgaaaggaagattcagttgatggggcagacttcattgtcttattctaagaaattaccacggtcacccaaccttcagtaaccaccaccctgatcagtcagcagccatcaacactgaggcaagacactccaccagcaaaaagattatgacttactgaaggcccagatagataattgtttgcatttcttagcatatttttgaaattaaggtgtgtgtattatttttctagacataatgctattgcactgctaatagactacagtatagtgtaaacataacttttatgtgcaccagaaaagcaaaaaatttgtatgatccattttgttgagatagtcactttattgcagtggtctggaactgaacctgcaatatctctgaggtatgcttatattaaataggtaattgaaaaacaaaaacaaaacggataaaggacaaaataaccatctgtaatgcaatgactagctggacaaaccactggtgtcttaatttcctctaaccgtatacagttgtcccttggtatccatgggggattagttccaggacctcctgtgaataccaaaatccacagatgctcaagtcgctggtatacgatggtgtggtacctgcccataagctacatacatcctcctgtatacttcaaatcatctcaagattacttataatacctaatacaatgtgcatgctatgtaaataggggttatattgtttagggagtaatgacaagaaaaagtctgtacatgttcatatagatgcagttttttctcaaatattttcaatctgcagttggttgaatctacaaatgcagaacttttagattagaaaggctgattgtatacattgcaatatgaaatcacaccataaatacaattttttttaagctttgacttacataattctaggtgtgattttaagcactcaaaaacacctatgttcatttagcaatatattagatgcattttcttctcagagattttttgacattgtataagtgtatattacaggttgagtatcccttaccaaaatgcttgggcctagagtgtttcaaattttgaaatagttgcatatacacaatgaggtatcttgaggctggaacctaaatctaaacgtgaaattcatttatgtttcatgtacgccttatgcacatatcctgaaggtaattatacaatatttttgataattttatacatgatacagtctgtgtacattgaaccgtcagaaagcaagggtgtcactatctcaggcacccatgtggacagtctgtgggtgtttgacatcaccatcattcctgactcagaatttgtatgctacaaagaaaatgataagtaatcattttcttacacttattcgcacttcagtactcaacagtaaaacaatatggcatatcattaatatagtgataaacaatgtgttccaggtaactaagcaacacagtagcatcaccagaatacctgtatcagctgttagacaatgacaacaaacatcagcaggctggatcaattgtgtgtggtgcacatgaattttgactgtgacctggcacatgaggtccattgtggaattttccacttgtggcattatgtcggcatttaaaacatttcaaacgttgtagtatttcagatttcagatttttggattagaaatgctcaacctgtattaataactgggtatacaataatctacttagtactttgtgtatatgtatgtatctattatgcattgattctttagtgtggcactttactgtatgttttatgtataaaattttatttggctgagcatggtggctcagacctgtaatcctaacactttgggaggccaaggcgggtgaatcactggaggtcaggagttcaagaccagcctggccaatatggtgaaaccccatctgtactaaaaatacaaaaattagatgggcgtggtggcacacgcgtgtaatcccagctacttgggaggctgaggcaggagaattgcttgaacccaggagcagaggttgcggtgagccgagatcttgccactgcactccagcctgggcaacagagtgagactctatctcaaaaaaaaattttttttgtatttaatccttccaagtttgtgtgaaaagtattattaacttcagtctacagatgggagtactgagacctgaagtgtttctatggcttgaccagctcacactgctgggctttccaatgaccaaccctgcattttcagcctttcacttattactgggcactgaagttaaatgtacctttgttttgttttttgagaggagtggatgttagaaacattgaattgattaatacagtgtatacaaatcattgactgcatttttttggtatttccatagaaatgattctcaaaagcagaactgatgaatcaaaaggtacactggggtttcctcaaacatactgaagaatgtggcttttcaggaaagttgtaacaacatatattgtattccaaccctctatgaaggtgccagactccaacttgtcagtgctcagcgctatgatttaaacccttttagttttgctcttttgccaaaggaagagggatactggaggtgggctctttgcaggtaggtgcagccaggtgactcctgagagtggcatctgggaaagatgttgttttcctgatcaggagggacattttcagttggcacaagtgttcaccctttgtccttctgtctcctcctgctgtcttatgaccgaggattgaaagctgcatgctgaggactccacatggagggaaaggtggcctgggggcctgggttacaagggcatcgagtggggaaaatacccagtttagtgaaacctctgttgttaggttcagatgcaaaggcaaatgcaatcctatccactctattttctctgactcttagtgaaaggatcatgtttgtatctcattttctgcaaattctctgtactgggactttgcatctccacacagcccctcacagcgcccccccgccccaagtaaggttttggtgtttctcttgccaatttgaattaagtctatatattatagatgttaactatcatttttgatgcagtttaagatgtgtcttttaattttatttgtgatgacctattggttaaaataatgatcttcagatgtctccatcaaaaagtacaatttgtcttcacacttactaatagggacaaattcctattccccaataaccttgcacttaattgtcgtatcatcgaatggatcgcccctaaatctacattgggggttgcaaaatggtaactttacaatcatatgattcccttcacattcattagtggtcattcttctgtgaacaagagtttccttctctctctctctttctctctttctctctctcccttcctccacccctccctttaggggaagagagtcactgggttcttaaggatttttacttactcagtgtgatacaatcagtattcttcatggtgctcaaattaacccaattttgcccagtgagtgccttttatgttatctctaacacaagaaattgagtgcttacacttttctttaattcttgacccttctttcttccttccttccactctcctggtctcttccccttcctctgttccttccttccttcctcccttcttttcttcttcagttggaggtgggaggtgcttataacattggctaaaattagaacgataataaataatgtggtgaaagaagagttctatttagttcttgtctttaattaagctggatttagtttttcattattaaataataagggctatttgtttcagttttttaataagaaagaaggatgattctatttctagttttgttggtgttttaatcatgtctaaacattgaatttgggggaatttactgaagttaactagtgcgttttttcctttgacctaatgaaatgatcaattacattaataagtttcctagaattaaactatctttacagccttcaaatacacccaacctgagcactattattttttcaattctgtgatgactcaatgtgtttagttttatatatatatgatatacttacatatgaaatatatacacatttatatataaatgaataaataagattagtttgcatttttattatactatgtatttaacatttataaaatgaattggtaaactttttaaattctcctgggaaatgaatatcatgtgattattattccctggaaaatctccttgggctttatgcctttttccgtatcaatctgataaattaattcattaatcttatggttattggtctctttagtttttatttctagttgagacaaataaattatcttttcctagaaaactgtctatttttctaaattcaagtttttgaccatttttcttttatagtttcctgtttattagtagctttaattccttttgttgttgtttttacattttatatttctctctttctttctctgttccttccttactctgtcccttactctctccctctcttcctccctctctttttcaactaagattagttgtaaatgtgtctattttattgtttttttaactcaagaactaatgctgatattcatttcctttattttgtactttcttatatctattgttttcaaatatatgtatatttttaataatacagttttcatgagtgtcttttacttttctttttatgctgttttggatgaaaactttatttgttgattcccatcttggcatgtcaataattttaagtcattcttttctgctaagtctagatttagcttaagaattcttctcaacagagagctgtacattgtcacatgtaggctaggatatatagctgtgtccatcttcggaaaatataattagtcacaagccctctctaacttgttcaaacttacctaaattatgtttttttatagcccaagtgtttcattcttaaattttaagaataaatttgtggccgggcatggtggctcaagcctgtaatcccagcactttgggagtgggcgggtcacctgaggtcaggagttccagaccagcctggccaacatgatgaaaccctgtctctactaaaaatgcaaaaagtagccgggcgtggtggtgcatgcctgtaatcccagctacttgggaggctgaagcagaagaaccgcttgaacccgggaggcagaggttgcagtgagccgagattgcaccattgcactccagtgtgggtaagagagtgagactctgtctcaaaaaaaaaaaaaaaaaaaaaagaataaatgtgttttaaaatatgaatggaatgaacttcccacctatagatttttgggaaagtctatgtttaagtgtttttatgtttaaatttaaatttaatttttttaaagacagggtcttgctctgtccccaaggctggaatgcagtggtgcaatcatagcatactgcagctttgaactcctgggctcaagcaatcctcctgcctcagcctcctaagtagttgggactacaggcatgcaccaccatgctgggcttctgcaggtttttaagtggcatattttcctcaatctttcaatatttgggggatttttttttcttactttaataaataatgttttgtctgcgactatcatttttgtgttgtgactttttccccaagactcttgacatattattctacctttggtgatcatggagaagtctgagggcagcctaaatttaaattctttgtagataatctggattgtttttctacttgggtacatttaagagttttaaaaaatgtatcagagcattttgctaaaatgtctaggtatataggtttttgctctcgttgactttacctgaaacatgaattctgatttgcctactctgtgaaggaaaatctttacttattatatttttgtgtattgattcttccccctgtggtactgtatttatctcggggatgttgttataggctgttatctatctaccaatatcttccctctcttttttcacttactaacagggccacgacttaatttgggaatggtctcttcttaacagctttatctcccagtcttccttacagggagggggtagtcatatgacatatttgaatctaatgagataaatttggaagctgccaggtggagctcctgagaatgctctttaaggggagatgactcatctgacatgcctcattcacctcttactcttcctctgttagatctggaatgttattgtaatggctagagtgccagcagccaccttggaagctggggaggagggccacacactaaatttgatggagctagggctaaaaaaaacagtctggggttcttagaatatcatgtagctgccctcccaccccagatctgtccatctctggacttcttgccacataagagaaaataaatatttctcttgactaaggaaatgctcatggcttgtttggtcaatgtctgaacaaaataacttctctgataagccaataaaggtaaattatccatctacacctatcatcttttcatgcatagctttttcctttgacccattctttcatattcttaaagaggtttttattcctttttgatacctctgatttgaattttcactctaaagcagactttgtttctattacttttaattttcatgctggaaagatatagctctaatcccctatttgagttatatcttttttcatttcaacttgcatttcatttcgtttgatttctgaatttaagttttttctaaaatcaagattaagttatttttcacatcatttctcacctgatttcacaaggccttttatgcttttatgacatttttttcaggatgcaaaatagataccatttacacttttttttttttttactatttgctgatagctccttttcaaactgtgattttccccaaattcttagaattgcactccctatctgtattcaacttttttttttctcagtttattcacctttggacagtaaaacaatccaggctgatgtttactaaattattagaagaacctcgtcctgtctctatgtgggttctgcctgaatcagaggcgcctgatactactatagacaggatgagggctctagaccttgccaaattttaatgcttagttggcacttatctattgaggcatatctcctagggcttattttgaatgagtagcttcccaaagctgttatatgtgtttctctcatgactggaacaagggttgtttcctgggtaataatataagaggatgcacttgcagagctctttagctcttcattcccaaagggggccaattccagccccagggctgagagcacactccttcctcagctgggctgaaattacagggaggttctctcatctcccagaagttgtagaaagagactgcttaggaaggagagctggcaaaaacgggtcacttctggaagcactccttccacaatggaggaatgacaacccattttctggcagtgtatggctgtggcctcagcctcatatctgaaatagggtggtaggctacaggtggaagatttccagcccgttttcatctaaattaccctctcaaacagatcacagttttgcaatccaacccatccaaactgcagataagagaactttttcccagggagctgcaaaacattggtcagcattagcaattcccagtgctgtgccttggggagcattatagtcaatgcacgtccactctcacttgttctggtggtggccgactctagcccaggatgttcccaacctaagactgatcccactgttttcaaggcatttcagctgagaaaccctttattatctcaagtttaatatgcccaaagccaacagtatgacttttcctggtaatgacattttaattcttcttgcccttaaatcttgtagttaagcaactagacccaccatccaggtcaacctgttagagttaagcagtgagacacagatgtatcacccaaatacccttgaggttatccagaattccactttccctcctttccattctcactgctgtcacaagtgtgtggggtgggttcaatcgcttcatgtctgaatcaccgaaggagcactcctgctcatctcttctgcatctcctctcccctccctcccagcaggcatgtcaatcccagggtgatgctttcagcagagcctcagtcatgctacccttagctgaggagctgctgtctcttccctgtgatctgcagctcaggttccaagaccatgattaaatggtctagaccctccagagatgtggcccacattcatcattcatccagtattccttcctgcctctctctaaaatggatactcatcagtagattccgcacattccattctatatttatcctcagctcttggaacttgtaaataatatcttttctgcctggaatgctttctgccttcttttatttatttatttatttatttatttatttatttatttgagacagggtcttgctctgtcatccaggctggagtgcagtggtacaatcacggctcactgcaacccacacctcctgggctcaggtgatcctcccacctcagcctcccgagtagctagaactacaggcatgtgccaccacgcccagctaatttttgtatttttagtagagatagggtttcaccatgttgctcaggctggtctcgaactcctgagctcaagtgatctgcctgctttggcctcccaaaatgttgggattacaggcatgagccaccgtgcccagccactttctgctttctttatcacctgtttagatcttactccctcccaaagatgcagctcaaatccagatgtcatattattctgaccaacacttttttttttttttaagattccggccattatatactgaataagagacatgcacatttggaaatgatttcagtggctttgtttgtaaattcttttgcatctctctcatttatgtgtgtgattcctcaaaagaatgttcaataaatagatgctataaaagtcagaataataaccctcgaatttttttctctagctgtaaaagtcagaataataaccctccaactgggagaggtaatgaaagaagatgttttctcagtgattggaattgctgctgcccggactggcataagccagttgttcaggaactattggatgctggtgaagatatcatttcaacttacattttctcggcttatgtagtcaatggtttaatctatgctgatgattaaatatctctttattaaaaacatgagttttttgttttgtttttatgtctgtttttccattttagttcctaaagcacagattgctccagcactgccagtaaattaattaggaaccaccgggtggttttcttctgggagtaggagttgagggtcgctttgggggagttcattgtcgtgtcctttcttccacatttctgaagtgttgttataaaaacgccttgcttttctgtctggatatgtacttgtctgcacagtctatttaccacccctatagaatcatcatcttctcaaactatgtctacaacgtttgcttttacataagttggacaattaggctagtgttctgtgccttagtaaaaaccctctctctcttttagaccaagtgacctaaaacctcaagcaacagttttaggacggagtattccaaagcgctttccataaaactgttttaggatgaaaatagagcttattccagggtaggggcagggggaagggtgggtgagagattttaaatgtcagataaagaggcctgaacaaagagaaacagatttctttgcttctttactgcaggacttctcaaggcctttggcaggctgctgtgcatggtaaagctccaccagggccaggtttccatgtgcagctgtgcagacagactggtttttttgtttgtttgtttgtttgttttaataacatttagtattttagcattgttttaacaaggcgttttcacatccttcgtgccattttaattggtgttctttttgtttccatctccattttattatgatatcttctttattcttaatgagcagctctgatgtgaatggtgcctctaggagggaaatactgacctgaccctaggggggctgccacagcatccccagaagcatttggcatgaaactcttgttcttcaaagaatatctttcaggcctagtgtttaatggggagcaccatggcaaacctcagcctgggctgttgcaaatcctgtaatcagagtaaaatggaagttttgccatacagcttgtctggccactaaaatgctactggcttggctcagaaatgttcaaaagaccccctgcatagaggatgagtcaaagacgcaacatgcaactattcctttgtgctgccaggaagaccgtgctgtgaatccatttcctacttagagactcctgttttcctatttaattaatgtcatattttctcttctataacatttagtattttagcattgttttaacaaggcgttttcacatgattcgtgccattttaattggtgttctttttgtttccacctccattttattataataccttcttaatttttctgctttttagttttcccttatttcttttcattcaaaaatttaacacaattttatattgttcccggcttctaatcttttaatttactttcttaatccaagtttggtttcgtttctcttaattgctttatttcattattcattttgaggctttcatctttggaaaaagggcaaatttggggatcagattatgtggttttgactaccttcccaaccattactgtctgggtgtcttaggtgaattgtttaaccattctcaaagcttcagttttctgttctgtgaaatggacttggtgataagttgttgtaagtattaaatgagaaaatgcatccaaagttcttagcccagtgcctagctagataagaaatgtctaataaaggttatttgcaatgtgaatattattacattttaagttgttttgtcatctttttattgttaaatttatacttatttaatatttttgattatttgtttcatattttttccccattcaccttgaaactttggaattttggattctgacatccttttttggctctgtttcatctatatttctcctcattaaattttttccatttcttctgaatttgattatttttatgctgacatctttatacagtacatgaagcagggatgaagggattgctgaagttagtggactcacaggactagcagggaggtcccaggccatagaggtgcttcttgactgatgagcgactgtgccccctcgtaagtctcctgtctcttttcttgtcagttctccaaaaaaatcctactgtgagctatttcccattggttaagggtatatctaagtgctgaagtaatgctgttccgtcacactcattaaccgtgaagaaccacacatcgaatccatcgtttctggccttcgtggtccctcatttatcttcttttgttactttttgaaggtagtttctaaatggcgtcccaaaagatcctctagtcttaaattacgtgattcaatgattcaatatatcgtgctcagtattctcccacgagattaggagaacccaaagtaatgcaaatgctccctttttgcggtatcagctcggctgctgtaagtgatgacacagactgggcatcttcagcagaaatttattttctctcagttctggaggctggaagtctgaggtcaaggttcccactgagtccgttcctggtgagggcttgctttctggcttcccggtggccaccacctcactctgctcacgtggccttctccatcatagacagagacagaagcagagagagagacagagctcccaggggtcccttcttcctaggacattggtcctattggatcagagccctgcccttctgacctcatttaatcataattacttccctagaagctctgtgtcttaatacagccatgcggtgggttaggacatcaacaggtgaattgtggggagacacagacattcagttcataacacccgtctttggtatggagaaagctgaccaatggtctggtctgccagcactgcgaggtgacatttctcactacccactcctgactgaaagctggctccctctggctataacattctttgcttgaatccactgagtggggtcattaggaaactctattcagttgcctcaccagggtgcccacccccacggccctggaatctcaccgaagccacctgtccaggaattgcccagacacaggcacgctgaccccctgctgggtcacagtgcttacctcagagaactgctgcacctggggctgagccctttgaagctagtggttttcttagaatgtgcttctcttggaatgtagccaagagtgttgacatttctcttgggttttaacatatttttgtttgagatttggattttgttttttttttaaacagagtttcgctgttgttgcccaggctagagtgcaatggcgcaatctcagctcaccgcgcctccgcctcctgggttcaagcagttctcctgcctcaagcatcctgagtagctgggattacaggcatgcaccaccaccccggctaatgttgtatttttagtagagacagggtttctccatgttggtcaggctggtcttgaactcccgacgtcaggtgatccgccagcctcggcctcccaaagtgctgagattacaggtgtgaaccaccgcacccggtgagatatttggattttagaaaactaatttctcagtttgtaaggaaccaaagaaatacaaatccttcctaacagcatgggtgtactggcgacttggagtctatgagccggacacctcaagtcctactgcaggattcctcccactggctctaatttaggctttgagagtttgggtgcaactgacctcaaagttctattcctcccgaaaacctgcacacgctgtgcttgcactggagtctgtatttatttctccatttattttactgcattccacattctctatgatagagaaaattctctgaggacttgaaaactagattgaggtctgggtctgatggaggtgtgggatgcctgtttttgttgtgaacgcctggcctggataccctgcatcctcatcatttggggatgccaattaaacctgcagattctgaactcccaggagggggcccatggaatcgggcccctgggacttggacaacactgtggatattgcctaaaatcagcacttttaaacaagttcccaagataattcttactcgcactccagtgttcccctagggcagctttgtcacccaaacagaaaattcttagaaatgtattcatgcacagaatctagcatgctgaagggtagcactggagaccaagctgggggaagttacctcctcccttccgagggtcgagggtgggctgctgtgcccaccagtcctggctctggctcagctccctccccacacaaagccaacgtcctgctaggtttcagctcaaagtgacagcagactggcttcccatcctcacatctctttgcccacaggcctggcccctctgtggcttctaattttttgttttacctctgtggtaaatcctatgtggcttctaattttttgttttacctctggaatttgacaacagttcctggaggatctagcatgtatacacattggttcttttagcactccagtttcagcatccacttgatagcttcctgtgccttatgctcagaagcggggttccggcttgtcttgcatccactcctatctgtgggatggagcacagggtgtaaaatcgacaggtcccagatctgtaaaatcgacaggtcccagatctgtaaaatcgacaggtcccaggctggctcagagtggtgggtgctgtggtagccaaagctgggcttggccatgtaacactccagactggagagtggtaggctgcctattttattttattttattaagacagagtcttgctctgttgcccaggccagagtgcagtggcatgatcttggctcactgaaacctccacctcctgagtagctgggatcacaggtgcatgccaccacgcccagctaatttttgtagttttagtagagacggggttttaccatgttggccagactggtcgtgaactcctgaactcagatgatccacccacctcagcctcccaaggtgctgagattacaggggtgagccactgtgcccggccaaggccgcctttcttttttatatattgttttgagacaaggtctcgctctgtcaatgatgctgaagtgcaggggcttgatcacagctaactgcagcctcaacttcctgggttcaagcaatcttcccacctcagcctcctgagtagctagggctacagggatgcaccaccatgcctggctaatttttttatttttttgttagagacaggctctcaccatgctacccaggctcgtcttgaactcctgggctcaagaaatcctcccacctcagcctcccaaagtattgggattacaggtgtgagccatggtgcccagctggatgcctcctttagatgccagctctcactccccaggatgaagctgtgggcataattgtaggagtctagccctggaacccttatgcagctgctgcttcaactgcccaaaggactttggagaagatcctcctggctaccaaccgcttgttcaacctgcaaaatgtggtcattccatgtacactcactggggagactgagttatttgccttatttgatggccacttggggtgggcacaagacattgattaagttagaaatttttccagctcagaagtctagagggaactaggtagtttttctctgcatactcaggagtataactcataaccttcctggtcaagatttgacctgctaagactgtgtttgtcagccaatggccagcaggcttcttgccactttgtcacagatgatgatattgctgcactcacggtcagcaagtctggcatgttccaggatcccattccagatgccaaatgacatcgagtcatcatgtcttcctagacacctgttggctgtaagagtttctcggacgttccttgtttttgatgaccttgacagttttgaagaatgttcatcaggtattttatagaatgttccttcattgggactttttttctcacaattatactggggctatgtggtttgaagagtaaggtgccatttcattccattatattaacggtatacaatatcaatatgactcatcactgttgaccttaatcacttggctgaggtagtgtttgttgggtttctcctctatgaaatttctctttttccccttcccatgcagagctctttggaaggaagtcactatgcatagctcacactgaaggagtaggaagtctgttcttcctccttgaaagcagacacctacctacctatggaatttttccccaagggagattggactcttctcccccattgattagtttactcacttatttttgtcagtatgaactcaggagtatttttttattatttcaattataatccaataatacattattttgttgttgaacttgtctgggagcccttttattgacttgtgtgtccctttgatatgctgcattttgtggagttttcttgtttctttgtctgttgctttattttctagagcactttcttatttcctggcactacaaaatactccagactcatcttgtatatttcttgttttagtcctagatcagccatttctccaaggtgccctattttcttttattgtggaatagaatcagacatcaagatgtgggtgctggttttacggtatttttgatgttcgaaaacccaattaaattttatgtagcaaaatctatcaaccttttacattctattttctcacttgcttttaaaattccttctttctaaagacaaatcagtggataattatatgaatttagatgtaaataatctgcatatatgtcctttcattttttttaacatttgaatctttaaatatatgagctatacttttggtacatggtgtggatgttttacaactttattcccaaaataaattactaactctctcaacagaaatcattttatactttttaaggtatttttccttatcttttgaatcttgagatatgggttgattggattgtgggttaagctgtatgaactcaatgtagtctgcatggccccttaagatgattaatggagtgtgtttccctggtaaaatcagcatggctttgccctttccttctttcatacacgtatatatttgagacagggtctcgctgtcttgcccaggctggagtgcagtggtgtgatctgacctcactgcaacatccacctcctgggctcaggcgatcctcccacctcagcctcctgagtagctgggaccacagatatgtgccaccacgcctggctaatttttgtatttttttgtagagacagggttttgctatgttgcccagattggttcttgaactcctgggctcaagcaatcctcccgctttggcctcccaaagtgctgggattacaggcatgtctttcttatatcttcatgaacagcttctggaggcagaggtgtcttcctgctgtagaggtctagagaatatgtctctgcccttaattgaaaagtctgtatgctctcatgtattgccacaagagataatttcaaactctctgttgcccaagtgttatccagaggatggttgtgagaaacagagcactaaatcattttatgaaagatctgtaggctacccaaccctctgtatcttctgtgtgtcacctccagggtaaaaaaaaataataataacagagtggaagttgacttgggtctaccactttgggtcctttgtagaactgctcttgctgaacggtgttggtttttgctccttccttccttgcacagtggtatgcggtgagaagaagccacagttaaatcacacctggatttatcacttggggcccttacaatggaagatgtgattctctccactaccccgtgtctcctctttggtttggctgataggaaactcaaagccaaatctatccccatttacagcaaaatgtttgcctttgactgaattttactatcttgcttccaattttgctttgtcctaatttccttttccacttaattttctgtggtattggatttagggtttctccaccttggcactattgacattctgggtccaataattcttttttgttggaggctgccctttgctttgtaggatatttggcagcatctctggcttctgcttgctagtagcagctgcacccaccctaccctctccagttgtaacaatcaaaaatatctccagagttttccaaatgtcccatggggagcaaaattgcctctggttgggaaccactagattatatgtatcaatgccatcactgaaatattttggttataaggcagtatataatattttgaattaataataaggaaatgaataagccttaactggtgaaaaggggagaaagggaatggaacatttacagttggacctggaaattcgagtcttaataagttgcccaagcattactgtaacaattctgaaccactgcttgtctattcacctggtggttcttagatggaatttcactgaagtatcatgtctttaaagagagaagcttctgaaggggagaaatagaggatgtatgatggacaaggcttctttggggatgcccactccatgcagacaaggaagatgtgccaggctaatcaggagccagtggcagcagggcactggccaagccccatgtctgtgcacagacagctcatggcccattagtgtatggtgcttatcccagaatatgtggacatgaagaaatgaagatggaggacttgagtaggtggtgaagatcatcaaactgggatacaggaactaggttatttgccactttgggggtgccatattgcttctaaagactattttatggctgctttatgtggcagtgtatttgcataccccttgaggaacttgcctctggccagcagtgggtaatggaaattttgtacttttaacttttgttgtgaaagactattaaagttgtctgttatccaaggaaacctttactaggctttcaaagccagagctaaagaataataggtagttcccaggtaaatattttaatgtgcctattctgatttctctaatggtaatatgcatttaatcttgaaagaatgtagttttgtttttttttaacagcactccaggctaagcatcttgcattacagtaaataattgagaattgagctttacaccatttcatccaattgaaatagtgacatagagtgcattttgccctttgcttgaagaaacatgattttgttcagctttcagtgcccattcctttgcaattgaagcacaatgtagtttttcttttgttattgcagaacagatgaaatgaaaccatagataaacgtgtaagaggtacttttgaaagcagagctataaaactcagttccatattcatcatggcttggatgtccagaacttgcttacatctatttgtggacttttttgtatcaaaggtaaacaaagagtttttaagaaaacaataaatttctttagtttaaaatcaggtcatgtaccctttttttaattaaaaaaggagtgatgattcatcttccatctcccaactagggttctccagtaatggcccttgatggtgctgtttcaagttgtgtgtatcaggagagtttcagctgcgaagggactggccattggccacagtagtcttgccagaatgatgtttgggttaattgcaccgtctagtttattttcagtcttccctactagacagcacttagcattgttttactaaactttatatccctaagctgagcactaggccaggtgtataataaaaacttagtacatatttgggtcactttctatttagtgatagtgggcaatttgcaaagctcatcccccaaaggcataataatatttataacagttgttcccaattcttgagaatctattttgtgccatgtggcagtttgggttcttctggaaatgaaacctgagatggatttgtgtgtagggagtgcccttgaattcaacatctgtgaaggaagggggcagaaaggggaatgagccaagggagaggtgagctataaaacaggacagagcagaaagaaggccagcagacctcaaagagttctggagctgaaatggacatcaaggttgtcccattctgtgtctggccaaaatgcctgggcctccacatccctgtctttggatgtgagtcaccactgaaaaggcatgaccttgggtgaggcttgaagaggctagcagctgaaggcatgtgctgacagcactcccagcacctggctgcagtccctcctggaagaggatgtgcctgcatgtctctgtgtcctcatgcccaagccattctgccagatgctttccatctagtagctcttgtcttcactgtgatccttaaagttagctaatatttgccctgccctttacatatgcagaaactcaggttcagagaggttaagtagcttgctaggtaaacagtgttggatacttaaatttgggtctgagtccaaagcctgtactctttggatttctctagagaatggatcaatcaaataagaaaagaagagtgcattgggagtcaggagactgaggtgtggtctggctctgctgctaacttcaagtttacactcaattgatcaagtcccttgatgacatggaactaaagtgacttttgaagaacatgagtacctcaaggatcttgctaaaatacagattctgatctagtaggtctgggatagggcctgagattttgcatttctaagaagctctcaggtgatgtctacactgctggcaaactgaaatctcagaagactccaatgtcttcttcagccctgaaagtaaatgagtctcaaaaatgtagggacagttcttccctacagaagaattccaattgataaacatagaagaaattaaggaaatacaaaattaccatcagaacacccctgtaataattgtggcaaataaaatccacagatgaatgctaaaattagaagctaaaaagttttaggagaaatacaatatttgcatagtatcaatgtatctcccccttaaatacgtattgattacaaagaaaaaataatgaggttagagcagcgacccccttaaccatgtgatcaaagtcaattatcaccagtaataaaacatattgtcatcatgttgacatatcgatatcacctccagatatgatgcactgagaaagacacatcacttctgtgtattcttatccagaacacacaacctcagtctaatcatgagagaatattagataaacccaaaataagggtcatgctacaaaataactgtccagaattttttgaaatgtccacatcctgagagacaaggaaaggctgaggaattctcatggattagaggagagcaaggagacataacagtataatgtgggatcttggattgaatcttggaacagaaaagtgatgttggtaaaacatgcaaatgtcagtagtttatagtactgtaccaatacttaattttgacaaatgtatcatgatgatgtaagattagatattaacttaagaggatgcttggtggaagataaatggtaactctgccctatttttgcaacttttctataagcctaaaattattcaaaaattaaaagttaaaataaaaatatttacagatatattcttcaaaatttttttcagacatattttatacattaacacactcatacaatagggtttatttagactttatatattgcatgatttgcaaataatgatgattttacttttaattttctactatttttacttcttttttcatcaaaaaaagtaaaactcaaacaattttgaattactgtagtggtcatagatatcttttggcattgctgaatgcaatgcaattctatttcatagaatgtcccttattttgggtttgtctaatattatctcatgatatcttcttgcagtgcaatatatcttatggttaaaaatgatgataactaacatttattgtacttactgcaaatcaggcactgtgctgaattgttttaagtgtcttacttcattgttctgcccaataaccctattattttcactattttacagaaaaggaaatagagaagtaaaataacttgctgaagttcacatagtaatttgtgaaaccaggatttgaaccaaggttacttaactttctaagaaagcttttagttacgctgtctataacactgtgtattcctctgaccaattgatttcagttagatttgctttaacattggaaggctaccgtcactgaaccagcattttatttcattttattttattttattttagattgagtctcactctgccacccagacaggagtgcagtggtgcaatgtcagctcggtgcaacctctgcttcctgggttcaagtgattcttatgcctcagcctcctgagtagctgggattataggcacctgccatcatgcctggctaatttttgtattttcagtaaagatggggtttcaccattctggccaggcttgttttgaactcctgacctcaagtgatccacctgccttggcctcccaaagtgctgggattacaggcatgagccactgcatcaggcctggatcagcattttaaagatggcgtcacaatggcaaagaaaccagtcagtgctttgtgatcctccgcccagtacaggcacagcagggcatccagagaagataggagtcccaagttgacacctgccacattcttggctcagaacagctgtggctgggaaggtccatgggccagggagcgggtgatgaaggacttcagcatctttatcagcgcccccccacacagacggcagctgcggcctagcccccaggcttcacttggcgtggacaacttgctaagtaaagtggggggtgggccacggctggctcctacctggacaggcctccagctaactccgggcttgcacagcaaatacaagaaaaaaagaaacagaaaaatcagttcatgtgccctttcctgacttctcctggcacctacagccctgactgcagagatggtcccgtggtcccaagacagaggctggagaagtgagtggagccaagaggcagaaagatctcagtaatttggaaaaaattcccaactgggtgcagctggctacaccttttcttccccaggtgacactcagggaggataacatgatctcataagattatttttggggtttccttgacttagagtttccattctttagtattctgcctggggcacagaaagtacttagtaaaccttgtaaaaatgattgatttacacttttctttgataaacatggacagacaatgaaggattttaactgaagacactttaagaaaagcagcagatcagatgggttgggggaagatgtgaagtgtttgggaaaatgcataaaacagaattaatttttaaaataaaaattgaagaacatctcaattagcaatctcaaggagagttgtgggggatattgtgccaaaaaagtaggctgctttgaaaaaggaaatttaaaatgtgattgctgaaggagccccactgatattggcaacaaataccaaataaacattgctaaaaattgaattagggatttagaaactaacttgaggggttttcacagaacatagaatgaaaatataaataggaattacaagatagaagtgactgagaggatagatttagtgtatccaacatatgtttattctcttcactctaattggaacagatggagaagggataatatttaaagatatataagagaaaatttacctaggctaaagaaagatttgaggttgctggtgaaaatttctcccaaacccatacaagatattgaaaaagacacatacatatacatatcctaataatatgttctaatttcatgagtaaagacataaattctatagatctctaaactaaaaaaaagatgggagagatcaacctaaagtgtcatcaaacagctcatttaccacactaattgcctgatgacaaaggagcaagattcaccaagattgtgaacctggattcctttgtgtagacaaactagtatttgtatagctacaaatgaaatatactttgagatgtgaaaatacttaggaaatattctgttaatgcataatttctgggaaaaaaaatgttcaaggacctataccactcattaaaacccatcagaatacagaacaaatacaagtgaaagatagtacatacgtgagacagttataagcattgaaagcagtaatctcacaggtaagccaaaatgtattttgaaactatgtattttgggaatacaactgtgaacaaaaaagtcctaataataagaggcataaattaataaaatcgtaacaatccagaactaaagtttcaaatggttttttaaaatatgttggatagaagtatttaatttttcagagcattatattgctctttattcttttttatagactcatattcctgtttcatggatgagctctctcttataagggtacaatattgctttgttgttgttgtttttgttagttttcttctgttccttaatatctctgtttctttcaagttctttttacctgcctgtttgttttggtctctatatttcctgttagaagctttcttcaactatctggtggtccttggctctgtggtcacatttaggaatgagatttagtctatcaattggtggagctcacttcattccgggggccctcgggtcttcatatctgtaggcgtttccccctgagctggttgttttcttcagagaagcctccagacttcttcctgtggatatgagcttgactgtgagtttgggagctggagaaggcttaagtcagcatggtgcaatttagtaatgtccgtcactcctcttctgtgcctggtgcctcttagtctggagcttcttttaaaaaaattcctctgagaataaactttctgttgattgctggggtgggtaagaggatgcgagagccagctttccctatatacaccttctcttatgtaggcttctctcgagttctagaactttctatgattctgtgatgtgaattggcttgtttcctgttgacttcctttttggggcactagtttttggtctttgcatttttttttaaaaccactgatctccatcaagcccattgttaaaaaatatatggattgtttcattgtcattatttcttgaattttcttgtccttgtgaaattactgcttttacagtgttcttctgctgtctggtcagcattggaaaaagagaatggagatgggcatatgtattccctttcctgtcgatgtatatccgtgaactttggggtaacatttccacaaaagtgtctccccctacaaaaaggaagtctcatagagattttggttggagttacattcaacccgtacattattttaaggggaaaaaagtctttctcatgtctagttttcccatctggggacatagatgtctctacattcagttcagagccctcttgtcagcatctgttttctttgtattggttgtgcagctgatcaagggacagtggagagtggaaagactttgaagaggctttgaagaaggacagaggtttccagcctgcctctccaagagctatgtggcatctgacaatttacttagttgtccagacgtcattttcctgaggtctgaccgaggaaaatggaattttttatatatattgttgaaatgctttgtatagtaaacatggagacagtaaccccacttgtggagttgtgagaatcagaaagagttcatgtgaagcatacaggattgagataatatttactattttattagaacaaggcacttctaggtacatgcctgtgtattttatgctttttgttgatgagataaatgagatgtttactttttgaagattgtaattttttttttggtagttgttagaaaagcaatttctctttggagatgtagccttaatcttgttactcaaattccatgtcagttctaatagtattttaaaattatttcttggatttgcaaataatgaatgactgcctccattttcttaaggttctataaatgtggtattgatttcctctatggcaaaatacttatttacaatagtcaacaatctttccaagtagtaatgtgtttacatgtctgtgtctaaaattttattaataatttctaacatttctgcattgtggtccagtgatgtggtttgtcaaatatattgatatatttgagcatgttccatttacaaggaagatgtacttcctgtttagtaggtacaagtttgatatgtactattaatttttccttactagttaaatatcagaagaccaatttcattcactcattcattcacctgctttatctgtcaaagacaaaataaattatggtaaaatctccccaggttagttgctatttgtcccctttgcatttctaggtcgtgaaagtttcctccattctccagtgaattatattctcgttgtagtaatcagtggttttcacgagcatttgtattgttcttctttacaccttaggtgtatttgtttgtgggggtaaatagtgtatattaggaaacattagtatgcatttgaaatgaaatttttgcccctagcatcctaaagaggaaatttcaagaaagccctgtattccagcacaggaagcaggaatgtcttaagccacactgcgctgtttctgctggagacatctccctgctctcaaaccttccttcactggtaggttctaagatgcatttttgcagagtgatgtttcttccatagtgaaataggtataattttctggaaaggttaggcattatctttttgttttatttttaaaattatgtaacatttgatatgtacagagaacatatgtaaacttagaactggaacattactgagactgcttcatctacccaggtgctcctccccaatcttgaactttgtatttagtgtaaccttctgtgaggggtacagactacaacgcaaggctgcagctcaggtgacttagggagcctgccttttgctttcaagtcatggagtaaattcatgcacctcctgaggaacatcctcaagtggctggctaacttgtagcacgactttcaaaataacaaactttgtgctttgctctaccaagtgagaccacatataggaaagttcttggaaattatgaaattgtacacacatgtaaatgtccttatgaagacacaatatgctgctattaaatttaacaactttctaaaatgtcctcaaagaaatacaattcttaaaaataaacaataaacagagaatataccaagagggctagaatacatggcaactggaagttggaggggaaaaaaggagactttggggacaaaaaaggttcataactcttcaaagatattttttggttaaaatccaagatgaaaataggaagaacaagtaaacaaaggaaaacaaattcatcttataaggaaattgagtttactaaaaattattataaagtctttacagaaatttgtattttactttggcaaaagaattttatatatatgtattattgaaatgctttgtatagtgaacacagggaggttgatttaaaacaggctatttgataaatttgctgagtgtgtacctctctactcagtttgtattaccgttttgacttttctctgcagcaattgtctctaagataataaaacctggcgagcatttatcatgggatacaatggacactgattttatgaaattgacttcagagaaacccttgtgctcacaggcatgctgagctcagagaggtcctgccaccttcccaggtccagtacaacaatcttacaggtgtaacagcagattcgtgaatgaacacaaaaggcctgtgctcacaaaggtcttttgttcatggacagaaccacttagactggcaacagtctacatttcactagtgtctttctttgttcgtttaaaacagtaaatccagaatgagtccagtgacagtaataaaggaagaaaattagcactgcagttaaatagttaagaacacttaactgggggaaataaattctaccaattctaaactgtgatgaaagatcaataattggaagttttttaaaaatgactttttaataaaattataaaaggaaaacaagacaaatatcttgtacatgaaagactaccatataaagaaaaacttattctttacaatactttaagattttggtgtgcattaagtgttcgtcagcttcatactcgcagagtctctgaggtatctgggacagagcaggcccccagtaggtgttcactgaattaagtgaatgaattatggggtgtgcccaagccagtctttcttctctcacttttcttaatggtcattattaatcaatggtatttctcttatcttagtacctctggaaagatcaaactagtgagtaaatgtagaattaatatgaattttgccacacataatgaaataaaattaatatttcagcgataacacaactgcaacctcaaaatgatgtgtatctatttctatgtttggcttgattcgtgtcagaaaagataacctgagatagtaggctgtcattagtgagtaaatgaattaacaagtgctaattaataatttcatgattcattcccaaaacctttttgtgccagtccttaatattgtaccagatgtttctggttctccatcttccaggcatgtggtagccctgttcaccttaggcgtggtcatgtgatctgcactggccagtggaataagtggaagtgatgtgtgttacctctaggttgaagtttatgaggccattcaccacattatcttcccacaccaaagtgatcaggaaagcatgggtcaagctgaagcttccatcagcatgagtttcttataagcaggccttccctacccacccagattagacatgtagtgtgaatgagaaaagaaagttttatcagattaagtcaatgagatttgaggggctatttgttaccacagcataatttagcctgtcctgactgacacatgttcattcgcaaacctgggctttgtgctaggcatagtggaagtcaatactaataaaatatgcatctttatttcaaaggaatttacattcaataggagaggcatgcgtataaaaaagtaccactcagactataagcccaaaatcaaacatttatgggacacattaaacattgtgggaagtgttgcttcaggtataatggcttgaattaatctttaggaaactccagagttttcatagttgaaaatgaattctttccagtagattctatcaaacatccaaaaaaatgttatcagtagattcattcctctggctgcattattcaagaccaaagtataaaaaaaaagtttttacatttgatatattaaatcatttctgagtagactattaaaataataattttgactgtaatattcagatacttacatgaaaaccattgctgtactcatagaataataaattactgtgtgaaattatgcagtgaattgtgctgtcacagggtttacatttataaggataaaattgatatattcttttctttctttttttgagacagggtctcactatgtcactcaacctggagtgcagtggtgcagtctcagctcactgcaacctctgtttcccaggcttaagagatcttcccaccttagcctactgagtagctggtactataggcacatgccaccaaacctggctaatttttctattttttgtagtgatggggtttcgccgcattgcccaggccggtcttaatctcctgagctcaagcggtgcacctgtcttggcctcccaaagtgctgggactataggcatgagccaccgtgcccagccaatacattattttcaaaatcatatttcctcacatccacagaaatgtagagcacagattttggccttagacagctctggtctgagtccttgctcccctaagatgaagagtgaagatgtagtctagtacagataactcatgtatcttagctttaatttccttatcaatacagtgaagtataatataaggcttttaagcttcttgtgagtattgattgagataattcaggaagcactttgtgcagtgttttatttggagtagtcactgaagaaatgtttactaaatagtactattacttactacattttctcttcttacaaccacattgcttccaaaaacttgtcaaggtaaaaggcaatacaggttgaccaatatgggtggttattatacataaaccataaaaattaagatattggggaaacacaccagttttccaattttctttgagattcttatattcatgattttgcttaagggaatgcattaaatttgtttcttgcatgtttattgtagaacttttagaaaacatagataagcaaaaaggatcaagtaataagaacttacccattatctcaagatctggacataactactgttaatactttggcatatatcctacaagcattttttcatgcatatctgtgggtgcatacaaaatatgtatgatatatatttctgaatgaaaaaggagctgggtaccgctttttaaaaactggatatttcatgaacacctttcatgtggatattctcctgcacaatcctttacaatgagggcatgtgccacacatctcccatctacccctccaatcccatcccctccccctttccatcttgcctgctccatcaggcagtcattcccacccagctacctctccctgggttccagttaccatccccttgagacaatggtaactgcaccatgctcgtggtttactttctttttgtgaatagttcaaaatactttaaaaaaccaattcaagtgtctcatctagttcctcctaggaccctgacttatgcaccaagagagaggttctcaaactatactgtgcatcagaatcacacagaaggtttgttaaaatacagattgctgggcatcactctccagaggttctgattgagtaggtgggaaagggccagataatttgcatttttaacaagttcccagatggtgctggagctgctggtctagggaccacagcctgagaactgctgcagtaaacattcacgccattgcatgaatctgacagtttatttatttatttatttatttatttattttaaagaggaattttttatttttcaatttttttacctttgttcattttctttttttttattattatactttaagttctagggtacatgtgcacaatgtgcaggtttgatatatatgtatacatgtgccatgttggtttgctgcacccatcaactcatcacttaccttaggtatttctcctaatgctatccttcccccagcccccaaccccccgacaggcccctgtgtgtgatgttccccaccctgtgtccaagtgatctcattggaatctgacagtttatttaaccatttatctcatatgcaaataactctggcttttatatccttttagctaaatctttatacattgatatattagtttccttaaaaaaaatttctaaaaagtagaacttgggcacaggtatatgcacatttttaaagtttctgagattgccaaattgtccatcagatagtttttatgaatttacaattctactaacacatacaaaaaacatttccttatatctttacaaatatatgaaagcatttcctatttccttgtatctttttttttttttttttttgagatggaatcttgctctgtcgcccaggctggagtgcagtggtggcgatctctgctcactgcaagctctgctcccaggttcatgcctttctcctgcctcagcctcccaagtagctgggactacaggtgcccaccaccacgcccggctaattttttgtattttcagtaaagacagattttcaccatgttagccaggatggtctcgatgtcctgacctcgtgatctgcccgcctcggcctctcaaagtgctgcgattacaggcgtgagccaccgcgcccagctgtatctttacaaatatagtacatacattattttcttgtttattaaaatcctcaccaattgataaatgagcaaattaaactattgtttcacttcacattattttgataactagtgagattaaacagttttgcagatacttttgtccctttgcacttactgatttgtgggtggcatcttcgtgatctttgcccatttttctatgggtctgtttgtcatttgttttataatttaagatatcctttatatgtaaagaattgccttttatacatattttcaatatttccccccaatttgttgtttgcctttggatttttgttaattttttttatgcaaatactttttttcattctttggtcagagctctcaatgcttcacttgtgttgttgtggtttagtcttgcggttagaaaaatgagagctgccttcacctccacttggattttctaatacttttatggttttctttctttttacatttcaatgctttgactttattttgataaaagagagatataatgttttccctccataaatgtcctagaggcacgcgttgagtaattcatccattctcccttggtttggaaatgtcacttttattcatcgcaaagtcttcaacgtatcagtgtttgtttttggagtttctttcgttccattgatctgtggttctggtccagaaccacactgttaattattgtcatttactatacttttaattcatctcattaattttctttttttcaaaatttctttagcaattatgatggcttacaaataaataaaatgttatttctcctatttctttcacaaaggccaataaaattgtatcaaatttcacctcagggacaagctcttttgttcatgagtttcagcacttctactgttcccgcccgctgtgctgtgccttttacagttgtcgtatttatttatttacttacttatttttaccttattcaatttactttccttatttaaattttataacatctctccatttctacaggttttttttttctccttctaaaccatcagctttcttgaagggatgttggccctgggtgtgtgagtcccctgggtcctgtggagtaaagcggggctgggacctttgaaaactcagagtccagggagtggtgacacacaggtggaactgtgtgtcatgactgattgggaatgaaggatgacaaaagaatctgaattagtgtcactttttcaagaggcctcccttttgcagttgcccattggtttctatgacatggtttttgagattgctttgggttttttttaatgctattggtacaattatttttcattatgttggttaatggtattcctattggtaatgttttagattcagtctgagaatgagaagagctggtggagggaagttagagatcccatagcaacctctctgaagtgtggccttgtcctgagagcagagggctcctaagcctctagatcccttgtgtaattacagtgcttggtgcacagcacagccctaggcagtatctgttgagtaaatgaatgtaaggattgtgtacagttcttaaatcagaaacagcaccagtagtgcatggtacagtgagacacattttctctggctctgactgagaaagatatttcaaatatcgctttcagataatgcagccttgtgagatagtgaactctccattcctggaagtattcaagctaaggttggagaggtgatgacggtttccattattttggagggtgaacttccaaggtctctgtatcactaaggtgattctgttactcctggctaattaagcttatgttttagatttttccttttcctttttctccagtccctaattcccatatacacttctctgcaaagtgtcttcattgtggtgtcacttgtgtgtatctgtgtcctctgtgctataactgcaatgtgacccgtttcccatgaatgtcctggggtggtgcttgagcttttcatgggcttgcgcctttcaccgcccactattgaacatgcagatgtgatggtggcatctgtcacttgctctgtgatcactcttctctcataactggtggaaggaaaaaaatgatttcacgttaatgaacaccataaacaattggatatccactttagtgaacatcaagatctatccattagtgtgtcttatcactctcagctactttttttcgtttccttgtgttttgtaaggaattgaaaaagaaagcaagatgatatttagaacttacttgttagtggatcagtttccttgggctgccgtaacaaattacgacaaacttgtggcttaaaacaatagaaatgtattctctcaaagttctagaggccagaagtctgagatccaggcattggcagggctgtactccctcacaaggctccagagcccaatcagtgcctttcctctcctagcttctgggggctccagttgtttggtggctatgactgcatcactccaacctccatctccatggtctgcctcctcttctctctgtctctcctctgcgtgtccctcacaaggacacttgtcattggatttaggatccacctgaataatccaggatgaacttttatctcaagatacttgactcaattacatatgcacccttttcccagataaggtcatattcacagttgccaggcattaggacatggacatatcttttggaggcccaccattcatcttattacaggcagtaagccaggagattccatagggagaaaaactgagtaagatctcacttggagatcctgggaatgccttttaatacagaggtagtggtccctataaacaaagctcccatactactgtaataataacattgtaataatagcagcagtaatttatggagcacttgttctgtgggaggcattgttctaactacctttacaagcatcatctgagctaatctctcaacaactctataaagaggcaactattgttactgttgttttacagatgaagaacatgagtcttagagaagtcaaagaagttgcctaaggtcacatgagcagtgagcagaggagttgcttacctttgttagactccaaatcctgtgtgactatgaaactcattaactgaaacaacccggcacctttggacctgtgcaggcaaaggcaagggagttgaccaggagcacacagcacagacgagaacagtcccaaagccttttgctgtatcccatctgtgcaaaccactcccaataaacaaacaaacacacaccaggcttcttgaacaatttctccccgttgccaagctattggaagaaaagaacgcaaatccgatcagattcattactagtttgaggattgcaaatacatttcaccttgggttggattgcgaaccatatatggaaaggacaccatgttgatcagtgtgcatgcacacacacatacacacccccactgtgtgcagtgacagaagtgctcattgtgtgccaaacaccacccttgttctgtccggggggaggtgctgcgaagactggggagatggaggcaggctctgcttctggctggattcctcaacccacctccctaggctccctgaccttccatttgaaggtccaggccaagtcgcagaccatatgccagttatccagggagcttgctacaagtcaccctcatgctcctggtcttccattcccagccgtcagccagaacccagattcagtgaccagttatgacccctgggaaagagttgccccaggttcgatcaactaagctcccccaaatggctctgctttaattcttcctaatcttgttcattccctccttgcctgctacatgtggctgccaggaaccctcacatcttgggtctaaccactgagaaatggtggagatgtttggatttgatggaaggatttggacaagcaaagatgagggtattgcaggtgactcgaacagttgagtacaactgtaaagaaggaagtcattgtcctgttctggcaagagcaagtaatttatttagtatttctagaatctcagtctaagagaaaaaactgggccttgggtgacaggaggtgggcaggagttcatcctgccctggctggcagatttcacacagggagaagagccagggcaggcagcgaagagagcggttggaggcccaggcttgggtggaggtagtgggaatgaaagggagccaatacatgggggaagtcaaagagcagctaaggaccaggctggggagaggaatggccaaagagaagtcagagttggcccgagtcatctggtctgcatgggctggagacagggaggcagcagagaaggcaggaggaggaagggctcagccattggcacttaatagttattatttttatgatttatttatgcctcaattactttcaaaaaattaaagcagctaataaaaagtgcatgaccaataaaatgttagcacatattgaaacagtgttttgcataagttgagttgaaggtgccagtggggcctcctgggggaagattcagcaacattgggaaatcaagaaggcaccagggtgtcctctggatcgagccttgagtggagggggctgctcggcatctgtgctgtgtgcccagactcccctcagtgcacccctcctgtgctccccatgggaagacacacccctccctccttcctttatcaggcctcctgagggtcaggcccctgcagggccagcagccatggcacagtccttggtgcatagtgggtgtgtttcagggccactggactggactttccttttggtgtggagggagggagaagcaatggagaaagaggcgaggacagagagcgccacatcctggggtcagatctccaggactgatggtgcatgtgaggcaagtgcagactcttccagaattagaaaggagatgccgagcatgcagccgcgcttccatggtgtatgattcagaatatttgtcctgcactctgcaggtcatcataacacaagctcattcatcagcgagtgtcttaagagtgaagagtcatggctgaaagcagaaggatgaatcagtggtttctaaaggttcctctctctctgagtcagggaatgcccctttgtctatatttgtaactgctcccttgtttcagaacatttccacttttggagaaatgccataagttagtctggcttgaaatttggtttcaatagtaaggccttctcaatccctaaatgatgaaaataataaaataatggaaataaaagggattttaattttccctggcatctatttcaagtattattacagtgcactgattgtttgtaatgtttattgaaatgtgtcaatttccctttttcttttcctctgttttcacttttgtgtccagagttggagatttccagaacacattggcagccatgtgcatacaatttccaactttagaacactgtgtatgaattatgttacatatcatgaggttagaaaataatgcaaaggacactgggcttttggcgggggggggtgtttgtgtgtgtgcacacaggtatgtgtgtgtgtttgaatacaacagcctctaatgacatcaaaggtcattaataacaattcaatcaattatccgtgaaggtgtaagatgcttactctgtggagtttagatagatttgagaacataagagtgattttatttttgctttttgtgcatttgaaaaggacacaactctcctatgcagagtttttggtttctggttgtatgatgctttttatccatacataggcgttgtgagcccactctaatcacttagatttttttttagtaatagtttccttacaatcaatcatgccagcagttgtgaaaatatgctataagctttatattaagacaaataaagttgagatgctgtgtctccagcagaaataacttcctttctatttcttatttcaatcagtcatgccagagatataaaaccatgccatcagccatttgcatgtgttgagattctgagtcccaatgcagatttaaaagaggactttccctctaactccttgcctattaatatactcattcactcattcaattattcaaccagtgtctatgagctcctgccgtggttcaagcacagctggagtggctaggtcacaaagatgaattggacatggttaaaagtcttccttcctctctggtgaagggatttttgtttgtttgtgtttttggttttttttgagacagagtttcactctttcgcccaggctggagtgaagtggtgctatctcagctcactgcaacctctgcctcctgggttcaagcaattctcttgcctcagcctcccaagtagctgggattacaggcacccaccaccacagccagctacttttgtatttttagtagagatggggttttgctatgttggccaggttggtcacgaactcctgacctcaggtgtgttccacctgccttggcctcccaaagtgctaagattataggcatgagccactgtgcctggcctggtgaaggagattgactttgaaatggtgagtgataagctagatgcctacccaagctataatagtattaggatctagaagcagcacccaggccagctgcagggtggagatggatgagggaaggctgacccctgagccaactcttattattactgatattttaagaaaagataggggttagtcacattacaagtaaaagcttttctttactaaaaagatgttttgtttatttcacattgtacagtatacattatccttcagattacattttattgatgattatagatgattcataacttgagaggaagtataataggaacctttgtccactaaagagtactaagacactgaggtgaatgctgcaaaccattctgttggtcaggtggaaagggcccatttgaattattgatcttaattaattaccagcacaggactgagggtggggccagggagggcagcacaggcccaggccatggctggtcatgggtgatgacaggtgctcctggagagctcagcaactgtggccgcatgtggatgaccccgtgtgccaggccccaggggacttcacctctcaggctgtaggcagccactgaatgacgcaaggcaggcaagaggcatgaccagagtgggatgtttccaaaagacccctttctgatgagatagtggattcacttcccattgctataacaacttatcacaaactttatggcctaaagcaacaggaatttattctctcagttctggaagccagaagtctcatattaggtatgagaagggccatgctcccttcaaaggccctagaggaggatcctcccctatcctcttccagctcctggtggtgcttgacctttctcggtttgtggccacataactccagcccttgccttcatctccacatggcctccttcccctatgtctctgtgtcttctcttctattcgaggaatactagtcattgcacttagagtccaccctaaatctagggtgattttatctcaagatccttgcttaatcacctctgcaaagagcctctttccaaataaagtcatattctgaagttctagaagggtggatatgaatttaagggatccactattcaacaactccagatggagggaggttggaagaggttcggaggatgaggtctagcaggacatgggaggacattacagaggaacctacaagaagtgaaagagaatgcataggtggcatgctggggcaggtttcaagaaatgtgtgttcaggaggaataagggaggaaagggtaaaaaagaaggatgagggattgtggcgtaaaagccaaaccttcacaaatttgctttccacccatgtaggtatcttctagcattaagttctagttcaagtaccaccctctctcctgtaatggctgacaaaagtgttactaggatcacctcatttaattcttaaacagtactattatgatcactcacactctaacacacaccctgttttaaagaggaaacaaattgaggcttggagaggttaggtggcttgctagtaaataaatgctggagctagaatttgaaccagacaaccatactgtaagcccagcactcctgaatactcacacatcacacatacccctcaccaacaccacaccaccaagtaaaattattcctcccatctctaaatccccatagcccgtggtgtacgcttcctttcggcatttgttcaattaccaactagtttatttttacaagtagatttgtgtacgtgtcgtgaggagagggactggacatgtttcacttttgcatgatgtccccaatatcttgcacctgcattgcacaaagatcatgtttatgagtgttgaatcatgggatgctatcttaattcagaccacaattatatgttcagcctgtgtgagagacagagagagagagacaaggaaacatacagctattatacagtatgtggtgtgcagggatacaggtgaacacacagagaccttgggatgcatctcatatgtatgtgccagctgggcatggtggctcacgcttgtaatctcaacaatttgggaagctgaagtgggaggaccccttgaggccaggagtttgagaccaacctgggcaacatactgagaccctatcttctcaaaatttttttttaaattagccaggcatgatggtgtgtgcctgaggtcccagctactcaggagactgaggtggagggatcacttgagcctaggattctgaggctgcagtaagctgtgattgtaccactacacttcagcctgggtgacacagcaaaaccctgtctccaaaataataataagaataataataatagtatgtattaatcaatagggataagagacacatacatagacagacacaaatcagtgaaggaggtgaacaggcaattcacagaggaagtaaaagtcaataagtatacgcaaggatactcagtttcacctgcaattagcactatgcatgttaaaacactgacaagatatgattctactccaaccagattggtgaaataaaacatttaaggggggcaggaaatttctcattgttcactatagaaagatatgcaccaaactgataataaactgaaatggtggcttctgagagcttgggtgaggggtgatttcttggaggactttacttttacctgtagtatttaaattgttttaccaggagaatatgttcatgcattacttgtatatttgaaattagtagggaaagaaatcaaatgctctccctcaatttacattactgggtaattacaagggatcatatgctattcattgctactcccatagctgaaagaggaccctgcattcccaattctgtcatctttccactacattttgatgataagttagatgagatccggaagttcaggaaatacctgtatggaggtgaaatgtaaagcctagagctgtgtttcccaggggctggacactttattgtcatgggggctgacctgcgcatggcagggtgtgacacagcatcctggcctctgcccaccagatgccagtagcaacccacccctcaccctttctactgtaaggtgtaacaaccaaaaatgtctccagacattgacggatacccctgggagatacacccttttccccattgagaaccactggtgtccagagaaagctcagaaaaagaacttaagcatcccaactcagcccaatttcacttctatgagagtaaaagtaatgggcttaatcatcatatgctagtactttgctcttgcctaaaatgaccagtgttataaactccttaacaaaaagtacattatattgcttttcttatctttgtatctttttttcttttcttttttttttttttttttgagacggagtctcgctgtcgcccaggctagagtacagtggcatgatctcggctcactgcaagcttcgcctcccgggttcacgccattctcctgcctcagcctcccgatctttgtatcttaaacacatctcatcttcctcctcatgatgccaattccccacccccaggagacaatcccctacctggtgaggctgattgattttgagcctctagggtagcacagagccacatgtatagagggtaagtgattactttgtctgccaacatcgtctttatcagaaccgctggacagatcatttaatgcaggggtccccaacccccgggccatggggctggtactgggccatggcctgttgggaactgggcctcacagcaggaggtgagcaagcattaccgcttgagctctgcctcctgtcagatcagtggtgacaagattctcataggagcacgaaccttattgtggactgcacatgcaagggatctaggttgtgggctcctcatgaggatctaatgcctgatgatctgttactgtatatattaacatgtaataatatatacatgtatatacattatatattacaatgtaataatagtagaaataaagtgcacaataaatgtaaagttcttgaatcatctcaaaatcatcctcccccacccctgtctgtggaaaaattgttttccacgaaacaggtccgtggtcccaaaaaggttggagaccgctggtttcacgggcacccttggctcccagtcacatatgagttgggactcttggttatggaagaaacccatgcaaattagcttaggccaaaagaaggggttagtcaccgtaaggttacagctcgtgaacagacccggaagggacagcacactctcactggcagaggtcagggtggctggaaaatagaggtagcaggggttgcatttgaaagggccttgtcaaaggtgcatggtatgtattaacagaaagcaaattcacagatcatccaggcctggaggatgggttgggaagtgagagtgagttcaggaaggacttattaagtggatgccagctatccagtgagggatgaaagtggcccagctgaccgtgcaaaggtggggatagagtgagtacatagaccccaaggaaatcagagttggctgagctgaaagtagggcggagcagcacatgtgcagggtgagtgtccttgcccacacagggaggaaaagaaaaacgtttgtgcaaaaggttaggcagccaggggaaacatgaatgaaaccagtgtccttgagctagagaaagtgacactgttgtggatcagtcgcattttcgcttccttacaaaagctcaacaggggcacactgtggttggtcagatgggagtgcacaagcatgaaaatccatggatttggtatttgagtcttctcaaattttaacttaaaaatgaaaacatgaaaataagtgtgtgagtttagaaaaagtaaaatgcttgactttcttatgcggaatgaagattgtgcctttacaatcaaggagttccatatattctgagtggtgggaaatgtgattccactaaatattgaactgtccaaagttactggtgaaacacaggcacatacacacacacacactcagatggttaagatttcgtgtgctgcttttataaaatctcattttttcacagttgtattttccagtccataagtctgctatttctttagttcttgctcaaagcttgaatgaacgttgaaaagtttgggcatcacacttttggtcagccactgcgtgctggccaggctccaaggaaagacgaccctcaggggctccaaggaaaggacaatgctcaggagctccatgttcgcaaacaagtgggaaacagcctcttaaaaaccatttcaatacaataggttttaacagatgcatgcagtacaatgaaaggaaaaaaggggcgtttagctcatatcctagaaaaatatctaagcctgagattttgaagaattgtctgagaatgataaactatcagacttgaaagtgtttaatacagaatcttcctcaatggattgggcatccttatcccttctccctgttgttggctacattgcaagaactcttttgcagtaagatggcacttgtagataataaaagtaaaatgcttttggggtctttcttttgacagtttttgagattagtttaatgttacttgtgtgctgtgagctttaagttttgatgagctgaatcttcaagcagataaaagatttttacagttgctcagtgttatgtagattgcttataggtacaaaaataaaataaaaatccaggcacagtggctcacatctgtaatcccagcactttgggaggctgaggcgggtggataacttgaggtctggcgttcaaaaccagcctggccaacgtgataagactctgtctctactaaaaatacaaaaaaaaaaaaattagccaggcacaatggtgggggtggggggatgtgtaatctcagctactcaggaggctaaggcacgagaatcacttgaacccaggaggtggaggttgcagtgagccgagattgcgccactgcactccagcctggtggacagggtgagactctgtctctagataaataaataaaataaaatacaaactacaactcttagtattttcactatggaaaaaatagaaaaaaattttctatttttagaaaatttttagtattttctaaaaatctctagaaatcctagagatttctaggatttttttttcaataaattctttcacacatgcccatgtttatatatcaaaatccatgtatacatctaggcagggttgaattatacccatgtttactaatttaactattactatatgcattaaatgtaatgtgttacctaatgtttaatgtcacttttataaacgtgctttacatgtgagaaaaataaacaaaaagacatgagacaattagggttcagccctttctgccctatgtcccttccccagaactcagaatcttcttaattggcacagatccctaaagggaacaaatgtgacaattagaagtctgccctcattataagaggctcacaggaatacctgatattgagaaatactcttattttctgagtggcattgtaagcgatccttggacacagcatgaaggactcgtgtgtaggagcaggcacacttttttactcaggatagaacaaacaagcagccagaaaaacacatacagctagaccatttcacattcgtttgcctttgtctagcccttgaatgtgcctttaagcacccactgtctgtgattcctaatcctgagtctctccaaagcagtggtttcacaccacattgacagaagcctccgcgttcagacacccaactccttaaagctaaagttcctctgattctctattttacatattctggttctatgtaaaatttaatttgaaactggggttctctggggaaaattaaaacaaagataacagatcccaggtttcagatgtatgataccattctagtcacatctgagtcacctgcaaatggtgactaaaaaagacgcagaggaaaattaaagggccactttgcatggctaagcagaggaagaatggttttgctatctggtttctggaaagaacggtttggtttccttggggccagtcaatagaaagtttgggtttctcctgagcatccagtgaccatgtgttgcctccagtggctgtccacccctccccatgtgttaggaaagccatctgattaaataaagttctctagggcagcagtccccaatattttgggcaccagggactggtctcatggaagacaatttttccacagagtccagggttggtttggggatgaaactgttccatctcagatcatcaggcattagttagattctcataaggagcatgcaacctagatccctctcatgcgcagttcacagtggggttcaccctcctatgagagtctaatgcagccactgatctgacaggaggcagagctcaggcagtaatgctttctcacctgcagctcacctcccgctgtgcagcccagttccaaacaggccaaggaccactattggtctatggtccaggatttggggacctcagctctggagtgtgaaagactcacagtatcacctccaccacccaggtgcctgttgttttaaatgattttttttttttttggagacagggtatcactctgttagtctggggtggggtggggtgatcaaagctcactgcagactacgactcctggctcatgtgatcctccccgtcagcttccctagtagctgggactacaggcatgcaccatcacacctggctaattttttaaaattttcttgtagagacaatgtcttgcttttttggccaggctgatcttgaactcctggcctcaagcagtcctcccaccttggccttcctacatgctgggattacaggcatgagccacagtgcctagccttaaatgagtcttgataggtggaatttcagagcatactgggaagatgtcctaaatatccctgctacataagaaatgggtttgtcccccagttcctgacaaagccccattttctgacacatcatcattgctactggaggatccatggagatcccttatgagggaggctggacccttatcagcctgggttttctgggtcatacatagtgggtctcagagccaaccagccaactttgcaaatgctgtttctttcttagtttctgcagctattctactccttgatccaaaggtgtgtcttgttctgcttactattgatgtcattcagagataaccctaattacttctctgcttccttgatcttctcccagtgtcaatccagatcaagaataattctctggactagcccctgagcgaggttcttgtcccctgggattgaatgagctcagatgagctccctggccaccacgtcaaagcttcactatttctctccttcgcactcaatcttagtagcttttttttctttccttatgaaaaaaggctgtcagctcacaataacaaaaacagctccagggaattttgtttcctttttgggggatgcacaaagtttttattttaaccaactcattgacacactagaaaacattgtcactatgtcccttcctttaccacgtgtggatagtaagcaaagaagaatggtttaaagtagttgacattttgctgtgcccctaacagcaactcagatggaatatacttactcatctctgttttgttctatttaaaattttattatataatatttgaacaaaaggaataggtatatgtatatatgaggcatattaataaaacaaacacatctcccaaactcaaggattagaacagctcgaggtacctatgggctccccaatcccatcctgctgatttcctgatatccttttcccaacattttattatgaaatttttctcttttttttaagttgaggtataagtttttgttggatttcatgttttttttttgatgtacaacacgatgtgtgtgtacacatacacatacacacacacacgcagtgatgtggctaaatcaagctgattaacattcattccctcgcacacttaccattttcttgtcatgagaacattcagaatccactctcagcaatttgtaagtatgtaatacattgttatagctacagtcaccatgttgtacaataggtctgaacttactactcttcttaagtgacattttgtatcctttgaccaacatcttttccatctcttattatgaaaatgtcccagcatacaggaaggttaaaagaattttgctgtgaacattgtcattatttttaaagttaaactttctctggggatttttgaagaccatttcatgaacatcagtgctgaccgagttaggagtttcccttacggtgcaggttgtgaatttccagatgaaagactctttataagcaccacaaataactgtcaaaaatgcaaccaatgtgaaggcaaatagagtaaatctaatctttgctagaccttgtccgtggatgtaagatgaagtgttttgggaaaagcatgaaacctttgtgtaacgaacaagtcatgaacgcacggagctaacgtttcactccaggcttgtgcaaactgcccgctttgataaatgcagccttcatgacggcttttggttgttctagtcacgttttccttctcacaggcgcacctcattttaacaccctctcggttctgccaccttttcaatacctaattatatctcaagtcttaaatttctcttacccaccagagcacatttcctcttaatgctcacagtgcctaatggccagctcagatttggataaccttttggataattcttctcagtgagccatgtagtgttttctcagcaaaatgtttacctattttgcaagtactacttgaggaggaaaaatggatttcctgatacagtagacagcatttgcaaataaaaagtggcaaatatgggcaatttatttggtaaataatggcaaacatttgtacccctggattcaattctggagtctgttactgtgtgtagaggactttgtggctgaactgtaaaagaaactctcaatgtctccttttgctctgccatatttttttcagaaagcagaaagaggcttcagtcagaaggagtatacaacagaacttcaataagaggtcgtgaagcagtcctcattttgtattttaggaccattttcattatgaatctgtgtctcagttaattttctgtggctataactgaacatctaagactgggtaatttataaagaaaaaaattctttatttgaatcctgtaggttgggaagcccaaagttgaggggcttcatctaatgagggccttcttactggtggggactctgcagaggcctgaggtggctggggccttcacacagtggggggctcacaatagatggtcaaactggctttataacagacccactcttgtgataactaaccccctccctcaataacccattaatccattaatctactaaatcataaataggttaacccatgcatgagggcagagtcctcttgacccaatcatctcccgaaggtctcacttctcaacactgctgcatggcggactaagtttccaacacattgacttttggggacacattcaaaccataccactatgtgatgttctagaataggggctctttctctagggactgggggcccctaggtctgagtttctagaagtttgtctaaaggccacctgcattgcaattacgaagcagtgcctgttcatttgcaggctcctgggcctcttcctgagatcccttagattactatttttgaggctggagtttgaaaatttgcattataacaagctctctggctattattttatgacattatagtttgagaactactcctctagagtttcagggttgaaaattgcctgaaattgtaggcaaacatttttgcgatttgcatataaactttttttttctatggcattcaacatatttggaactattactctagaaaacagaagcttggaccctggaagaatattgctctctcacacatttgggattaagtggctcagcttctgtggatgatgcccagagaggcttaatgagaactttgtaggaacaagtcccagcactcttctctctgatcattggtggtggggccttccacagtgaatctaccagtacacaggtctgatcatgtcacccttcattcaaaaaggtcatgtgttccctagtacctaatgaccagaatctcaggatctgagcctgatcccagggcagtctggactgagtttgtccctcatcaagtttttcagtgtattccccacagtcatctttcccgtgctgtcttccagccagggtttgagccagcatccttttattctccatgtattgtggttttaaaaaagactgtggattcagacaacttgaactctagccctggctctgctacttgtcacctgtgtgagtctaggcaagtgacttaatcactgtgagccttcatttcatccttaataatataagaaaaatagcacctacttcaacccgttttgtgaaggttaaatgagtctgtgtgaacatgaagcttagcacagcgtctggcacaaacactctggctggcacccttcctcccatctcaatgccttctccccttctctacaaatcccaaacctatccatctcctcctgaagtcttctcagttcttccctttactcccctacaggaggcactgtctccctcttctgaatactggtaacacattattttcatctttctttagcacttaaccaatcctggctttgtgaacttttcagacatctgtttgatctcccctgcccctgtgggcagggtttttttggtttggtttggtttttgagacagagtctcgctctgtcacccaggctggagtgcagtggcatgatcttgactcactgcaaactctgcctcctggattcaagcaattctgcttcagcctccaaagtagctggtactacaggtgcccaccaccatgcctgactaatttttgtattttagtagagacgaggtttcaccatgttgaccaggctggtctcaaactcctgaactcaaatgatctgcccgtcttggcctcccaaagtactgggattacaggcgtgagccaccgcacctggccagcagggttctatctaactatccccatggaccgagccacaagctttcttgcacataaaaggtgcaagactggaacttggttttaatgctattcatgatagacaggaatttagtgtaagatgtattccatgttacccaggaatttactggattaaataagccaccacttggtaacatgaaagaaagtgccaaatatcaagtgatcctccagcttggcctccagacagctttctgtaaagctgctgctttctatgatagctcacatgtgttgagctcctcaatgcttattaggcactggtcactgtgcagagcgctgcctcctcacactcgccccttgtcttgcgttctctcacatccctaatttaaaggtgagaaagtggaggctgaaagatggaaagaaacatgtccaaggtgccacagctagaggttgggcagcaagggggactgtatgctttgaatcactgtggttcactaccagagccgctgtggcgttcctcaactccagcccacttggaccttcaaggcttacaaagatcctttcattgtagattctttaaattaaggatggcttgttaaaatggaaagctcaattgcaaaagcagccttttcagaacacttcctgaaaatatcttttttatggagcatgatacctgattcatattcaccaagcactgaaaataatattgtctagagaaaaaagccttggagaatatcaactactttcttagaagtgccaggcccttcacaagtaacaccgaggaaaaagaaagcattttctccagaataattcatctcctttcctccgcagtgagaaaacatcaaagttgttgacactcaaaaggcacaggttcttgctttccgcagaaaataataaatgcaaaatagccaaaccaagatgctggagagagtggctgacagcagcacccaagggctccaacttgaatcgagctgtattatttgtgcggcatcaaggtgaagctgaagtctacagcattgagagcaaaggagactgtaatattaatagaagccccttactcccaagtctgagagttccaagtgtggtaaaaatggcaacctttgcttgaattatgccatgcttcagtagaagttctttgtgctcaagagctaggtgtggtactaaaattgaatggctttatattttactggtacctgaacgtcttaacatggctatgttcacccattaaaagaaataccattggttatttgggagaattgtatatttgctaagtttgttgttgttgttgttgttgttgttgtcgtttttgctgagacagcaaatacatctaaatgcaaggtttatactttttagttttaagaacaaatgactacaaagaagtgttttaaatatatttagtattgcttattgtctgtattaaatactgcagcatagaatatgactgccttaatttatacctatggaaagttagataacatccaaattttcccaatagtagcccatacctcagtgttatataaaagagcctaagggagagttcatttttgaaaacatgattgagatttatttatcaccatgtaaatcgaccctgaaaggtgcatttactagcgcagtaatttttataggtaaaatgaatgaaggttcaatttgaccagggatgttatacaggaacctttgctttatctgtggagggtaaaataatcagacatctccagcaaccttagatctgacaccctgatcctgtggcccccaaatcagtagaggagtttcacaactgcacttgccagtttacgttatctgcccttagcagagttggtaacattcccttttatgcaagatgcactttgcagagcctaaaagaacaaaagatggggacatcaccaacttatagcagaggttatgtgactgtttgagcctgctggtaatgaatgtttgcccaggattactttcactgcactgtggctcctgggacaagctgtgtaggtagagtcctctagctcccactccttttaatggttggagggtgcacaaaaaacttcaggattttgagtaatcaaattgacttatatttttattgctttctaagttttattttattattttatttttttatttgtatttttattttttttgagatggagtcttgctctgtcgcccaggctggagtgcagtggtgcgatctcggctcactgcaagctccacccactgggttcacgccattctcctgcctcagcctcctgagtagctgggactacaggtgcccgccaccacgcctggctaattttttgtatttttagtagagacggggtttcaccgtgttagccaggatggtctcgacctcctgacctcgtgatccacccgccttggcctcccaaagtgctgggattacgggcgtgagccaccgcgcctggccagttttattttatttttaatcgacacataataattatacatgtttatgaagtacaatgtgatgtctcagtacatgtgcacattgtttaatgaacaaatcagggtaattagcaaatccatcacctcaaacatatataatttctttgtagcaagaatatttagaatcctctcttgtaactattttgaaatatgcaatacattattgctaaccatagtcaccctactgtgcaatagaatagctgaacttattcctcctatctaactgtaactttgtaacacattggccgacctctcctcattcctctctctcccctaacctcctcagcctgtgataaccactattctactctcttcttctatgagatcaactttttaagattccacatatgagggagttcatgtggtatttgtctttctgtgcctggcttatttcacttaacataatgtcctccaggttcatccatgttgtggcaaatgacaccatttcattcttttttatggctgaatagtatttcattgtgtatatataccatactttatccattcatgtcttgatggatacttaggttgtttccatggcttggctgttgtgaatactgctgcaataaataagggagtgctgatctcttggacgtattgatttcatttcctttggataaatattcagcagtgggattgctggatcatatagtagttctattttaaattttttgaggaacctcaacactgttttccataatggctgtacaaatttacacttccaccaacattgcataagggtttctttttctccacaccccaccagcacttgttttcttttatctttttgataatagccattctaactggagtgagacagtatctcattttgatttgcatttctctgatgattggtgatgttgagtatttttttacatacttgttgactatttgtattcttttgagaaatgtctattcagatcttttgttcattttaaaattgaattatttgggttctttgctattgagttgtttgagttcctaatatattctggatattaactctttgtcagatgtatagtttcctaatattttctcatattgttttttgtttgtttgtttgtttttgttttgagatggagtctcactctgtcgcccaggctggagtgcagtggtgcgatctccactcactgcaagctccacctcctgggttcatgccattctcgtgcctcagcctcccgagtagctgggactacaggtgcccaccacgcccggctaattttttgtatttttagtagaaatggggtttcaccatgttagccaggaaggtctcgatctcctgacctcgtgatctacctgccttggcctcccaaagtgctgggattacaggcgtgagccaccgcgccaggcctctcatattctttaagttctctcttaactctgttgattatttcatttgctgtgtggaagtgttttcatttgatatatttccacttgtctatttttacatttgttgcctgtgctttcaatgtcttatttaagaaagtatttaaccagtccaatgtcatgaaacatttccccaatgttttcttctagaagtttcatagtttctggtcttatatttaagtctttaatccattttgagttgattttggtatatggtgagaggtaagtgttaagtttcattcttctgcctgtggacatccagttttcccagccccatttactgaaaagattgtcctttccccaatgtgtgtttttggtcccttcacagaaaaatcagttggctgtagatgtgtggatttatttctgggctgtctattttgttccattggtctacatgtctgtttttatgccagtaccatgctgtcttggttactatagctttgcagtatattttgaagccaagtggtatgatgcctccaactttgttcttttttctcaagattgctttgcctatttgaggccttttgtggtttcatacaaattttaggatttttttctatttatgtgacaaatgacattggtattcattggtattttgatagggagggtattcaatctgtagatcacttttggtagtatgatcacttttggtagtatgatcattttcacaatattaattcttccagtcaatgaacatgggatatctttccatgtatttgtgtcctcttcaatttctttcatcagagttttatggttttaaatgtagagatctttcacttccttggttaaatttttcctagaaatagatttttttttggtagctattttaaatggtattgttttcttgattactttttcagatagttcactattagcacatagaagtactactgacttttatatgttgatttttatcactatatctttattttaatgcaagtttttatcaaatatttttgagcatctcctaagcgcagtgctctgtgagggtaagtacagagttgtggggaaaaaggcatataagatatagtcttttgtgtaggtacacatctaccatttgcacttgacctcactacttaggttataactgagttacagtaacatcagtctcataaacctttcccctgtgagaacagctcttccacttctaccacaagtctcacttccctgtcgacctggtaggtggagccaggctggagaatagatacctggttttcctcccttattcctagttttcctgctcctgcctgcaggtaaatataatgcaaacatcctccgccctcaatacacaatgtagactcattattaagaaaagtaatttatctactatagtcagcatgagttagtgtcattggtatgctggtaaacatttaaaacctgacaatttttgaaaaaagaagaatatatatacacatacacttatttaaaaatattgctgatataaaggatgtgtagcacacagtttaaaaataataaaatataaaatcttctttatataaattctgtgaagtcaattgattttcatacaatgtttaccttgatttttgccaaatttctgactatccatagtcaatctatggttacaactgatgaacgagtataattcaaattgaatgttgtttgatactttcatttatcttaactaataagacatatgttggaacttcacttattcttctggaatgtgagtaactattttgctaaggatagaatttttctgaatactggaagaatatatcatcaatgttttttgctatttacagtataacaagtgtaggcacacttttaagtttaatctatgctattaacattttcttcatcactgttttaagactacacaatttaaaaaaaaaatcaagatgtgatttgtagcatttgccaattcttttattattattattatttttttttttgagacaaagtctcgctctgttgcccaggctggattgcagtggctagatcttggctcactgcaagctccacctcctgagttcacgccattctcctgcctcagcctcctgagtagctgggactacaggtgcccaccaccatgcctggctaattttttgtatttttagtagagactgggtttcactgtgttagccaggatgatctcgatctcctgacctcgtgatccgcccgcctcggcttcccaaagtgctgggattacaggcgtgagccaccgccctgccaattcttacattatattctcaccatgtccaatttcaagctatcagtgtgatgctaccgaacactgagttgggcagagatgcccagtagcagaccattatatagctgtgatactatgaaatatgtatttggtcttcatcccaatttcctgaggtagagtttctaaaatccttggaatctctggaataataagagtgctttttgtatgctaaagaaatggctggtggctggacgtccctagatagcttcaggataggggctggtcataagaaagaacattagaggattgggactttcagcattacccctcaacttctggggagcagagacgggctaaaggttgagttgatcaccaatggccaatgatttaaccaatcatgcctgtatgcatctgttctcacattgctgtaaagaaatatctgagactgggtaatttacaaagagaagaggtttagttggctcatggttctgcaggctgttcaggaaacacgatgctggcatctgcttggggaggcctcagaaaacttacagtgatagcggaaggtgaaggggaagcaggcaggtcttacatggctggagcaagaggaacagatgaggggaggtgccacacacccttaaacaatgagatctcaggagaattcactcactatacagtaccaagggagcatggtgttgaaccattagaaccacccccatgatccagtcacccccaccccctgccaggccccacctccaacattggggattacactttaacatgaaatttgtgtggggatgcagatgcaaaccctatcaatgcccgtgtagtgaagtttccattaaaaacccaaaaggacagggatggtgggggggaaggggctggcttcctgatggctgaacacatggggagattcctgaagggtagcacacctagagagggcatggaaagtccactccccatgccccagagcttgctctgtgtgtctcctccatctagctgttcacctgtatcatctgcaatatcctttacaataaactggtaaacgtaagtaaagtgtttcactgagttctgtaagctcctccagcaaattaatcaaactcgaggggtaaatagtcggaactgtctcaattataggtgacagcctgcttcttgcaactggcatctgaagtggggccaatcttgtgggactgagccgtcaacctgtgagatctgatgctatctccaggtagagtgtcagaattgaatcggaggacacccagctagtgtttgctagagaatcccctgaaagactgcttggtggggaaaaatccgcacacattttggtggccaagggtcacagaagtattctttgctgattattgtatgagagtaggagaaagcattttggcttggtttttttctatatttaatagtagaatttccatcatataaattcagtacacacagaataacttcaaaagcacagatgactgtataatatagtaaaatcattaggatagaatgagttttgagtatttgttacattttcctttaatataatttaattttaagttatataatttaatttgtaataatgatttcatggttttatttaacaattggcatgcaaactttctgaaaatttaacaatcttctctcacaaggcagtgtcggctggctccagcaagctgggatgggatatgggttaggttgtatgttgaagaacccttagatgtattgcaggagaggatgggcctatactactcagtaggtcctggataacaggtggtttccagggctcacttgctcaaagatcaagagcaagataatcgtcatagagcttctttgggaatttcatgcttagaggtcacctctcttaaacaggaggattccattagaacacaccttctctgattcatttctaacccctacatgatttatttgctaatttataaaacatagctctagcagtttgtgctcattatctgtttgtgctttataaattacctaaaagttagtagcttaaagtaactagtacacacctacaccacataacaatgtttcagtgaaagatgaaccttgtgtatgctagtggtcccattaagattatgataccatggctgggcgcagtggctcacggctataatcccagcactttgggaggccgaggcggatggatcacgaggtcaggagattgagaccatcctggctaacacggtgaaaccccgtctttactaaaaatacaaaaaaatttacccaggcttggtggagggcgcctgtagtcccagctactcgggaggctgaggcaggagaatggcatgaacctggaaggcagagcttgcagtgagcagggattgcaccaccgcactccagcctgggtgacagagcgagactccgtctcaaaaaaaaaaaaaaaaaaaaggattatcataccataatttgactgtgccttttgtacatttagatatgcttagatgcacaaatacttaccattgcattacaattgcctgcagtattcagaacagtaacatgctgtgcaggttttcagcctagaagcaataggtcatataggttatataatacagcctaggtgtgtcttaggctgaaccatctaggtttgtttaagtacactctgggatgttcacacaacgatgcatttctcaggacatatcccagcacatattaagtgacatgaatgtattgatgattttctcacagtttctgagggcaggtgtctagagtggcttatctggaaggctctgcctcagtctctcatgaggttgcagtcaagacgtcagtcaaaactacaatgtctgagggcttgactggtctgcagggtctgctcctatgaggactcaccacatggttgttttccttgctacctggacctctccatagggctgctcagttgccctcacaacatggcagatgcctcttccagagcaaatgatcacagaagagagcaagtcagaagtcatgatgtcttttaagacctggtcccagaagtcgcacatcacttctactctattctcttcactagaagtgagtcactaagtgcagcctttcaagtggaggaaattgggctccacctgctgaaggtagtgtcaaagaatctgtggacgtattttgaaccaccacataccataattttgggtaacttaactcatttttgttattttgattcgtgctttcaaattttagggtttttattttactttttaatagttcattatattatctatattttattcttttagatactattaccttttactcattctaaaatcgtttttgtgacttctattactaatattcttatgttgtttgtgtgaaattttgattttatgtgattgaatttgggcttttcctttatattataattttcttttctatattaaccgtgataatctttaaatagttggatttctttccaactccttcaagcttgcctttcttgtctattagtgtgccttctcacccaattcgaccaaataggttctgataattatccgattcttttggtaattataggtgagctccaacatttagaggtagatgggagctctatatctcctaccccaaaactacactaaaaagtgatatactacagcacaagtcagtcccagactgaattttttcacatgtgcaaccatctgttaccaagcaggcactaaatggctgaatgtcccatcagtggactccgtgaagaccccactgctgcctttttggcaccgtagcacataccttgtaggaaggactaattccagcacaaacataacaaatgtcctgatgacaggagtggcttaccttgtgagggatgttctctgggcacagggcagaatgtggttccagactgaggatgtctcttcaaagggattgttttcgtggctcaccagtttcttcagccccattcattccaagttggagatgcctgtacaatactctggttaatgaaaagttatttccaaatcccacagatcaactagcaatcttctctgatacagatttagattgaggtttttgaaggaaagccacattctgaactgaagactcctgtaggagctaaataactgctcctatgattggtgtgtggggattttaaatcaaggaaattcagtgttatttacccaacactaggttagtggttaaactcaagcacaccatctacacgaaggcattttaaagctaactcctgacagatggtgtgcttgagtttaatcactaacctagggctgtaccctctaagtgagaatactgtctcggtcagcactgactaggttctgctgtgagaaaccccagaatcacaggcaactaaaatgttggaggtgtttccttgctggctcatagctgacacctctgagattgttgggccaaagggaaattgagggctctgaggagttcaataaaaattaaatgtactggctggaaatgacacatgttactttgggtcacaattcattggccagatgagactcctgcccccgtgccatatctggccagaaagagcaatcctgcaagtggctggagggggaagaactggggatacttggccaacagtacagtgccttctgctaacaccctcctgccatcttgtcattggggttagaaacaattcatgaaaagtcatcggggaatatcaattacaattataggactggttcttttaaacagcctacatttaagccaatccgtggattcctagaagctgtcttccctctgcaatacatcctgagtgatgcccacagggtgaggcgcactcggctaatcttacactcgttcgcttcctttctcacggttgagttgaatgcttacagaggcagttgtgtgtttgcccaagcttgtttatgccagtaatacttacttttacaatgacataatttagttaaatagtacataatattataaaatataaggacagaaagaaagaacaaatctcttttaaaattgctactgaaataggaactgaataggccatatcataactactcaaattttaatgtgcacacaaaccacccagagagcttgttaaggggcagattctgattcagtaggtgagggtggggcctgagacttcgcatttctaattagctctcaggcgatagggacattgctggtccacagattacacagtgaatagcaaaatatgagactgttacaaaagcttattggaaaatcattaaaatacaaaaagagattgtgtgcaggtcgctttgctagtactttaagttattcaagagctcactccactttaaaaaacctaaatctggatatcatgaagctgcttcttctcataaagataatgtgaataccattcagtaaaacacattaaaaaaaagaaagagagaaaacttgaccttattatgaaaaataaatacatggggttaaaagtaaaagtttctggaggcattttattgtttttaagtgattcattacataagaaaactttttgcactggagaagagtttctaccatattgtattaaatgcataattaccaatggaagttgataacaagactcttggcaattaaccaaactttaagtagatacgtctcataaaatgtcagtcagggtcacctcactgcccagttccaaaagtgcctggtatatagaatacagtagcagacctgcaacatattttgaatctcggggctttttgtgtattgttttgttttctaagaaggggaaggttagtaacattcaatatttcaggagccaatattgggagagagaaaaacttactgagtgttttcaaggcaaataaatgctctttacttctgacatttccttcacacacccctggtcacagctgtggaaatttttgttgttgttgttgttgtttgtttgctttgtttgtttgttttttgagacggagtcatgctctgtcgcccaggctggagtgcagtggcatgatctcggcccactgcaacctccacctcctgggttcaagtgattctcctgcctcagcctcctgagtagctaggattacaggcgtgtaccaccacgcctggctaatttttgtgtttttagtagagatggggttttaccatgttggtcaggctggtcttgaactcctgacctcatgatccgcccaccttggcctcccaaagtgctggggttacaggcgtgagcccctgcgcctggccagaaatgtgttttatagtcacagtagggaaggggagggataatgtatttcttcattgtacaactaaatcctgataagcttgagggattttcaaaggaaaaatgacaatgaaatacattgatacagtggagccatggattgagaactatttctcataatgtattcagttgtccggtgatgtatttgtggaataatttcagtcctcatctttctatgctctctccaaggaccagagcttgctgctaaaggaaagattgagaaatgctctaaccatcccaaatggggcagtcttaaggtttccaaaaaacccatctgcacacagaccctcttcccagaatgctctccctccatgttccaaactcatctcctcccttattcaaggcctctaagttcataagggattattctgtgcaaactattcctccctgatttagacccagtcttgtttctggctgctaataggtcactgcatgacttcatatcaaatcccaaactggagtctgtctcaagtattaataccattctgtgaaagacaagaatattttcccccttccataagctgtgtagggaaggaccttggtgcaagtacccaccaagcaagctatcccagaaatcacaaaacaaaaaggctcacagaccaaattaagatgcttgaatcccacagtttactaaatcaatataaaatgcaaacagtggaaaactgcggagtagattaacactcttgggttatatatatatatgcaagaggaaggcacacactacctaaatcctgggctagtcaagttcatgtgtcctgtctgtctgccataggagccttctccagtgatggtgtcattaagaggccagagttgagtttgagcaagagtacccccagactagaagatacctgaggccattgacatacactagctctattacagcgatgtagccagcctatagctgtagcttgccagttagctgctaaactgccatgctttctaattacacttcttggacaaaacacatgcagagccagaatggggacatgcgaggtgtcaccagtggatagtcaatgtcaggcgtggcccagctgtcaccatgtgtgtgcttataacttgggtctatccatccttttctagctctaagtaacacatttttgccatcatatattccattttctatttttagcctttcaggtttctaatttactgtcagcatttagcatatatgatcaattctgcccatgtcttgcaagccatttgcttactcattctcgggacttaacacagactacaaggttctcctgtggcatacaaaccacttgctaactcactatgtatgcttttacattgcttaagtatttcatccacttaatttgcttttcttgtcttcttcagcagaattgaataatctcaaataatacagcaaactcatattatgcagtagaataggaggactgatggaaaacacaaggtgcaaaatacatttttgatggcttagccaataattggtgctcctttaaaaagtggcacattactcatttagaagaaataagacctagttgttgtttttttcttttttttttttgagatggagtctcactcttgtcgcctagactggagtgcaatggcatgatcttggctcactgcaacctccgcctcctgggttcaagcgattctcctgcctcagcctcctgagtagctgggattacaggcatctgccaccacacccggctaatttttgtatttttgtagagatggggtttcaccatattggccaggctggtctcaaactcctgacctcaggtgatccacccgccttggcttcccaaagtgctgcgattacaggcgtgagccaccacgcctggcaagacctagtattaatagatcagtagggtgactcattaacattaattggttatacatttcaaaatagctagtagagaataacttgaatgttcctggcataaagaaaagataaatatttaagttgatggatattccagttaccctaatttgattatatgaatgtgccaaattattattactttcacaccaacctaatatgacatgtacattgagtatacatatatctaatatgtatcaataaaaatgactaaatacgtaaagataaacttcataaaaagaaaaaagtggtacactattgaagattctttttaaataaattcaattaaatctcctaattatattaataacttacgcgtgcttattttaagacattggaaaatatagaaaagtataaagaaaaaaattgtccttaatgctaccagctggtgacaatcaatgtcaacattttggtatactttattttttagatcttattttaatagatatctttccccatctgttaaggttgtacatacatttctatatccttactgtcacagggcgaaccccaaaattgggattcagcctggaaagccacctgggctcttggctttacacaggaaggacttcaagagccggctcacagggtaaagtgaaagcaagttttttaagaaagtaaagtcataaaagggtggctactccataggcagagcagccccaagggctgctggctggctgtttttatggctatttcttgattatatgctaaatgatggttgcattattcatgacctttccaggaaagggaatgggaattctggaactgatggtccctccccctttcacaccatataaggtaacttctggacattgctatggcatttgtaaactgtcatgatgctggtaagagtgtcttttagcatgctaatgcattataattagtgaataatgagcagtgaggactactagaatttgcatttgtagccatcttggttttggcaggttttggccggctcctttactgcgtcctgtttcatcagcaggatcttcgtgacctgtatcttgagaaaccagtcctgccgaactcctatctcatgcccttttcccaaaatattatatgtattatatcttcctatcttacttcacgtgttttctttttttttgagatggaaacttgctctgtcgcccaggctggagtgcaatggtgcaatcttggctcactgcaccctctgtctccggggttcaaacaattctcctgcctcagcctcctaagtagctgggattaaaggtgcccaccaccacgcccagctaatttttatatttttagtagagacggggtttcaccatcttggccaggctggtcttgaactcctgacctcaagtgatccacccgactcagcctcccaaattgctgggattataagcatgagccaccacacccggccacttgatgtgttttctatctagtgggagactgcctttccctgccactggctgtgaccaattattattttagagagacagttaacaactgcctgaccttttgcctgatggctacaggttgacattcctgggtggcctctcctgccttgcttgtgtctgcctaactatgtactctaacagaaagacctagtaagggaaggagattctctgcagattgtgaatgccccccacaagagacagctttgcagggccatttcaaaatatgtcaaaaaagatattttggagtaaaatgctttgattcgcttcagcactggctatgtgttatgtgatgctatgcaaacatgtttggaatttggcatcttattgttgcaaagagtctgttctgtcaatcttgggatctcttttaatgttaatgctggtcagtggtgcctgaactccaaagggaggagggtatcatgaggcgtgtcccatatggcctgaactggtttttcaggtttctttgggtcctcttggccaagaggagggtctgttcagtcagttgagtggcttggaattctatttttttggtttataagaccatggtaatttctgtatttagtcagcatttaatcactaaaacttaatcttagtagacattttttaaaatgctgaactaaagtgagattttctcttccttaaaaatctgggatgctcgttcattctctgatcagttcagatgcagtgtatgaagaaccataaagctagtgttacagctcttttagaatttgtctagcaggttttccagtctttaccagaaagccactcctaccccaaaaaaagaaagaaaaaccataagcctgtgtgtgtgctccctggacccttcttttccgcaaaaccttgctgaaatcagagacaaggaccttcttttcttggctagtccctgccctgtcctttctctgaaatcctttaagatggccaagctctgtggattcaaccaggaaaatgcttcaacagagggggaaggagatgctctccacccttttttttttttttgagatggagtctcactctgtcgcccaggctggagtgcaatggcacgatctcggctcactgcaccctctgcctcctgggttcaagcaattctcctgcctcagcctcccaagtagctgggattacaggcgcctgcccccacacctggctactttttgtatttttagtagagacagggtttcaccacgttggtcagtctggtgtcgaactcctgacctcaggtaatccgcccttcttggcctcccaaagtgctgggattacaggcatgagcgcccgctacctcatctcaggcaggtcaggtgaaggtttctctgaaggactgttttttaatgagggagatttttttcccaagactttggcaatcattgtgttccccttacctactgccacaagtatgatttactttccacatagaaggattcccagatcctaagaatgacttaatagcaatagataactgtcacatattgctaattctatttatttcccaagaaaaaagaaagaagtgttaatggtatggtgttcattactggggcttcagtcttaaaaggggaatataaacttcgcaaagctgtgcactgcactgtgtgtgaggtcgcacagtctgggaggccctgtgccaccttgtcaggcttcctaaaggagctctcaactcccatccacacacaaaggcatctcctgggggccaggccctgggcaaggctggctgcctcaggaagttgcccacacagccacagggcggcagatctgcctggtaacttgaacgaccagtagccctccctgcttggtagccacgcctcttatgttactgccccagaaagcagagcccatgggcatcatcacttccatctcttaggctggcaccattgatactggtgggctggggtcggtccccaaataccagtaggacctggactcaagccgatgtccagacttttgacaccattgtgagaaggaacttgaggatgaatccaaaaatcatgaaagttgggagatttatttgcaaaacaaaattacatactcaagaaaaggaagtgcaggcatattaaagagagagtttgccccatggatttgggctgctacctttatggatttctttaaccaaggggtggaatactcatgaaaattcctggaagaaggtagaaatttctcagaactgtggtgccacccatttttacaccaaatataggtattcccagaactgtcacggggtggtgggtgtgtgattgaggatgttaatgagcgtataatgaggttctaggagaaacccaggccaaatccagcaccacgttgggtccagtcggtcttagccagcttggtccacaccctggtttttcaggattttataagctcatagcttctgcagctatttcaggtgtctttttgctagtcatgtgaaactgccgcctggaattttccaatctcctgcaaccactttgtattattcttatcttacctccagtgctatagtgggtgaaatccctcctatgactgactgttctccttcctctccaatactgttaggagatatgtgtttgtttcttaattttgacacagtatgggattttgatattttggtattctaaagaatttagtattttgcaggtattttaatatataaaaaggtaggcactgcctctatctttacttgattttatctgaacccaaataggtcttattgtttctaagacaactatttcaatcagtgtctagggtttattgcattcaattgttccgttttgcataagtgaaccatgctttgatgacaaacagccagcacctctgtgatgatctcattcagcgttggagtccagggtagtttgccacaggtcccggctctcagagggtaactgcatatgcatgaatctcttgcctcattgatttaatgccctcaggatgagtgcagtgggccactctctctgcacacttctgacctgagcgggagatgggccgggctccagagagaggctctaggagtgtgttttgatagttttttccacaatatgcccagctacaaagtcagctcagcaagtttttaagtaagtttggagttacattacatacctttatttattaaatttaaatctatggtggttttaaaacatatgaagaataatttgtaatattttacattcatgtgcatcagaaagtgagaaaaaattaaactatgttttaaattgagttttattttccccctgcccttgagccatttttttaagtatatacatggtagtgtgtgcatcatattcatttcataaaagcaccgattgttgtaggagatcagtgagctaaaggacgggcacatatctctcaaatgcattcatattatccaataaattaaattcttaaagaaaagaaaaaagacctattaattggaacacaaaagcccccatccctggtcccagtgcacctttctctaaggtgatgtaatccaaaagagaatttatagaaaaaaatagtttttgttctgtgtacactcaagaaaattaggaaagatgaggaaaaaaaaaggaaaatctcttcttttgggggtatgggtgggggtcacagtcttaccatggtaggaactcactcattaagtggaagagggagcggaataccccatcccacccccacacactcacacagagaaacagcttttccagataatgactttatgcaaatcagagaaaggctccgctgccctagaccaccttcctgctgcctgtggagaggcattgattagccccctgcaaagcgatgcgtcctgggtggacagatgcccaggagcgtgcacagtggcccaaggagagggtgggacccacctcttggcacagagcgatcactgcctctgctaaataaccttctacagctcccccagccctgagcgatttctccaaactgagcccctaaatctgtatcagtcactgctgcatgaagaacaggtgtggctcatggtaagacaaggatcagcaggactctgcccactgggagaggagcggtgaggtgagggggatgtcagtttgctgggcaggtgggggactctgacgaacacagaccgcttccaggactggcaacataaccgtggccccagtgacaaaggaaaatgcgggacagcttgtgcaaaaattattaaggatttcaagatggcgacagcagagcattaaacccagcacagggttcccagtgaaggcgttggttcacaggcccctggagctggcactgggcccctgattccctgtcagctgtggctgccccgttcagtctgagcaatgacaacccacatctttcctgccattgcccctaggtcatctcgaccctcaacgcacacactccaacaacctacacatacacacaccatagtcacacaccccacacacacactctcttacacaccacacactcacattcacacactcaccctacacatacccactatagtcacacaccccacactctctcacactcatactcacgcacaccccacattcacacacacagcacacacattcacacgctcaccctatacacacccaccatagtcgcacatcccacagtctctcacacacccactcacacacaccccacactcacacaccacacacattcgcacactcaccctacactgtcacttacacacacatcctacatacactcatcatagtcacacaccccacgctctcacacacacgtcttacacacactcatcagtcacacacccatactctcttacactcatactcacattcacacactcacccaccctaacacgtacccaccatagtcacaccccacactctctcctacactcaaacaccatagtcacacaccacagacaccacactcacactccacactctcacacacccttcacttacacacattcacataccacacacaccatacacaccccacagtcatacacactcattcacacaccatagtcacacaccccacactctatctcacacacacccccacactcacacacacaccacacacaccatacatacaccccccacaatacagatttgcacactctcacaccccacactctcacacactatagatttgcacactctctcacacacactccacactcacgtgcacacacacatcctcgcacacccgcagtcctcctgagatccctttgggctggccatgttcttctcccaggagaactggtgaagtaggaagcaccctctccagcgttctcatcatcaagagctagctggctattgttcctctgaaggctctcacagcatgcttcctaccttgtatttgttcaataacgctaagctaaaccatttgccttcccagttccaaagcctggtatgaccacaaatccgatataagagagtccaaatatcctgcctccacacggagaaccctccagaccctcattgcacactctctctctccacggttttctccaggcaagctgagagctcccgctcagggaacagcctctgtgcttcccttctgcacgcctggtctcttatgattacagtttgcctgcctgtctttagctctccgttcaactcacgagttttgcacttttaatgttgacattttaaaagtgtgttttataagtctaatcagtagcaaagtatattatctgtatttacttcagtattgacattttacaataaagttatctgttcaagaatatatatcctatggaatctgaatattatagactttgagagtttccatgatcaatttataaaatacatgtaaagcttttcattaacagttgaatatttacattattcttttccccctggaacttacatttctatttcaccaaccccgctgcattttatcctaatatagtataaccctctggcaggaagtcttactcatcactatgtcatatgtcctgtcaacaaaaataagtacatagtgggaattagatttttttaattctttgtaagcatcgagtttttatatatgagaaatatctagattaatatattttacagttgtgattcatacacaattgattacacatgttatatatttttagtagaaaaaaatatagaattttatccaaaatgtatctcttactgagtaggaaggggcttttatttctctcgtgttccagtacccacgaatgagtgctatttcctgttaaaatgagacagttttggcataaattctatatatacacgtttggtttgttgttgtggttgttttttaatttcactgttgtaagtactgagggcaattttaagatttaattctgtttgtatttaggggcatggttatagtaataatctgtgaataagtacataggaatggaagaagtcactaagcgtcgctcaatttttataaatccttttagggctcatgccaaaaatcacagaaaattacttttaaggtcctattatctgacaatttgattaggttctcctctattttttaaaagtactagaaaccagttaactttcaaacggatttgattggcccaaattagagtcattgtctcagtttctggaacatctaccaaaaaaaggctttcctgaatggcattagttatacttattttattagaggtaccttctataattgattaatactgttagaaaaagtaagattgaaatattgtccgttagtacacctttgtaatatgatgcagtatttttaaatcttcttttaaaatgctttcgtcaaaaacttaagaatggaaaattttggctcatgcatgtcactcaattagtcaaatgatcaccttttaacaaaatctgcaaagccagtcctcttcagcaaacccggcagccaagtcagatttcttctctgttgggtaaccctaccttccaatcttttagattcaaaccctttgtgttgatgtgtgtgctgagacagccatcccacttctgaggttgccttctaagataaatacacaggtgagacacagagctttgccatgttctcttgtctgacgaaataaagctcttctgctgccaatgttttgtcccgggctcattgctctgctcttatggccagctcttgcaggagcaatttggcttcagctgggtaatagaagaaacagggtcttcaaaacttattaccacttctgcctccctgttggatagtaagtcttattatcaaacatagcaatgtggcccaacatgctcacctctgactctgtttccatgctttaccctaaacaaaaatagctacaaagccagcaagatgggaaaccttaccaaagcggctcgatggaaggaagcttcacaaggacatgatctcattaaccctttcttcattttccagaaggtttttatttccagagtcgatgtaagattcacagtggggaagaaatacacctctgttattttgaaacgtgggagaaggatatttgtgataggggaggtgtgtgtgtgttattcagcttgaagaccgtggacaaaaagtaacagacttgctctaggctggactcaaatccatcacacactggtccttggtgttccttttcatcaaaatgtcccttgactggcctgcccaagtccctcctgctctctgggcgtggtgaattagaggacactccaatggaagaggcagtcccaatcacagagctccagagaagggggtttggaagctggaaatgcagatttctgagtctttcttctagagctgaggctgcggaagtccatgagactgtagaggcaggatgtacagagaattacctctgtgcatgttcatggggaagcatgctgtgttaacacaaaaaggaggaaggatgcccagaagtcaaattgagaatccacgctcaatgggatgctagggggcttttctgtaaacctataatatttttagggtaattatgataagaaaaacagtaacggaacagccagtgttcattcatctttacattccccgtggtagatttgtgacttaaggtacccaagtggtaaagctgacattttcttcacaattccactttccaagtctttttcctgcatgaagtcaccaaagaaaatcagcaattctcctagactctagactagggaatcttggtcagagaatttgtctgcaatgacttacgtccagagaatggtcttgtgtggagagaaatacctatgctgaattcttacaactaaacgaaaaaaatatatgcttgaagatttcattaacattaggacataaaagcaaaaagaaaaatgcctaaatgtccaagtatagataaaggactgactaaaataatggttcatgtgagagaagtatgacttacgactctggggtagaatcaaagtccattttatctgtgagagcttcagagaaattcataataaggagacttctgtgtaaagaggttccttgatgataataaaaataatacttagccaacactgaactactcatgatgctccagatacttatgatgctccacttactcatttaaccctcagagtaaccctatgaaatacaagtagatgtgaaagccaagggctacagaggttgagtaacttgctgaaggatacctagctagtcagtggcagagccagaatttgaacacagagtcttgtactagagtctgcacaatgcacactgtcctctcccaacagttttctcatttgttttggtcaagatctgtactccgtaggatctctctctcatcaaaaaattgtgtgtgcatatttttgggcactaaaaacatgacatcaataatgacaatagttgcagaaccaaaaagaaaagtatctttccttttccatattcttttttacattcatatgcatacataattattataagattataatcataaaatttttctccttgccttttttttttttttgaaacagaatctcactctatcccccaggctggagtgcagtggtgcaatctcggctcactgaaaccactgcctcccgggttcaagcgattatcgtgcctcagcctcctgaggagctggggttacaggcacctgccaccacgcccagctaatttttgtgtttttagtagagatggggtttcaccatgttggccaggctggtctgaactcctgacttcagtgtcaggcctctgagcccaagctaagccatcatatcccctgtgacctgcatgtatacatccagatggcctgaagcaagtgaagaatcacgaaagaagtgaaaatggctgattcctgccttgactgatgacattaccttgtgaaattccttctcctggctcagaagctccccaacggagcaccttgtgacccccacccctgctagccagaggacaaccccctttgactgtaattttccactacctacccaaatcctataaaacagccccacccctatctcccttcgctgattctctttttggactcagcccgcctgcccccaggtgaaatgaacagctttgttgcccacacaaagcctgtttggtggtctcttcacacggacgcgcgtgacactcaggcgatctgcctgcctcgacttcccaaagtgccgggattacaagggtgagccaccatgcccagccctctccttgccttttatacttattatatttcaaatagttttattttgctatattatctttatcatcatcagttgtgatagctgcaacatgctacaggaagttgatgttccctaacttattgagatagtcctctcttagtttccttttttgtgtaatattgcaaataatatggcagcgaacatcccatatattatttcttttccttcttcgattattttttaaagataattcctggagtgagattactgaacaaaggataaggatattttttgtttcttgtaagaataaagccacattactttttgtttttttcttgcttgttgcccaggctggagggcagtggcacaatcttgcttattgcatcttctgcctccccagttcaagtgattctcctgcctcagcctcctgaatagctgggattacagattataggcacctgccaccatacccggctaatttttgtatttttagtagagacagggtttcgccatattggccagggtggtcttgaactcctgacctcaaatgatccacccacctcagcctcccaaaatgctggtcactggtggtagccaccgctcccagccaagccacatcactttttaatgggtaattgtgtattgtcatcagtaacatatcaaaaggattattgtattttaatgttacaatccttttgcagttgtataccccactttcttaaattgtatgtatttaatagctgacaattcttgctattatgtaatatcttgtattcactatgtttagatgtatattgctgaaaaaagcacaaattgaattataaatggactctttttgtcttacctaaagaatttattttgaacttgtaataacaaatgaattgttgcttagcaagaatgctgattgtgactagttcaagacatcaataattcttgaggttcttggcagattatggttagaactcttataccttggcaccataataaataaatatttttgccttcttcaacagtagatgtcaaagcagctaattttgttgctccatcattgtgttagttcattcttatcctgaggaaatttcaaaagaaagcttgaaactgaagaccattttgcatgactcatgtaaagtttgttgaataaacaaaataaacccatggcagtgaaatcactccatgattagttggcagtagattttgttcaagaaaccctaagtcattttcttggtgcattcgtttgtccagcactgtattttttgcaagatggcagttaaaggatgcaactcactatcagagtgcaaatcaagtgaaaaaaaatcttatgttcatttattcattatgtaaatatctactgaacaccttgactctggtggtggccaattatacaagacaggcatggccatgccctcatggaacttttggcccagcttggaattgtcaaagaaacacaaagctgaacactagttaaggagacaagacggattctagtcagtactactgcagtaaggaagagacctcagtgaaacctcagctcagctcccctgagacaaaggtggtatgtgctaaaggaaagggactaaaggaaggtaagggggtggtctctgggtttaggccatctgagtttgttaattgacacttacctggaggagaaacaaaagtctcctatctttaggacaggacatagttttgccaactggattaaggccccgcaaagtttggatcttaccatcccacaggaactgggagacaagagagctatctcactgaatgtttgcatttcaaagagatggctcccacatacttgatgggacatttctgggtggtagaaggtttctatctcaaacgggcacagaaagaatatataattgcaagctttctaaagtaaatgccctaagaaagtgagctcagaggcctatcatcagatgttgtctgaaacaaacagtaattttttttttttggaaatggagtctcgcactattgcccgggctggagtgcagtggtgcgatcttggctcactgcaaccttcacctcttgggttcaagagattctcttgcctcagcctcccaagtagctggaattacaggcacccaccaccatgcccagctaactgtttgtatttttagtagaggtggtgtttcactatgttggccaggctggtctcaaactcctgacgtcatgatcggcccgccttggcctcccaaacaaacaataaattctttcggcagcattgagttttctcaggcaggcattttaagggggctggaattgtcatcctaggaacacagcctggaactgatgggaactatgctagtgtttattcaagacttttcctgtagtggggtggatgaaatcacttgtgctgcaagtcgtagttcttctaggccaaggtcaaggcctgcttgagaactctgaatagagtctggtcaaggagagtctttgtcccaacattggcagttaaaacaaggctcattgtgtctgcagtaagaatgtcgcgcaggttgtacactccacagcatgcctggccatgtgcagtggtctcgtgaccacagctgcttcagctgttcaaaaaatttctaataggttctcctcagtttcatcatggtcagtggacaaggtcccttctgtcctacccctacccaagatcttcaggtcccttactctcatttcagggcaagatgatgggagagttataagtgcccagggctgttggatgatttgtggtccacagtgcaggcggctgggggccccctacactgagcacagctgggccccatcttccttccagcctgtcctttagccctccaaggagaaggtctttgttacccctccccatccaggacaccctctctcccctgccacttcctcccctggacactgaaattctccataagtatacattgtctggcgctataggctgtggctctttctttctcctctttacattggactaggggagaaaacccatcttttggaaccggagagcaaattaatgtacagaggaaacacatgaactaatacttttagatgagctcctaccatgtgcactcacaagggagcattttaagggttctgatggtggagttctgggagccctgggaacagacaccaggaacgcggcagctgatctgccacggagtcaagaggatcttccgggaggctctgtcatttctgtaaatcaaggggttaggaagacaggggagaggagagggaaatggaatgcgaaggtaagggttggccaaaaaggtctaccgtgcttttttctggtcttttattttttgtctcttctgctctctattggatcaaacatattttgttttatagctttctttcctcccctcagtcccccactagcttggaagtaatgtgttctacttcaattctttagtggttaactttcattttttaagaggcgtaattaactttatgaacactgaagctcattaatctctgtattgtactctaacaccacaaaagccttacaatgcccagcttccctcccccacctcccatactgggtgctgggtgctgcttttatttccttctttttgtaaacttccaagtctggtcatttatcattatttttacactcggttcatatttaagtgaatcaaaatgtttgccagtttcatctcttcagatggtttcttaaatccagttcacttctagattcagtattctttgtgctgaaataatctttaagctatttagaatgaaaaactctctcggtctttgttatagctgagttaacctttattattgattgacagacttgctaaatatataattctaggatagccgttgtattttcacttggcattttgaatatattattgcattatcttccgaagtcctttgctgctttgtaagaaggtgcttttgcctaattgccattaccttttaaatttttatttttttatttttgaggcagagtcttgctctgtcgcccaggctggagtccagtggtgcgatctcagctcactgcaacctccgtctcctgggttcaagcaattatcctgcctcagcctacagactagctgggattacaggtgcatgccaccatgcctggctaatttttgtatttttagtaaagacggggtttcaccatgttggccaggctggtctcgaattcttgacctcaagtgctctgcccacctcagccaccaaagtgctgggattacagatgtgagccaccgcacgccgcctaaaattctatttttaaattgacaaataatattgtacattcgtggtgtacaaagtgatggatagtgatgcaatcaaggtaattagcatatttgccatctcaaacattcatcatttctttgtcttggaaatattcaataccctccttctatttaatagctatttgaaactatataatatattactgttaattgtagtcatcttaccatgctatagaacctagaactgatccctcttgtctagctgaaattttatgtctttcaacatacctctccctatccttccctccccgttcccttgtcagcttctagtatcctctgctctacttttaacctctatgagatcaacatttttagtttccaggtatgaatgagaacatatggtgcctaactttctattcctggcttattgtactttaaaaaacatggaatgcttcacagtttggcttgtcatctcgtgcaggagccatgcttatcttctcttactgttccaattctggcaggtgtgttgcagaaatgaacactgccattacttttgagataatctttcttctcttggtaattaaagtagttgtctttttatggtctgcagatttgttaagctgtacctttgtgtagatttatttaattcattctgattaggagttgtgatgttacctcaattagaaattccatttttctttatatctggaaacttcaccatcatcccttcaaacatcgctcctctcccattttctttttctgtttctggagctcctgttaacagataatggacattttcatttctcttccctattattgaaaccctcatattttccagatctttacctcttcatgtgacatctgagtgattttctcaaatcttttttccaatagactaattctctgaagtctgctctttcaaccttctattgatttctctatttcaatggctagacatttcattgtagaattcctttgcttcttttgcaaatcaacttggtcttttcccacagggtcctgttactgtcttatgactcccacatcttcctttacctcgaaacaatgaaaggtgacattcttattttaagtgttctcttcagctgttttattatcctgagttattggggttaaagtctcccggtctttcacctgctgcctctcctggtagttttctatcactgagagtccccagggtctgggcctggcagtatctccaggggagagctcacattcatctcttctgggccttgtaggattcagcagtttagggtaattttttgtgtcagctttcagctggggaagcaaatgtgtgtctttttactacccacacagtgtgagttctggcttcattctcattggtggtttaggtctaggacatgctcctcttaggcaattctgatccctcttaacctctttggagccaccgtttcccagggctggtggtcagtgctgtttctttccaccgaagcaacaagccagccctccaaggtgtctggcttccagcatggaaccggaggtctggattcatctccctgcaagagcatcagaagccacacactcttggaggctgaggcccggatctggctctgaaatacctgtgcctgcctctggcttccattttagccaagtcaccctggcttttagaagattttgcttcattcctggcacctcttttgatattgaacttggctatatgcacaaaacattacctcttatttagcatttttatgtatttgaggcaggtagggcagggttaggagtgggaggcgggcagcctttcatgccagctcagcttgccctgtggtgtgaggccccaaattgttttatgaagccagcgttaacagtggcatcagacccactagcccctcacaatcttgcccatgatcgccatcgtggtaaatggtttccaggcaagaccacatacggcacgctggccccctgaagacccatgctcccctgtcccctgttgctcctgctgatcagagccagagctgatgatgcctcgcaggcaagtgtcctcagccagggcctgcgggtgtgtgacactctgcaggcaccaggcatcactctgcttcctgagcctctcactctggatccggttctctgcctttttcaggccaatgactattattttatttctcaggggtatctcgcggctcctgtctcctctgtaaagcactgtcaaatttacaagagagcttctctctctctcctgtctcaaagagattagaatttgcaagaaagagcctccttgcccatttttttcctctgtgaaaaaagtttcagttggagagtgattttgcagccaggctacaactgggtaagatttgatggagacgtacagatgcgaagcctggagtatcaatgtctttccacaagtgctgggaaggagaaaagaaaattggttatttgagtgagaagaatgtggagaagagtggacatatctgaatgctggcaggaaggagctgaagcaaaatgagaggcgggcattccagaagagtgaagggagcattaatagagcaaatcacaagatgggccgggcattggcgttcaccccgaggtcatctgccgtgcccagtcccacagcatctctacttaaggtgaggtactcaatatgtcagagtggaactttaaccaaaggaacacagccaccactctgaactttgggctcttctccaaagcgaaggtgggacagagttgagagaaacttaaaatctactgctcttgatggttttaagtcaacagccggggactggcagtttcctggcctgagcggacccagccgtatgtggggtgtgagtgcagggccttccttcccacagaaggatccctgcagcttgtcccactgcctggatggggagaccttgctgaccaaggactctcttaactggaggggtttcatagaagttgatgtgtctgttgtcactgcccaaaacgaacttattgtggagataggtcattgaaaaggtgcattgtgatgaggtgagaataggaaaacttgcagagtatgaggccctgggtggctctggtagaacatcattaagaggggctcaggtcatcctgagacaggatttttgcatgcctgggccactgatagaagactcaagaaggatcaagtagaagtgagtgtgtgtgtgtgtgtgtgtgtgtgtggtattgttacagggcgtccttgctcccagagctcccaagatggtgttgggccacttccaagatggctgcaagcctcgtgttcgctaacctggggttcttggcctcatggattccaaggaatggaatctggggccatgcagtgagtgttatagctctattagaagccttgggtcacggaagagaaccatggaacccagtgactagtgttcagctcaattaggacaaacccgggcacttagccaagcaggaacaatggcaagcctttagcccaatccagagcagcaatgggcgcctcactggatcaggagcacagcagacaccctgccagatccagaggggtggaagtcagtagtgggtctgcaatggcggtaaatatcaatggtggacggcgagcgaaagctcaggtccagccgtgacaaacacggaccagaagagtgtgcacttgcaagatttaatagagtgaaaacagagctcccatacaaaaggaggggacccaaagagggtagccgatgccggctggaatgcctgggtttgtatcccggtcattgtattgtccctcctgcagtgctctcaggcgatagatgattggctatttctttacctcctatttttgcctaattagcattttagtgagctctctcattagtcgggtgtgagctaagttgcaagccctgtgtttagaggtggatgcggtcaccttcccagctaggtttagggattcttagtcggtttaggaaatccagctagtcctgtctctcagtatggaggcaggtaggctaaatatcaggatgaaaaatccaacctttaccattttatgtaaataaaactgcttttggcttattcaggcagttcccattgtttaagttccatctgacacatcacctttctcctccgtgaatgaatgaaacggttctgtaagtatccaagtgtgaatgctccatgcgggcaccctgtggacgctagggatgcagggagagttaggattgatcatctctgtcctcagggaactcacagtctcatgggacagtgtcctcccaccagagggcatgattcccaggggtgaaagactttccaagggggactcaagcatggagattctatggaatcctgtcctcaaaacctcaacttctatctattcttttctaaaattgacctgctagaataaacctgtgttcataataacccttcacaaaaggggggcgttcccccttgcctccctcaaattttgcctgtgcattacccacagagcataaaactttgaggatattgaacaaagggaaaacctttctcaaaataataaatcaagacatcataaaccctttgagcttcccttctgtttctgccttgtacacctcagttaagaataaagggtggtgttagaaggggatgctttgtcctgcatgtttgtgatgtttggaattcttcagatgtatggtatgtggagtaatgacaagtttcattttaatgactttacctctccctgtctactatgcaaggagttcttaagggagacttacaggagaacaaggcaaagagagcactgtaagaaagactgaatattggaaacaacccctacccatatttcaatgtaagcatttctttacacctgtcctcagcactcatccctcagctaagagagcagtctcttcaaagagatttttgctattgattcttgtaaacacagttgtgatgtttcctgaactatcaacattttcaaggctattaaatgaaatgcatgaataaaacttttacccaatctctctcagattagggttgtgttattaattaaggtagtcaaaatctggtttatcaaatcagatcatacactctttatttacagtcatttgccatcttataaaacattcaataattttttcctgctattattactaaacaaaattatatactagctgctagactgataatttttagcaaaatattcttttcactttttaaaatatataaattatgttataattatgtttaacaagactattggagttatttctggtatttatacatgagactcatttaactgttcctcaaaaccaaatcatatgcacacaattacagaagggaggccaaggctattacgctgcactcttcttaagtaactggtaattttagctgcaaattacattgcactatagcaaattaagtaatgagaatgatttattatcttgtttatagaacttactttaaaatggataaatatattagatcttcattattttaatcttactggaatgtctaagtactctaacttacaaattgcatcttttactttatttccagtcatatttctaatattctttaaaatgtacattaacacatttatctggattttaaaatgaagtcagacatttttctgaaaaagatcttatttggctagttggtttgacaaagaggactggctttgccatttatattatatggtagatattttccacaaatagaacaactaaatctgtagctctaagattatgacagaagtatatttaaagcatgagctaagattaaatcatattattacaatattatatcagtaaaagcgtaatgaaattagtaatatgtcaattttcttgccttttcatgagttaatctatgtatttctcggtgaaagaatagcaggtgtaattctccatcacctgataaggcatgataagtcttttttatatacttcccagaaagtgcatgactctgggactgggtaacaaatcttgccccaagtgaggtgttttcaagttttttacgttcatcaaactgaagcaggactgacttgattgagttattgacttgtaaatcattaaagatgatttcatgataagagactttatcataaatgacatgtgcttattttgtttggatcatctgtatactactgatgataactctaacaatactaattgattactcaacctggaagaaatggtttaacacttagagctggtgatcataagaattttttttttttttttttttttttgagacggagtctcgctctgtcgcccaggctggagtgtagtggcgtgatctcggctcactgcaagctccaccttccgggttcacaccattctcctgcctcagcctcctgagtagctgggactacaggcgcccgccaccatgcccagctaattttttgtatttttagtagaggtggggtttcaccgtgttagccaggatggtctcgatctcctgacctcgtgatccacccgcctcagcctccaaaagtgctgggattacaggcgtgagccactgcgcccagccaataatttttttaaaaattaaatttaaatctttatacatatttttatcacagaaaagaatgatataattaataaaagactttacatcataaatagctatagcattaggaagaaattttgttggggacttagaatgggaatatgattgcaatgagaaaaacaaaaggtataaagtttctatgtgatcaaatcagtatgtattttttcaggaaattaaacatttcatcaggattttggaatttattatataagacctttagagacctttattttaattctttaaaagctgttttccctactggtggtgattgtaatcttctatattactggtattgtttacttgctttttccctctagtttttcttttctaattgaaatacacatatgtatttctatagtttttctagtttttcatatatatttctctctaatttttatagttatttttcattttttcaaatacatttttttgtttttatacatggatgtacatacatgtaaaattagagaaaataaagcaaataaacaatattagaaatgtgaaaggagattgtaactgtccttgatagggaaaacagcttttaaagaataaaagaatgccatctaaagaactagagtaatataaatatcataataaataacttaggaaataatacattcaaatatatattcaaataacttttctgagtaataggtacaaaaaactagacaaactagagtttcatgtgtgtgtctgtgtatatgcatctatatatccttatcaaaaaatagctgtttaatttagatggcaacgctactttcccctgcccctgttttgtttggtttttattgttctgtggtggtggtggtggtgatcgttactatgtcagtcaggatccaatcaggaaattatggcaaactcaaggtgcctaatttaaggagcatttcataaaaggactgttgaccaaggcatgggcagagcacaggagacggcagggtggctgggcaggcatgagcagatgcaggtgggcacgggcactagcccagaaggaggaggaacccccagagaggggccagctcacagcccacagtgagggaaccatgtgggggcatgttctgaccttgcacttctccctccctccagtcttctgtgtgttccacattggctgaacccagctgggaggcagcgggtgagggggcccatgaatgcctcctcccagtcagcgtcccaggaccctggccaggaagagcaaagtgggacagaagaggcaggtgcaaggtagcctaccccttttgggtatttattcacttactcttcctgctctccttgggtttgctttgttctttttatcctgattttaaaaaatgtaaggattgaattttcaggttcttgatttacattcttcttgtttactaacaatagcagctaaactatacaatatttaattaccagtgactgtataggcaccgcctagtcagaatgcacactgcccttgggactcctggagagcccttgctgtgcccgcattaaccctttagctgctgcaccttgcaagggtcggttgtccccagagaggctgaaagcagtgctgttttccaatcctcacagaagcgttgccctgtcctaacatggttcagcatggctgacccagccagtgctggctagacggcaatcctacgtaatgctatggattccactgttgcacataattttatttgtattccttttgtggcattctcattgtctttcatttctgagcagtatgtaattgcaatttaaaattcctttttaaccaaaggttaaatcgttaacaaatggttaaggtatttttaaacttcaaagttgtattattaatacaatatctatcctagttgctttgcagtcagaaaatgttatcaccactctttatgcatttcataatttatcaaggttttctttgaggcccttgtataatcaatttttggtaaatggtccatggatattagaaaacagtctattctttgattgtaaagatcttgaaagacatctacttaactgatattatttaaatcagagtccctgtatactgttatattttattaaattgatgtgtcaaatgctgaaggagttaggtcaacatcctctgccatgtctgtgcctctctctgtagctttgttctggtcactgctgtgtctccaaggacgtatagggccagtgttcagagaccaggcagaggagtggggcagacagagaccactgtagtttcttcaaactgtctgaccccatgacggagagatgttgtacagtttatggaagtagtctctggccctgagtcaggtagaagacagaattcctattctgtctgtcattttatatggtctttgttttataagatgaaagctgagtctggtgagatgaagcaggtttttgtttgtttgtttgtttttgtttttgtttttttgagacagagtcttgctctgtcacccaggctggagtgcagtggtgcaacctgggctcactgcaaccttcgccttctgggttcaagtgattcttcagcctcagcctcctgagtagctgggactacaggtgtgcaccaccatgcccagctaagttttgtatttttaggagagacgagctttcaccatattggccaggctgatctcaaactcctgacctcatgatccgcccacctcagcttcccaaagtgctgggattacaggtgtgtgccaccgcatgccagccgaagcaggtttttaatgccttaaaggtttctgctgtggcagaaggcagtccatccaccttagccatcagcaccactgagtttttctctttcctggatcatggtaagctgaagatgttgcctggtactgctccccagatgccgtgttagccccagggacaaaagtctccactagcccacatcctgcttccctttagcagtgtggcaaatgcagtgtaatttttttttttttctgagagtcttgctctttcccccaggctggagtacagtgacgtgaactcagctcactgcaacctctgccttccaggttcaagtgattctcctgcttcagcctcccaagtagttgggattacaggcacccaccaccatgctcggctaatttttgtatttttagtaaagacggggtttcaccatgttgcccaggctggcctcgaacccctggcctcaagtgatcctcccatctcagcctcctaaagtgctgggattacaggcgtgagccaccactcccagctgcagtgtaatcttaaagcatccttgcaccagagggaccagctgtcaagggttctgtggctcacagtctgatcatagtggcagcattagagtgctttcggacaccattttaatagctccttctctgatcacactctcctgtttgtgtcccatccctaggctaggcacacattttaatgacagcaacttattaccgagtacatgaaaaaagcgagccctttatctaataaaattttttaatactggaataaatttaaacactcacttacctttctcatctcttcatattttgctgcataggcactttatgcttgagttctgaccctgaacccactactgtaaattaaaattgagtctcagttagctatgtataaaatacactttgggttccagctaaatgaagtccctttctgggaatacagataagaaataagaaacatgtttctctctacttcaagtgcatgagttctggtaactagggtaggtgttggattatagttgaatgtctatatcaaattaatgagagatactgttgctgcttttcatttgtagatgaattggggtaccctcgaaagcagggaatgtctcactccctccagaatcactgattgcaaggaagtgaaacctacctgagctaatttcaaatgaccgtaaaagggggaagaggacagaaggatcagtgtaataagattatacaacagacagctttacttgcaaaatgatgaggggcttaggcatcactcctcttctctttctgaactgtatcctatttcttggccatgtccttacacagctcttggcgtatggtttggaggacttcaaagacttaacacccaccactcatgtcttttagaattatcaggaaaggaactatttttggtcactgagcatctaattaattagctccttttggtgccatgtccatctctggcccaagagcagtgttatctagcacaagcctggccaccagcacccgatccttctggggctggagagtgcaggatttcctcgaagaaaagcctcccagggaggcctgtggggtccactagagggaatgggggcacagcaccagctaggtattaggaagagttttagattcccctttggaggagagctgtgtaaatggcccaacaaagtctgtgtcaaaaaggattttgaagctttagaaacaggattttgcaggtgaaaactgatagttcatcttgtatttttaacttaaaaaatcaataccacaatgctgggccattcagtgtaagatatatttagatcacggattgaattgttattcctgagcagcaatatgatccaaggggaggtgagaggaggcaggaggcctcactgctttctcctgcagcagcactgggtcaccttgagaacctgctcatctgaacctcttagagctcagggtatttttttccaaacaagaggacaagacgtatcatggatctgaacacagcagtggtttaggatatcacatcttggatgcacatctttatcttagaagcaattgggtcctgataacacattttggtggagaagggaaggaagcaaggaatggggtatggcagggcagagggaatgaacctggccacagtgtgcctgtgaccagcagtatagatcacagtgtcttggaaggcacagcaaagctggctttgggcaacatttatacctagggtgttttactcatgggctgataaagccaccctcatcttctggattgatagttcttgatgaacaaagcccaagggaaaagagcatgtcatggtttaagaggttcattaatttggagcaagtccccagccaggattggaaggtgtatagagaaagtgatacaacgagtggaggaacatgagggctcttgtctcacgtgatttagataaaatgacacggacacacgtggagtggttttaaggagcagagggtttaatagacaagaaagaagaagaaagaaggaagaagctcccctgtacagagacagagagagcagtgccggggagccaagagagggaactcacctgtggggaacaccagccaggtatataaacaggctggaggaggtggtgtttgatttgcatagggctcaggggattggtttgaccagccatgtcattcatgtagcctgcgaaaaaaactagccttcccactctagccttttagtatgcaaatacagggcgccatgatgttctacacatgtggggatatgtgggagtggccatgttgccaggcacatgtaggggcaagggcaagaggacaacagtgggaatcgccatgttgggtggacccagtttctaatggcctgcatttgcatatcaaaggttgccagctaggctctaagacccagggctttcctactggacaagaaatgtttctggagccgcttcaaaaacgaaaactttccaaggaccccttttcctctctgtctgcctaaaataatttcttaataatttctactgtaacaggacaagcagcagacaaaacccctccgataccgagctaaagaaggaagggctttattcagctgggagcttcggcaagactcctgtctccaacaaccgagctctccaagtgagcaattcctgtccctttaaagggcttacaactctaagggggtgtgtgtgagagggtcatgatcgattgagcaagcagtgggtatgtgactgggggctgcatgcaccaataattagaatagaacagaacagaacagaacagaacaggacagggattttcacagtgcttttctatacaatgtctgtaatctatagataacataattgattaagtcaggggtcgatctttaattaccagcccagggtgtggtacagggctgtctgcttgtggatttcatttctgccttttagtttttacttcttctttctttggaggcagaaattgggcataagacaatatgaggggtggtatcctcccttactaccacaaaaggttcttttgtgggcaggaaatggacacagtctcagtcagctgggccagccctccagtgtggtgctgctggggaaactgaggaaggctcctgcagtgagttctgacaccaactacctggtgctgggccagacttcgcaagtcaacacggtcccccacacactgccacaaggccatgggccccaggccacctacacttctactagctggctacaaatttaggagttcccagtaccccttaggttttctaatttactagaataactttcagaacacaggaaagtggtatacttattattacagttttattatagcaaaaggagacaaatcagaacctgccaaaagaagagctgcatagggtgaggtctgggagcacctagaatgcaacgcttcctgtgtcctctccctgcggggtcaggatgcattaccctcccagcacagagtattgccagtagagacactcgcctgagtcttcacgtccagagttgttattggagtttcatatgaaggcacagttgactgaatcattggccatgtggctgacctcaatcactagctcctctccagagatcaggctgatgtcacgtgactcagagacacaacactctaatcacagccctcatcctaagtcatctcttagtcataagctaactagcagcccaccagctctagcataaactattagagcctgccgtgaataacaaaggcactactatcatccaagaaattctaaggatttagaggctacctcccaggaattggaaacaaagtccagccaaactctaggacacaggaatcctaatcatttttggctgagcaggtacattaaagaaaatgttgacgtgttggtgcctgggcctggcaaccagatagtaggtttaggaaagccaccaatcccttccacccccatggcctgccctggaacaaaggagagaagggagaccagtttcttgtgagctttccattatggtgccccttggctttaaaaatgggcagggctgggccagaaattcacaggcctccctgtgcagaccatgtgtggctggtgtcacagaaggaagccattagaaatgcatattcatgatcatgactcctactgctggagagggaccatttgggctcagcatttagtgcctacctctgcaagacactgtgggcttgatgaatgttttaaagaatctttcttctagtgacctggaagcaccttgagtactatttggtaaggggacagtacatattacttttgttacttggatcccttatcagttagtagggttaattacctgggctttagggctaagagagtttaggtaggcagctgtgagtcaacagttgccaggggtcccatttcacatacactagaagaatgtgatggtacctggcaccacatctagaggattagggagatcctgtggtttctgacactgtgtttccagggtcattttatattttgatctctttaggccaaggatgaaatatgtaccaatcaatcagagaagataattgaaatgaagcctatttacctttcctaaccctagtcagaaccacaaatttttaaatctccttatctcttaaagcctgtaatgctaagccttgtgcactaagtgctcagtaagtatttgctaaactaaatgtcagaggaattaggttttttttttttttttttttttttttttttttttttttttttgggacagcctgttgcccaggctggagtgcagtggcgctatctcggcttactgcaagctccgcctcctggattcatgtcattctcctgcctcagcctcccgagtagctgggactacaggtgcccaccaccacgcccggctaattttttgtatttttagtagagacagggtttcaccgtattagccaggatggtgtcgatctcgcaatctgcctgctttggcctcccaaagtgctgggattacaggcatgagccactgcacccagcagggttagtttttaattgttgagctgattgcattttatcatcataggttgcaatgccaaatgactgttgcagagacgattatgagatgcagatcctcgttactcaaaatgtagtccttagaccagagtgtcctcacctggtagctcaataaaaatgcttagtctcagacctactgaatcagaatctgcattttaacaagatctgcaggccattcatatggacgttaaggtttaaaagttcctctaggccagcgttcctcaactgtcttggcacatgagaatctcagagcaattaggtcagaatttctggggttggaacccaggcttcggtacttagtaaagctctccaggaaaaccactgaggtaagcattgcaaatcacaaggaaatagcctggatccattcagagaacctgggttttttttgctctgaaaataagaagccgaatactcatgaaccaagtcagctttccttccaataaaatctggttccatctctgtattttgcacatctttcaaagattatgcaaacaatctttgaaagattatggactgttctatgtccagaaggtactttgtataagagggattgcatttggggcctttctaatctaggatcagatgttttcaaaatgttgactctgaagaggattgaagtgccttgaggaagagcacaagaaatgtacaatgcatctttctggggtgagatcttttgatcatattttcttcagctgctactgctgaattagagtctaaagatactgttcttcttccatagagagccaaattcagtagggggaagcttgctaacaccggagtttcaaattattcaattagtctggaaacctgacatgtgtgagatttgtagcattcagtctatcttcccatggtcacaggtgaccttcccccaccatgtggatgcctgtttcctttgcaggctcctcctttccctgagctcttaccattgggccgtctcagggctcagggctgtgatcttctctcctgtctccactccctgccctggtcatcccatcccatcttatgacctatttcacctgtgcattggtgacatacattttcatttccatcccacatctccttcttgaatgccagacttgtttttctatcaccacttggatgtctaagaagcatttcaaacagaaaatgtccgaaaccaaactcttgtttttcttctccaaacctcccctgactacttcctcatcttagttcgtggccaatctattcttccagttcactcaggttaaaaaatgaagtcatccttctctttctatcctgctccacattcagtttagcagcagatcctttgcttttatcatcaagatatatctagaatccaacaacagcttctcaccaccatcctggttcagaccaccactatttctcaccagacctattgcaaaggctcctaatctgtctcttgtgcttgctcttggtcatcttcagtatatccacagcccattaaaacatttgtcaaggccaggcgccatggctcacgcctgtaatcccaacactttgggaggctgaggcgggcagatcacctgaggtcaggagttccagaccagcctggctaacatggtgaaaccccatttctactaaaaatacaaaaaattagccaggcgtggtgatgcacacctgtaatgccagctactcgggaggccgaggcaggagaatcgcttgaacctgggaggtggaagttgaagcgagctgagattgcaccattccactccagcttgggcaacaagagcaaaactccgtctcaaaaaaaaaaaaatatgccaagttgtgtcacttctctgttcaaatcccatcagtggtttcctattccttgggagtagaatcagagtccttgctgtgacttacaaggtgccacctaatgtgctctctccttacctctcactctgcctctctgcccttgctgctgggtctccgctctggccactccagccactcctgcctcagggcctttgcctgtgccattctctctgcctgaaagctcccctaccctggctgtgaatccccaggtctcacttcttccctccttcaaatctgcaaaaatgccaccttctctctcctttgattgccccttctgagattcaaccctttcaacagcctcccatcccctcttcccgctcccacattcatgtatcattgtccccagagttcacatcactttctactatactacaggactccattagttttattcgttgcctgtcttctcactctagaatgtaagctctgtgactgtggaaaaaagagctttgattattttagtcactgctgtcttctgtcatctagaaaaggcacataaaatgaatgaatagatgtatttgctattccaaagaacatcgaactgcatttaatgtaaaacatcatgcatttctcacccagtgcttaccaggcccatgccaggagttggggaatatcagtaagacattatccctgcatctctaagttcatagcctagtggaggcactgatgtacaaacaagcacaatacaaaatgatccgtgtacttgtagctcaaaatcagatgccctgggagcccagggggacactcacaacctagctgagttcggggatgtggcatttgtacttgtgcagaatgggagtcccaagcaaagaaaaagaatgcacctttaacaaagactgtgccatgtgaaaaggggcacaggtaaggccaagcgcagtggctcacgcctgtaatcacagcactttgagatgctgaggtgggcaattgctcgagcccaggagttccagaccagcctgggcaacacggcaagaccctggctctacagaaaataaaaagccggccatggtggcacacgcctgtcatcccagctactcagtaagctgaagtgagaggatcacctgagcccaggaggttgaggctgcagtgagccgtgattgcaccactgcctggatgatagagtaaggccttgtctcaaatgaaaaccaaacaaagaaagaaaaaggacccacgtaggaagtgtctctgggattgctggacagcaggagggacgtgggtgtagtggagggagtggctgggagaggcctggaaaaagggcagggataaggccagcttttcaggctgtttgctgtgctggtgagtttgtattcatcctgcaggcaactcggggcctattgagtgttttgagcaaagaaatgacatgattagattggtggcaggtaaatcctgtagcaaaggtgtgggggaagatgacaggtgacacattggaggtttgtcaggggcctggagatcctggagatggactgagccagatcgagggactcacccagctatcagatggtggctggactgtttttcatggttgaagccatgactggagacttaaattattttacaaccatcgagttaaaaacaaagaaggctggcgatagcaagtactggaaagagtgtaaaaataggtgaactgcacagatggtgggagaatcaactcttcccttccctttggtgagcacgaaggccccacctagcaaagtggaggatgggctgacttactgcaccaagagacgtgggcttgtgcataccctggggaaaccactcatatgtataaccagttgtaggtaagaaagcgatttgcttgaaatagcaaaataaaaaaactggaaacaacctaaatgctcatctgtaggagaacagataaataaattttggaatatacatcaaggaaatattatagaaagattaaaccagaaaacccgagatgcctatattaatgtaggtaagtatcccaaataagaattttattcctataatgtgaggaacttttaaaattatgattatgaaactattcatgctaccaaaaaattattaaaaaccatgaataatgatagaaaatgctgctgattttctatgagatcaatatagaatctacataggatgccatgattattaactgaatagatctttttttttttgggacagggtctcactgtgtcaccgaggctggaatgcagtagtatgatcgcagctgtctgcagcttcgactgatcatcctgcctcagcctcctgagtagctgggaccacaggcacatgccaccaactcagctaactttttttttatttttagtagagacgaggtcacagtatgttgcccaggctggtctcgatctcctggactcaagcaatcctcccgctttggcctcccaaagtactgggattataggtgtcaccatgcctggccagttgaatagacctttgatttggatttgcatcttattatttttagatgcctacatgaaaattcaaaatgccactaaataccatatgtgcttttgtaaaccaaataataatatcatgctttatatgaatttaggttcggaacatcggggttaaaatggaaaaaattttgataaaagttcaaatgttacaaactctagccttgactctgtccttcttatttccgtaattttgctcatatcctttaaacaacctgagacttctattattggttggtttgtcttaaaatgaagtcaggaatatctaccctgcctccccagtggggtgatgatgttgaggatcacgagatggtatcaggaaaggggctctgccacatgtaagtgccctccagcgcttgttactaataattcactgtctaaatgctttacttttttcatctcgtggaagtaagagatttcaaaataacattgtcactcaactgacaggtcgaaaacgacagtaaagcagcctggcttttctattcacagaccaaaccattagggtctgtgtcgttccagatccttgacgaagcgggtgccagggtgggactggacatgcaggagatgggtgaggaaagagcctgtgaggggaaaaggcctgaccctcctgaaagagagtgcaagggaggagggtggagcagaagcccccaggcagcaacatcatttctaaaatgctgccctccgaagagcctggcgtctcccgcacatgggcgccctctgcatccctgctgtgttcagtcattggtcagggcagcctgcagaggatggcctgcgtgtgggggctccagaacacaggatgggggccatctccagccgtccaaaatctacgcactacattttcacggctgtcacaacgtcatgaaaactgcctgtcatatttggatgaccatggttgccattatttttagcaaaatgacatattaaaagaatatattcatctagacaatataatctggaagtcaatgcctctctcattaatgtctcattattaacattaattatttcattatttaatgcccagtgtcctgctttatgttaaatgcattcctgtcactgacagaaacaatatgaaattgaccactgtttttagtgattatttaacattgatcttgaaattcaggctactgaaataatatgtgaagcaaaagctccagggatggctattttaaggagaacaaatggtcatttttttttaggggtgtgagtttatacctgtaaagtgtaaggaaaatatctagttatttgaattaatataagtttacaaagctaacagtattcaaatataaaatttaagtcatttaaaaagcgtctgggtttcaatgataatgaaaatataaactatccatactttaatcactaagtgcagaaagtatgtaataaaagtacaaaactttactaagaaacataaaagatttaatttaatctaccaatatgccatgttctttcatgagaaaactgaatattgtaaagttacattttatgttaattcatatatagtttatgatgttattaataaaatatcctctatttttctgttaattgacattttttcttacttgaaattattaacattattttaaaatattctgaaataatgaatagtccagaagaggtacatttcaagagggcaaagaagaggaatgaaataagattaatacgactgtattttaaagctaccataatgaacaaaatgtgatcctgactacagaaaaagcaatacatccatgaaactgcacaactcagagtaaattctggcacacagaaaaatctgatacatgataagggggaagcaggttaccagtaaggaagaagtatgttattcacatgcacccaaataaattacaaatggatctaagagctgatgttttcaaaatagtgctatcacatgctagatgggtgtagaaataatgtttacctctatctggctgggaagggtgagtaagcagggctttccaaaattaaagtgttaggaggaaccagaaagaatagttttaacacataaaattggaaatcttccattaacagccagatacacaaaattaaaaagcaaataacgcccagggaaaatatttgcaacaagtatgttagacaaaatcttgtaggccaggcacagtggctcacgcctgtaatcccagcactttgggaggccaaggcaggggaatcacttgagtctaggagttcaagaccagcctgggcaacatacagagacctcatctctacaaaatcaaaaaaaaaaaagcagcttgatattttagaattcacagagctcatatacttaagtaaaaaataatagcaagcttgagtagataaggctttaaagaacaagatcagacagctcacaacagggcaatataaattggctaagagaaggttgaaaatgtaccgtcaggaggtgcaaagaactatgggaacactcaatgttgttgagtttgggggagaagaacacttgcatggatcaccagctgggtataaattaggcccttttgtaagttcacttggctatgtattcatagcctttcactcagctatgctcattcaggccataatatttcttacacaaatgaagcaaaatgcagtacacattttgtgtgtgtgcaaagatgcttctccacgattatttaatagcaaaaatataaacaatctacgtgtccaaaatggtatcaaaaaactaaatggtagtatgcttataaaaggcatccattaaaatttatgaaactatgttagaattttcaatgaattccagttattaaaattggaatataaaattgcgtatacaatatgtcttaagacaaaagaaaaggaaaaacaaatgacaacgaggaatctaccaaattggttaacagtggtagattctgcatcatgagtgtctttttttcttctgttttctgctttttatagctttcagattttccacagtacgaatgaattatttttgtaataaaaaggaagaacaattaatgctctgtttaaaccagatgtgagatagctgctgtaccttaaggtcaagagacatttaatttgtattcgctttctggtaaattagatacgtttccggtgttgagctctctcctccttccctatgttgaagtctttgcaatcagctgacaccaaataggagttcatttttttggagggatgctttacaccataatggctttgatgagtctcctaagatccattgccatggaaaatatttcttaaacgatagaattcaaaactctgtttaaaaagagacctctgccattatcattagcaaactaacacaggaacagaaaaaaaccaaagacagcatgttctcacttataagtgggagctaaatgatgagaactcatgaacacataagaagggaacaacagacactgggatctacttgagggtggagagtgggagggggaggggagcagaaaagataactgttgggtactaggtttagtacctgggtgatgaaataatctgtaccacaatcccctgtgacacaagtttgcctgtacaacaaatctgcacaggcacacctgaacctaaaataaaagttaaaaaaaaaattaatgggctataaataaataaagcggcctctgattcaagcaaaaactagttaatggatggtaaaggaaatgggtgaaattttgagaagtaacagtatatttatgtaatttccgagtgtctctccacaagatactcattatttacaaaggataaaatagtgactttacagtggagaaatctgacagacagcaccttaaccaagagttgccatcatcagtgcagcttgtattgggttggtgcaaaagtaattgtgggtcttttttgccatacttttgatggcaaaaaccacggtaacttttgcaccagcctaatacctcctgttacagggcattgagggttcatcgtggcttctgtggctcctgctgaagtcagagcctgactcttatcacaaggaaacatcaggcaaatttaaagtgggcagtattgtacaaagtaactagcctatacccttaaaaaccatcagtgggctgggcacagtggctcacgcctgtaatcccagcacttggggagaccgaggcgggaggattgcttgaggtcaggagtttgagaccagcctggccaacatggtgaaactccatctctactaaaaatacaaaaaattagctgggcatggtggcgggtacctatagtcctagctactcaggaggctgaggccagagaatcacttgaaccctggaggcagaggttgcaatgagccaagatcgcaccactgtactccagcctgggtgacagagagagactctgtctcaaaaataaataaataaaaacaaccagtgtcatggaatacaaagaaaacaactgaactcaatataacacaagatcttgcatcttggatttttctttttcacaaaggacattattgagaacattgatgagatctgaataaggtctgtagattagataataggaccatgttgagattaatatcctgatttttataattgtactgtaggtatataaaagaatgtcctgtttttaggaaatatgcatcatagtatttaggagtatgggagcatcctgtcaacagattactcttgaatggttcagaaaaacatgacacatatgtatgtataaatatgtatacgtatataaattatatgtctctcacatacagagagacagaaaaaggaaaaacaaacagcaaaatgtgaacatttggagaatctgagtgaaatatattagggaattcattgtcatattcatacaacttctctgtaagtctgaaagtatgccaagatttaaaaaaaataaattaaagcagaaagggactgttggttgcagctcttccaagcattagcacatcatcagggccctccagctcctgagtttgacatgcctttttcaacactgaatcctctgtctgttctgtagggaatagatgctatgtgtctggtgctattctttagtcctctgcatttattttccctccaaaatctgttgacagcactatgaagtagatagaattctaattctcattgacaagtaagaaactaacatttagagaggctaactaacttccataagatcccacagccagaaagtagcagaatgagacttgaactggggcttctctacctccctctgcacttctgtcctttccacagctgggaatcatatgtccctcccatcacagccccttgaatgtaagtctttttttctgggcatttacaaatctgaaagcatccctgttggtgttttcacatgacgtggattcactgaattgatttccaccaaggcatgttatctgctttgctcagtgtgctaccattaaaatcatgttccaccttagaattcctcaaactattggatgccagttagggaacttagtgccttcacggagactcactgcttgccagctaaagagattgaaaaggacccaagatagtagattcaaggtgactatgtagaccttggatggtgccagagacatacttcccctggttttcaatgcttggggtgaagatataggaattcagctgtgggcttataccagtaacatagatcctcagctgtcgtcagcaggaaccaagtcccggtggcagcattgaggagggcacacaaaatgtattctgacataagaacctcttggggccaggcgcggtggctcacgcctgtaatcccagcactttgggaggccaaggtgggcggatcacgaggtcaggagattgagaccatcctggctaacacagtgaaaccctgtctctactaaaaaatacaaaaaaaaaaattagccaggcgtggtggcgggcgcctgtagtcccagctacttgggaggctaaggcaggagaatggcgtgaacccgggaggcggagcttgcagtgagctgagatcccaccactgcactccagcctgggcgacagagcgagactccatctcaaaaaaaaaaaaaaaaaaaaaggaacctcttggaggaatttgatcccagagttgacagtaattggagaaaactgattgtaaggaaagagcttggaatttcaatgaaagaaagaaaccagcaaatacaaaaagaaaaagtagaggacctggttgattgggatagtttgaatgggccacaggaaagaagaaagacatccttaaatgcaaccttacaagtctctatttgtgccagaacccgtcctccactggtgaactataagaaccctccttcaaagtaggtcaatttagggaaaagccaagtgctggtggcataaaagaatcaggacatgccatcttgccccgagcagtggaatttaattcagaagaagagtagaaatggaggctggctgtgcaactgcattagcttgcttttgctggttatgctgtgaaataaatacccatacaatctcagtggcttccacaacaaaagcttatttctcactcacatcacatttggctgtgggtcagctgcagctttccttcctcttgtggtttgggctcagatgtgcttctgaagtgtaggctgaaggcatagcccaatctagaactgaacatgatgttcttgcgggaaaaggggcagtagcaagagggatggtgaaactcatgatacctcttaaaacttcttgcttacagtgaacatcacatttaattggccaaagccagacctccgctctggaatgtaaaataatcctctctggggagaggaggcaaaggactctaggctttcaccatctccagaagagagaagactttatatttctccagaagtctctatctttaggatagccaataatcgtcctttaacccatgtgcctttgctcagaaatcattaacaccaaaaacacaaaaatattcatggaacattgtttcatgacactcatgctttttaatattctgattactgtgtttagttgtagagacccagttttcagagttgtggagatgagtgcccctctggctcatagttctcagcaggcacatattctcctttgactgacatatagagactggatccaaaatctaacttctctccttctccctagctggttgttactatctcccagaacctctatttctatgttcaatatcacatctggaaactcttaatgttttcatatatattcaatgtagaaacaacagttactaaaaaaaatcacaatttggatattataatttttcttgcctcattagccctccatatcctatcaccaactaacataatttatttagtctccaggactttttagattctattatggtaaagacaagagttgaccacagacagtcgcatatatccaagtcagtgcatgcctatgggctttaatatatttatgttgaaagatgctgctgtttgcttttcaatgtcttagacactcatgtgtctgtagaatcttaaaatattatccagtggaaaaatatgtaattggaaaaggtggtggtgcagtccatttagcaggccgatgatagattttcctggatgcctctccttcccccaaataataacttccataaaaatagttttatgaaagcttccaaaatggtgcaaaataatacttttgtggaagctagaaatagggatcggtatatctgactccacaactgatttccaggataaaggtgcaactggactctgaagatcagcccagacctctgcctacctgcacatttcacctgtcctcagtagctccaggcctgcaccagtcagtctcaaagcctccacttgctcctctcttcctgtgtttattggagctctccagttcccaaaaatgcagcaaagctggaagtaggtatagcaacacaatgggcataatagaagctgtgatagcctcaatagaaaaaggcagattcagagagagagaggcatggaaatagattgcagcttctggtacgggaaagataagatacttcatatcatccagaaataagcttcatcgcaggtagcgagatgagcaggtgaggagcagccagcttctctccacagtctgcaagagcagcgtgcaatatacgggttgctaaacaagcaaaaggttatccacagactttacaaattacatgcaataccgccctgccagtgacagctctcttctgtctacaattctgccaaattctcaccacccacacctctcccaccctgttcacaccaccgtgtctggcctagattcttgcaaggtctcccaacttcctccctcctcatccttccagtgtgttcctaaagcagcagccagagagcccctgctcgctgccagccagatcatgtcgcttccccactcagggctcaccagtgacttcccaccttgcaatgtgtgaacaccagagtccttccagtgaactagaagcctaacacaacccggccccttgtgacatccccagctttatttccttctgtcctcccctttgttccccatgttctggccacactggcctctgcagatgctctcccacctcaggcctttttttttgcctggaatattcttcccttgggcaggaatggacacttccttttcttccttcaggtctttattcaaaacctccttatctttgaagcttttcctggagacccagggaaaccttcatctcctacccacgtcttaacatttcatttctcatttgttatttcttgaagttgcatgatctctaacatgtgcagtttacttatttattgtgtttttggttgctctctttccctcaacacgagctccacagccagggcctgtaggctgtgttgctcactcacgtattgcctgatccacagtgcctggtatgaagttggcccaccacaaacatttgctgagtgaatgcatgaatgaaaagccccctccacatgaggccctgaaaggaaatatgtgcacagcaaatgaaataaatgctgaataaggtcgcctttcatgactatctgggtccctgtgcaggcctctcctccctatctcattgcctcacaatagtgaatcaccagcaaatccggccaatcccctgccagacccgtggtccagacccaagtcttgatggcactagtcccttggaagccagccagagcacacctggggctggccaggtcaggagagcctcccctggaactggcagagccatatccaagggagcccggagctctgtccctggggaccctgcaggaagaagtggagttccccggcccccacacccatcaccttacttggggtgaaatccacagagagtaccccctgctctgaggagtggccacagcaggaggaggtttggccctccttgatgggggacctctgtcctcccagcctgcacttcagaccaggaaaagtgtttaaagataatacttgggaacaaatactagactgataaaagacaacagaagggaataagggactattattctttaaaactgcggaataagagaggcatccttggcccaagcctatgataatttcagaaaacattttgaactcaagaaaaagaaaacatggactaccaagcagccaggactttgtgtgagctacatgaggaaatctatgaagattcattttaaaaatgaaaacaggaatttaatccatacagagacatggtgctcctggatgggataacttaatgtgcaaaactttcccatagtcatttgttagtttaatttaatcccactaacaagatacgtgaatctttatgttctggaggatggccagtgggtctcagtattgggctctactggcatcttggtggggagtcctgagtgtgggcatgggtgtgggtggcattctcctacacacccagcacactcccctgggcccacagtaaccagctctctggattctagatggataaaaatgcaagcacagctaagagaacttatttcaaaaattaatgaagtgccgggcacggtggttcacaccagtaatcccagcactttgggatgccaagaggggaggatcacttgagcccaggagtttgagaacagcctgggcgacatagtgagactccgtttcttttatagaaatgagaaattaaaattaatgaaggaggtacctgtgctacccaatgtgatatatataataaatatacagtaaatatgtttatatgcactagtccgtgtatatacacacatgcaaacactaaaacttcatgtgtgggcatatgaatggaaagagcaataggagtaaagtcctgaaatagacacaagttaataagaaatttcagatattatgatatattaagtgattacttaatctatatcattatttaagtaattactaaaattattaagtgatttgggaaaccattcatgggggggaaaagctcaaatgaaatagtgtgaattcaaagtgtctgacacaggtgtcagtcaatttagaaagtttcttttggcaaggttaaggctgcactcctgacggtgtcaggtcctgaggcccaaggtggttggggtacagctttcttttgtacattttagggagacatgagacgtcaatcaatatgtataagatgtacattggtttggtcccaaaaggtgggaaaacttgaagcaggaacttccaggtcataggtagataagagacagaagattgcattcttttgagtccttgatcagcctttcgctgaatactcaatgtagtctggctcggtgaatctgcatttttacataaacagtagggcagaggaagcaatcaaatatgcatttgtctcaggtgagctgtgaagattagctatcagtttacattgccagggtgaaattcaacagaactgttttagggtaaagatcatgaggcccacaacaaatttccttgtgggcacattatgagggagttgtgtagctttttaaaaatctttgtagctgccttatttaggaataaaatgggaagcaggtttgcctgccatagttgccaccttgagttttcccttggcttagtgatttgggggtcccgagatttattttcctttcacaatagtaaatgaaaccaaaaaaaaactaactatacccaatgattaatttcagaaagaagagactataaaggtaaagtgaaaactagggaggagaaggagggagggagggaggaagcagggatgggagggagggaagaaagaaaaaaagaaggaaggaaggaaggaagtaggtaggtaggtaggtaggtaggtaggtaggtaggtaggtaggtaggtaaagtgtgactgtttgcctaatggaagctggggcttcagaggttctggggaaaagggacattgctgccagtgtcttaaaggtatttctgaccaaaataaaatgtaaatcactggagaagacctgcctggagccctcctcggctcttaaatggaatgctgtaacatcttgttgtgtgttcagctcatctgttcggtgtgtctcccctcctgaagggcagggaccacactaatctttgcagagtggaccactgagcattggcactctggagccaggtgcctggctctgaatctgcttttctgctccttactacttgcatgacattgggcatattacagtgactctccatgcctcagtttcctcctctgtaaagtgtagacagttataggaactgcctcgctagattattgtgaggatcaaatgggttaatatgtgtaaagcaagatgagcatttaccattgtatctgcagctcccaaaacaatgccagctatgtgggagacagtcaatgcatgttgggtgactctgagcctgctttgctagataatacctctccaactccctaagaacacaagcaaaccacccctcaaggataactggtgacagattttgaaaatagaggcagaaatgcaattcaccagtctttcccccccgccgcccccacttggagcctgcaaaagcgctgagtaggacttagtctgcttgcatatccatgacaggaaagttaaatgagatactgaagccgatgggagagggcccttggttgctcagggcagagtgaagcctgtatcctttgcataattctgccccatcatattgctttttgtaaaaggaaaatgttttgatagtctgtcactgaaatctgtttttaatgaaaacaccctaggattagctattattcttagaagacagctctgttgtggagttattcaaggatggagttctattacgtgtgtttgcccaccacagatgtgcctcagatgaaacatgaaggttagggaagaaagcaaacagctctgggctgagcagcaataaagcgctgcattgggagggatggcactggtggggaggggtcccagctcatggccatgatgctggcaccagagtgggtgctgtccagaagctgtccccatccctgttcttaccaccttggctccaggacccagcttgacttctcatgtgacttttccctctggtgctcagaaattggagtctgaggagtaaggcctggggaggaggtggccacacccacaggtggtcatatttatgttgcctggtatggagttagaactgttcctctagggacaaactggatctttggaccagtctatctacaaacaaggatggctccctcagcttgggaagaaagtgtcaaatgggaagttagggaacgtggaagtttaaagtgaagccatctttatgttctccctgtgtgtcattgtttcgccgtatggatatgctagagaagtgaaaaaatgtatgaatgaatgaaaatgaaaaatatatgagtaaaataaatatctttaaaaaggaatagcccactggctataccactaagttcatgctcttcaagtaaagcctggactatttgtcaaagccttttttttccctctaatgtaagagggtttttctgtcatagaggaggggcctgggaatttggaaggcattgtaagtcattgctgacaggaaatgatgctattaggtattggatcataaagagacctcctcccaggaaaatgaattcagtgacaataacaccataatgttatataacagtaaattttatatctcctgaaaattgatgttggatcaaaacaagggactgaaagacaatagattgggacaaaacaaaatcagtcagaccccaactcatgctgatggaatcaaggtcacaaagtttaaaacagaacttccaacgtgagaccagacggccacgtttttggcctgctatccagtctggctgatggctgatgaatatttgctgtgacatcagccaaaagggagacgatctagtgaaactcttcatcccacctcttgggctcttgcaacaaagaatagttttgttaaattagcaaatgtaattttctggtctctaagaagaagcaagttttaaaaatccccttcaaaatatgtgcaactgagcttactttgtctttgcaagggtgtctagtgtgacatttcaggaattaaccacatatatgggaatgcacacacaggctttcccttccttcatgtaccgggttggttggtctgtcggcaaatagttattagatggcgcacactgtgctagggtctttgccctagagggcaaagatagaagaggcgggccgtaaatttccttgaggggtttggggtcactgaaataggaattgtatgtctttaaatatctctacagcttggcacctcctgctggaactcaacaaatcctaaatgccaattgtccatacttaggacaacttaaaataattgacagtcacaatgatagtcttttgtgaggggcacttgccccagctgaccagatttctggggatgtcagatacacccacttaaaataagtgtaaattatttttaaatatcacaagccccctttgaggaccagccactccagggcttcttagctgtgatgcgctcttacagccccagacctgtagggacatgtccctcccagaaggcggcacactggctgggcctctctcaaaccaccccataaaaaagagaaccttacccgaaccaggacttctggctttcttctagggtggggttctgagtgacctttcatcatattgtttgtcgtccgtatggcttggcttttcaaaagcaaatgtactttgtttctataattaggaaaaaaagttttttttaaatgtcatcttttgccaggcacggtggctcacgcctgtaatcccagcactttgggaggccgaggcgggagaatcacgaggtcaggagatcgagaccatcctggctgacacggtgaaaccccatctctactaaaaatacaaaaagccaggcatggtggtgggcgcttgtagtcctagctactcgggaggctgaggcaggagaatggcgtgaacccgggaggcggagcttgcagtgagccgagatctggccactacactccagcctaggcgacagagcaagactccgtctcaaataaagtaataataaataaataaatgtcatcttttatattgctagcttttatgtattccacccatgaatgatcttgacctcttcctcaaaaaatcctccacttatcagacgacagaccgaatgaaagaggagggaagcaaaacaatgaaacaatttgttttagcctatgataaatcacagtatggtctgaagggtaacgtgctttctaatatttggtttttaatcttagttcatttgggtagggacagataaatatttgcccaggagaaacatcctgcttggttcatttgatttttaataatcctaactctactcaggtgacctagcagctgtggcagagcatcaggcctcagaggtggtgtcactgccagtcagcgttgatgagtagtgacaggccgtgtcagatggttgattcacagggctttagagaggtgccaggggtttgcagggcataagcagggtgcggcagccaggacctatgaagaagtggcctcaggcagggctgggcctccaacaccgccctgctctcctattgctgtgccacaagggtctgcagagggaccctccccacgtgacttcctgctgccctgtgccgagcactcctagaggattttcctgagggtcatggccacttgagtccaacagaggaactggctgtgtatagctgtgtgtaaaccagttgtgcctttgaaggaagaatcatctaatctaaggttattttaaagtagtactttgtcgattcctaatactgtcccttgccatttcctggggatttcctctacttgaaatctgtgcactcattcgctgctgtcaggctggatcccatatggcagaagcaaggggccgtgcagatctgtgtagctgaaggtgggctgcgagcagggagtagaagcactcatcagatggcttttgtgtggacaggtcacttggtccccatctgattccttcatttccttgggctccagtttattcctgatgaaagagggttccatccaggttctctttggtggggtggggtaagcttccaggagctggagctggatcctttttgatccccattcactttctttatgaagtctccacttctgctctcattctttttttatttccagagtcaagctttgcagttaaacaattagtaaactgtaaagaaataatttacagtaaactgtaaagtgaaatacaccggtatccccagtactaagtgctaaatagataatgtctaaacagcccatttgagtggtcttttttcctcttctttttactctcctaatgtatgtgtgtgtgtgtgtgtgtgtgtgtgtgtgtgtgtgtgtgtgtgtttaattaattggatcaatatttggcttaggacagtgagcacaccctataccaggctctgtgctaagtgctgaggatggcagccccagctcccagagaattctgagtcaattttgcaagatagacattaaacaaatatatacataaacagttcattagaattatttttaaaactgtcaaaaaataataactacagggtactattcccaggcctctgtcatgggggaaggggaagcacaggggaggccaaggagtggggggtgtggaggaagaagggctgacggcagctcaggtcaggcagcagggacagcacactgacatctccaaggaaggggtaaataagtgcctctggagactgtaggattcccaagtggccagagtgtcacaggtcaggaggagggaggcagcagtgaggtcagggaggagggaggaccagatccactttgcatgtttgtataaagtaagtctcaaactggtatttagagctttagcctaaaggaagtgtgaagccactaaaacaaggaagggcgacatcaggtttcctttttcaataaagtgttctgtccattatggagactgtattaagagcaaaggtgcagacgaggaggccggttaggctccatgggagttgagtgggagagggaggtttggaccacgctggaggaggcagaaatggtgagaggcagatgaattctagaaccgttaggaggtaggagcagacgaactcagtgcttggttggacaaaaaggatgaagaaagaggactggagaaagaaagctgtccaagttcctgacagggagctctaagcggcagaggaaccatgactaaggctagacttttaagggaagcttgggcataggaataaagatcctgagtttttcttgcatggtgcttgggtggctgcgcaaagctccagtggatggggactgggtctggacatcagatgagtgctctgacctatcacagaaattggagagttggcgatgttcacatggtaactaaggccagaggcagggacatggccctagtgtgttccttcttgcgtcttttcctagttggaccttctccaaggaggaaggcagtgcaggggagcctgcagatggggcagagctggggcagcctgagaaccatccaggaagccagtggctgtggcagggagcgggaaggagcaagggtgctgcacggtgtgcgtcaccactgagaagtccagtagcgtccaccagggcgttggacacagagcaggatctcagtacgtagatgttgaattctctccgtcttctattcagatctgcttggaccagggttgagaacataatctctgcacccagaatgcaagcttgctacttgtttcttacacgacttcatttgtcagcaaagcttcaggtttcatcggggtttgggaatgctgacatcatagactgcttttttctggaatcaggccacattgattattttcatggtgactgtaactcccaaggaagatgaggttataaaatcagaataaagacgtatgaaccaaaacaatacctggattaagagggccctgacagatgatgccgtcagcaactgtcccatgcctggcatctctgctcaagtcctgtatgctaattttggacatggtagctctaaagtgccaatggtgagaccagtgatgccaagtttattgtggtgacagtcactccgcaggacaacaagtggaaggggatggcacttcttgagtctttcccatctgagtaaatgcctgagggagtaagggcactgaaacaggcagtgaattttcagcagtttaactgtagattccccttcctttgtggttgagggagcttcaggagtggatcatatgtgaggatgcttttcgctggccttctcagacggctgggagagcagaacttctctttccccacaaacacccacaccagatccttgtttcttgaaaaagaaaaaaaaaaattctaggctcatgagtctcattccttaaattaaaatttaaaatcaaatcaaattacttatggcacagaataatgttgcttgcaactttttatccactttatcaaaatgagtgtggtccttgtgtgatttttccttttgcacgtcggttgcccaggccaggtatcttggcgggggtgggggaaacaatgttgtttgtgtgggtaatgttgctgattttgtttgcttgggatacacgctaagttaacctcgttggacttttccccaggaattgatgcgcgtacacgtggtgggtcattatgctgctgcacctgtgtagtgtgaaggtcagtgtgcttttctgattataagaaaccatccatgtcattccattataaacccactccactcataatggaatgtgcctcagcctagggccattgcggttgcccagcccaggaattatctcaagtgtggctggacatttgagatccatcaccctccctccccaccacctgcatccaccccagaattcgactgtgctccattttgagatgatgtttttgcatgtggagtcctccttgtgtgatgtgaacgtacagttgttacaagtgaatttgtacctggaaacattctatgatgctacttccagaattacagctgagagctccgctgtctatgggtaattgctgtacagttgatatggacagacagaaataggccttgagacaagagcaacagcttctcctcctgactcagagccaggccatcctctgggaggctgatggctcattaggatgggctcttgcagcagggttgctttccctggaagtactttccaccagctccccaagacttcctgccaatggtcctccttcctctgtgtcatggttttacttttggtgacagcccaggtttacagtcatcacagctcacatttactgggcaccatgaatcatggtttgtgccgaatgagctccccatgagctcctctcctgagaggtaggtatgatcattgtccccatttgatgtacgagggaactgggtcatggagggttgagtggctgctctgaagtctcccagtgggtaactgaggagcattgattcccactgaggtctgcctgtctgagctggagtccatccactgggccctgtgctgctcgggtaatactcagccaatcctgatgtgaggcttttctctaaaaaggaaataaaagcccacatttgcatagcactttgcaaatttattaagcacatccacatgcatattcagctaatccttgaaataaccctgcaagaaggagagggacgccctgagatgttcagtgtgtgccttggtacgcgtcagcgggcgggaagatgaggccacgctcacatgcagaggcagcttctcctctgccacagggccctgctgcctactcatgcagagggcagctctcttaattcacaagttctgcctaatgcacttaaagaatgagcatagcatgtgttggattaaggaagcattaaattaatacttaatcctgtgctgccaaacatccaggaacagtgtcagcacagtcacttaaattcccctttatctccttgagtatcccagcttggtgtgcgctcaggagccacttcctctgtaccattttcacaactcagagctcagcaaagccttgatttccccagttcactcagcttactccaccctccagccatcccttggggaaggcgttaattttgctaagagaaagtttccatagcactcagtctgtttgcattccccttggacttcggtgttttctctttggctttaaagatagaatgagaagtagtttttaaataccaagcagttccttctgagtgcatttcacattcaggaagaatgccgcctctttcttctttccaggactagtgtccttgggaagttagggcttctcagtcctagacaatctcagctcatggcatcttcagatacaagctttgccttgaaataaaactcctggaaccaaacagcaaagccaaatacgcacacagatcatcataggggattttattcagtgatccaggaaacagaaggccaagtattctcccctgacatttatgtgagtgagttctcactgggtaacatgagagagaagactgggatcccagctgatgctgtcaaggacttagcttgtgaaacaaaacatgagcatcagtacagcctcctgcaatgacacagggaacctgaaaggacaggatgcagcaaccttatttccaggtttcctggaagttaaatgcaaagctccttaccccgcaccttactcagtaaagggaatctatggccccataacttctgtgctttcatgtaaatcttcaaaattaaaaataatctcaaagttccctacaccttcccctaatattttataagaagattcatcatgctctgaaatgagtctgcagcactactaggtggacttatgaaaatatctggaaataagctctggaggctaaggcaggaggatcacttgacgccacgagtatgagaccagcccgagccatagggagatcccatttctatgaaaaataaaaaaaaaaaaattagctgggcatgatggtgtgtgcctgtagtcccagctactgaggaggctgaacagggagaatcgcttgagcccaggagttccaggctacagtgagctaatatggcaccactgcattccagcctgcgtgacgtagcaagaccttgtctctaaaaaagaaaggaaataaactagggatcatttaattgaccacttaatgtattttcagcttctggaatgatccttagcaggatgaatgcttatctctgggagaggctcatacaaggaagaattttatgctataaacaccggttctcaaccaggggtacatcgcaaaccaccaagtctagctctgcacgtgaagcctgtgtagttgcacactgaaaaggtctctaggtaattctggtatgcactcctggttgagaaacactagctagacctgacgggaactaagcctttccacatctgtgaataagagaatgagaaagaaatctgtgctgaagatctttatgctacaaagacaagtatcttgtcacccaaagatggctttctaagcctatcaaaggccctctgtggagaaaaaacaaaacatgcattgcaaatgactggcatctctgtgtctgttaggtcccctgagagggcaagagagaactaacgtttgtgacagggaaagggaggaagtggaattgtgtgggggctgcagcctggcagagcctctgccagcccagtggactctcaggagcaaaaactgcctgttcagagacccagtgttgggtgggaatggctagacccctgcatccccaactagcttaatgttaggccaaggcaccctaaagagagcctgagcacccctccatacataggtggagtggaaggagttggtggctggaagctgtcagctgacagcatcctgacaactaggcaatgaatctgttcttaaaagagaagcacagctccatgtctgctatactctccaaagactagaaaatcagttcctctgggctgttcagagtttagctctgttttgactacaatgccaaggtgtgatcctttggtggaatttactgccttaaggtagaggaatgaagggaggacaatggaagaaatatgcaggaaaacttggttcatttgatttccttctgtttagggcatgtgctagatggcaggacatggaagaatagggcactaaaatttgagggatcataacaacttctcatgtcgaaagtgaagcccagaccaggcacagtggctcatgcctgtaatccagcactttgggagggggatagcgggaggatagcttgagaccagtctatataagcctgggcaacatggtgagaccccatctctaataaaaataaaattttagccaggcatggcagtgcacctgcagtcacagttactctggtggttgaggcagaattgcttgagcccaggagttagaggctgcagtgggctataatcgtgccattgcactccagcctaggcaacagagcaagatgctatggaaggaaagaaagagagagagagaggaaggaaggggagagggagggagggagggaggaaggaaggggagagggagggagggaagaaggaaggaagaaaggaaggaaggagggagggaggaagggaaagagaggaaaaaagagagagaaaaaaagaaaagaaggagggaaggaaagaaaagaaagagagagaaaggtaagaaggaaggaagaaggaaggaaggaaagaaagaagaaagcaagcaagaaagggagggagagaggaaggaaggaaggagggaggaagggaaagaggaaaaaagagagagaaaaaaggagggaaggaaagaaaaagagaaaggaaagaaggaaggaagaaggaaggaaggaaagaaagagagaaagaagaaagcaagcaagaagggagggagggagagaggaaggaaggaagggagggagggagggaaaacaatggagagagggagggaagagaaagacaaaggagaggaggagaggtgaggagaggagagaaagaagaagaaagagagaggagcccagagaggttgtgtgtcatcagagatcacccagagatcgcagggctgaggtggagccccagggctcctgacagcaacacccctctcctgacacagaatgggcattgttacatcagtctccttcaccccatactctacacaataaagaaaatctgtggctccagaacttttatgttcttgcttaaatcttccaaactgaaaacgatcctgaggttccctacaccataccccgccccaccacatccttcatctagacacatcctgggtctagaacgtatcaggagacagaggtgtagaaccacagccagcttccctaaacttccactaatctccggcttgcttttggttataatgttgtgcagatataaattgacaaagtcatgagaagcctctcttctaactctgcagtttgtcatcctgacaccaacagaaaatcaggacatcattaattctctacacttattgatttggaacctccattgtaaggccggctgctttactctccctcctcctcctcctcctcctccttttcctcctcctcctcctcctcctcctcctccttttcctcctccttctcctgtccctcttcccccatctccccgttctcctcctgtttcccctccccctcctcatagttttcagggtcggagtcctaggccactctattgcaacagctaccaaagagaaaggggctgaatctgtgtgcatgtgaggccacaacctctagaccccagtgacttaggggcctccctgcctcccctctagctcttcgccagtcattgcctgaactcggctttcctggaccttaggggataaatagtgtggtccagcactgccctgggtgagctgagtcatgcccttggcagggtcgaggagctcccgtgaggagaccaatcgcctagcgtgagtcttcttccgggattgctcgccctctgccccctaggtgccgggcgccgcccgtccccacctccatcagaactcgggtcatctgcggagccttggctgcggcccggtacctgggtgtgactccgccactaacattttcccagcaggaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaagtaagtgcttttatcaagggcctggactgtcttttaaacatatttttttctcacttgtacattaaagggaaatgtatttctgtctagaaaaggagaccgggagaggaatgagactgtgcggtattcaggcttggtttaaactagggcatgcacactgcatagctattttcttcaggcagcatgtggccaaaaaacatgcgtgtgtagctgactgttttgagctttgtttattttaagtactgtatactgagggattttgttcaagcaaaggagtaccagctttatatgcagccacagatgcctctcttgcttggtagtgctagatttagagctcaaaattttccttttcagcaagaactagaagttccctagtagtattttttcccctcatgcctgtttgcactgtgcagaattcttagagaacacggctttgcaaatgttctgcggcagtctcaggatagcacggtatgtcagcagatatgggtcccgggcctgtttgcttagctatgctttcttaatgcaggttcttgctttacacgatttcagacaataactcagtattttcatgatcacagctgaatatacgccacggatggatgtgtatttttcttcctctcttgcagattttttttaaccaaaacacacacacacacacgcgcacacacacatacacacacacacagaaatacaaaataaaactggatttggtagcattgtatttgtcttaaaattctggatagggattatgctgggtcactctggtccacagcagcctcatgaactactctgaattcgatgacagaccctgaaatgaggggtctgtgacaccaactcagcctggcttggatgttgtagatgggagcatggaccagtcattccttttcaactgggccactatttattgagcgcctactgtgtaccagatatagtcaaaaaatgagagatacagctgttagcaaacaggtctctggcctcctggaggttttattctagctgtgagaaggagtgtcagaaaatgaagaacccacacaagtgtagaacacaatgtaaagccctaggaagtgctaagaagagaggacaggggaaggaaggtggagaagagagcgccaggaacgtcctgtgtgtacctgccctgccttgtacttccgcctctgggtacaatctaaaaacccatgctgtctctctgaacttgcgtaaaaaaatagcccagaggtcaccaactcatgctcccttgcaagtttattttatttggctgccggtgctttttgattttttaggtttgattttattaatgattttttaaataaaaacaggcaattttatgtaaaaattcagaatcttagcttctcttgaaaaaaatcaaaagctcctacagtcctgggcccaccctctgcttagccacagagctgagtgaggagggccctgttaggccggagggcatatgaccttcagatcctcacaactcctacttagctcacctcctctgaaggcagctgtgttttagcctattttgttgctggccctacaatcattcgttacttctcccagggcagcaatgcttctggtgtcagggaccccaccccccttactggatgggccctgtggatgcttcctcctctggctttctctcccagtcattttattgaggtttgcctctccttgagggctgcaaggggtggtgaaggtgccaagctatcagagtcccaggccaagtcacagaagctgtctgtcgaagaatgagccctgtccttctgcaatcccagattccttttgcctagcctagtgggacaggggactgaatgtggatgcacaaaatctagtttctttctttttttcttttatttttttgagatggagtctcactctatcacccagactggagtgcgatagcgcggccttggctcactgcaacttccgcctcccaggttcaagcaattctccagcctcagcctcagcctcctgagtagctgggattaccagtgcctgccaacacacccagctaatttttgtatttttaatagagatggggtttcaccatgttggccaggctggtctcgaactcctgacctcaggtgatccgcccaccttggcctcccaaagtgctgagattacaggcgtgagccaccatgcctggccacaaaatctagtttctttctacttattatattcacaggtctaaatagctaagatgcttttggagttacgggttcattacactcctgcctaattaaaacccagccgatgctctggttatttcctcttttctcccttatacaattccacccacaaagtccttctcagactctttcttccccaaatggaattagctgaagcgcatgttattttgctccagttactgtttatttatttccatgtggctgttcagagtagaatgctattacctgacaggtaggtgtagaaattcagcaatcgcaagaggcagtgtcattcatccaagctggacccagtgctctgggggggtacattccacggggtccttggcttgacttgtaagaatctcagcatccagcagtatcctcctcctgtttctgctgattcaaccaatgttggtctagaattcactcccttaacacacagaatatttccaaatgtgcatcactatcagaaccatacacctgcgagccctctactcagcatataagtgtttcacttacactcatcacccttccttactccatgatagataataggtttttctctgggcaatgccttcccctgctacgtgggtctttcagtagctcacctctgagcatccttcccaggtttctgcccccagtcagtatccgtgtcagtgaggagttgtctgatgctcactcccagggcttgtggttcttctgctgagagtggatctcttcatagctgtcttagggccatgtgtacttacacccaagaactggcagctttagcatcacctgggagctccaaaaagtaaactccagagcccactccagaaatgctgaatcaatatctgcactttaataagatttccaggtaattcatgcagacatttaagttgggaacaccctggcttataccatggcccaagccatgcagaggctttcacagctacctctgggcccattgatcccagcctctcattaaaaactcccttcaccaatgtacagatgtcatttgatcattggttatgagttcccatagtcatacccacgcattttgtaaccttcatcatggatagttacactctccatctataggtaaatataactagcagttggccagactataaaagatccttgggggctaagtcatttattataaaacacctaaatggttactgggggaaagtagtcttgcagtgtagtttaacagtagatgtagaatgtggaaaaactaattaaagtcaataaaagacagttgttgttaaatacactgttaaccaccaatcgaacaagacaaaagtggttaagagctgacacgggagtccagtggccaaccttggttagagttcaactttgcttccagctgcgtaaccttggagaagttatttagcccagtcatttgcaagtctgtctgctcagtaaaatcatctgtggagcttggacatggattttcagctgcttgggatttacctggttcagtagctggtcaaggctcaaacatccgcactttaaaaaaaaaaaaaaatcctggtcattttgatgcacagcccgtttcgggaaccactggcaacctcttggagcctctcattcctcctttcttgaatgaggacagtaacagagaagcctcctgagtttttgagagaactgaacggtagcatgaagggaaggaagagtcctgccacatgcctacacatagttgttgctcacttgttggtagtgatgatgacggtgatgaccatggtggtggtgatggcgaggatgcaggctccatttacacactcactgaataaactcaaatctagcctcctttatttctcaaatacaagccttactttatgtacacatctgtttagaagcccacaaacatagattgtcagaataaaccctattattttattatggctgctgatagctctgttctaagcttgattccaccttttaataactctgacttagttttgttccgtgccttcagttttccaagagctttaaatatatcatcaactttgacattccctccaatgttaagagatgtgcattgggaggccgaggagcagggtggatcacctgaggtcaggagttcaagaccagcctggccaatatggtgaaaccccatctctactaaaaatacaaaaaaattagccaggcattgtggcaggtgcctgtaatcccagctactggggaagctgaggcagaagagtcgcctgaacctggaaggcagaggttgcagtgagccaagatcatgccattgcactccagcctggacaacaagagtgaaattccgtctcagaaaaaaaaaaagacagatatgcagagatatcacatgaatacattcattttataactgaggaaacaggcttagagaagtgaggggcttgcttaaagctgcccactgtgcaaccttgagtgaggtttagatctctggactctgagtctgtgctgactgctagtctttctatctaaagctcatattaagggaaattttccaggcaaatcttgattgactggtaatgaatatccccagattagatgaacaattgcctgggaagcgtctttgtttcctgagtcaggctccaatttagtcttatcgtcaggtcttttcaaatcccaggagaccaaacacagaagatcttttttttccagtggagaatcaatgaccactgagagtaaaataatgaagccccacttaagtgaaaataacacaggtaattgttagagagaagaaatatggcatggcccagtaactctatattgtagcacttgtatttgcaatttttcatgaattcgttcaggtaattaattttatgaaataatgccaggtggcatggttccactttcccagccctcctggaaatatctgacttactagacaagcacttttactggaaagttatgtcaaggagttcaggagaatgtactggaaaacacacaaatcaaacattaagtcaatatacaatctgctgacaccatactagcaggaacctcaacaaaagcccccttgcctcccccaccattgtcagcagagagttcagccttccagctttcttagatatgatatacgaaagtgtatgaggagccaggaatttcctcagctgcacctcagtttaattaccatctctcttcgcttccagcactggtcgtaatgcccagagagatggctactctctacttttgaaaaccacagaaccaactgtaactgtatctatctaaacttgtctttgctagagtcatttatacaccctaaccttcttttatgtcactagaagaagggatgttgaatcacccccactaggggctgccatcttggtttgctcccctcatcaccttttctattgttgactaaggatagctttgtcattccttgctgggctgtgcaatagctactttacactcagtccagtgatccataattacaagtttagaagaggaaacacaatgccctagtcaattaagacaattagatgttagaacacaaactctatgttatttaagaattagggcatcaaaaacttgacaagtgtgcccaatgtgatccaaggagctaacccaactatgctaatacctcatctggaattctacttccaagcaaaagagtttgaaataaaaatagctggagagagtcaagtactgttccaggtactacattaccttattttgataacttcagtcaccgttgcataaaataagatttattcaggccgggcctggtggctcatgcctgtaatcccagcacttttggaggctgaggtgggtggatcacctaaggtcaggagttcaagaccagcctggccaacatggtgaaaccccctctctaccaaaaatacaaaaattagctggatatggttgcacacctgtaatcccagctactcaggaggctgaggcagaagaatcacttgaacccaggaggcagaggttgcagtgagccaagatcgcaccactgcactccagcctgggtgacaagagtgaaactctgtctaaaaaaaaaaaaaaaaacaagatttattcaataaatatgtatttttcaacagatttattcataaatatttgtgacgtggctcttctgggccatgcactgtgccaggtgcaggagatgacatgatgagccaagccagccccagcttattaacaggactccagtttagtgaaggagaaaagccattccactcacaggaaatgtggatattctgaagggaaagaagacagctctatgagcatgcatgagggaggagggaggactttatttggactgaagttaaggaactaaaatgtgagttgtagttaattaggtgagaaggaaggatttcttttccttattataaaaagttatgtcatctgcttccaagaaaatctgacctaattatttaatatgaagaggtatgaaaaataaaacaagctaaagtttgtcatggctaaaactgtccttttaatctttaaagtgtgctgctcaccatctcacacaccatcttctattattggataggtaactcacgctctaggtccatagtaggccctcgtaaatgttttgagattctttaaggcaaagaataatgattggctgtttgctttatcatacaatccaaaatagtaaatgtgaaaagtgagtatgtgggttttgaaactgtgtttgtcattgaagatctcatggagcactgtgaaaagggagcattatagttcaagccaagtaaaaacatagtaaagatgaacatcggctgggtacggtggttcacacctgtaatcccagcactttgggaggccaaggcagatggatcacctgaggtcaggagttcaagaccagcctggccaacatggtgaaaccctgtcgctactaaaaatacaaaattagccagccgtggtggcaggcgcctgtaatcccagctactcgggaggctgaagcaggagaatcgcttgaacctgggaggcagaggttgcagtgagccaagattgcgccactgcactctagcctgggcaaaaagagggaaacttcatctcaaaaaaaaaaaaaaaaagaaaagaaaagatgaacatcaaagtaatttctgattaataatatcatggtgaaatactggaataattaataagtagtacattagcttaatgtgtgccaagggagtgataagataagtaaaagctacttcactaaaagcaatatttcctagaacagaacctgctattcttcatcccccttctctgcatctggcttcccctcccccaacaacctccctcacaaaaaagaaagaaagtaaggtatataaaccatgtattgacaatcacttattcaactctatttatgccaagtaagacttaattttaacttgagagctaagcattttagaatattgatacagaaatcaggaaacaaaaaagaaaaatgcccactctctctccgttcccaaattaacagttagtgtcacaatgattgttattagatactcactcatccttttcatcattcattcattcattctgtgagccttaactgattattgtactaagggctgtggggccacccgaatgcacaagacacaaagagatgttcacacaaatacagtgtatatgttaattaatattccaaagtgagctattagtagttggtcatgaaagagttctgtggtcaagtaaatttgggaaacaccaagttaaacagaattgatctgatgtatttgctgcaggacctctctgagtctaatatgtggcaagaaggggattttgaaacacagcatttatatcacatttttctaacctatcacctagtaactcatgattagttgggtacactctgggaatcactaacgtaggcagtaaaacagggttctgccttcaaggtaagaaggctgatattagtaaggcagattagggcccgaagcaagaggcatggggtttgggtgggtcagattcccactctgatggaggggtagcagcaaacctccagtggagaggaggtgaaaaaccaaaaccaagcaccatcctctagaccaagcagacttgatgggggatttattttatttgtgtggttaatgttaacactattaattattactagtaaaagcagtgtgttgaggtgaccctcaacagagtaccaggaattttagcacaagggctaaagagtatagactctcagctcagagtttttaggtttgtatccatgttttaccactgctgacttagatgacttgaggcaagttattttgcctctctatgtcttaatttattcatatgcaattagaaataagaagaagaatagtggtattcagtgggataacatgggtgaagcactcttcacattcctggcacttggcaggttttcattaagtgctcattaattattaaatgctcattagtcttcccaatcctatgaatctgatattgtcttctctattttatagataataaaattgaaaatcagaaagtttaatgcgatgttagaattacacagtaaaggccaggcgtggtggctcacgcctgtaatctcagcactgtgggaggccaaggcaggtggatcacctgaggtcatgagtttgagaccagcctggccaacatggtgaaaccctgtctctactaaaaatacaaaaaaattagccgggtgtggtggcacatggcctgtagtcccagctactcgggaggctaaggcatgagaatcgcttgaacctgggaggcggaggttgcagtgagccgagattgtaccactgcacttcagcctgggcaaaagagtgagactccatctcaaaaaaataaaaaataaaaaaaataaaaaaataaaaaaaaagaattacccattaaaaagtagtggagctagcattcaaacccacattagtttaaccccaagccccatgtttttctagtgtagcgtgccaataaagcgactgagaggcgtatggataccagattatggaactaattatatatttcatttacaggtagatcctggtcaagaatgtctccaaaactggattaagccagtgtacttgaatgggaatatagacaaccaggacagacttggaatgttttttaatgtattggcccagcaaagctagaaatcctccactttacctaacagaagataattagaattaaaaatggcactaactgaaaacgtacttgttaaattgcctgtgcttatagagttgttgttggccctgtcgtttttggttggcaaaaagagacatatttttatttgttggagctaacagaggcaaatgtcttgagttgggcaacagttacattgctgatggtagggaatggcttctgtagggtgaaagcttggatagaaaatccctacatctagcagtgggaagtgcaccccagtttgttttttttgttttgttttgttttgtttttgtttttaccaattcaactcttagtgaaatatgaatgatctcttttaccttagcccccagatatgggaaaaagtcagcactctcaaggaaaacaaaacaaacaatagtatgcttcagtctgcactattcttctacaaaaaatgtccactttggccaggagcagcagctcaacctgtaattccagcaccttgggaggcagaggaggggggatcacctaaggttaggacttcgagaccagcctggccgacatggcgaaaccctgtctctactaaaaatacaaacattagccaggtgtggtggtgcatgcctgtagtcccagctactcaggaggctgaggcaggagaatcacttgaactcaggaggtggaggttgcagtgagctgagatcgcagtgctgcgctccagcctgggcaacagagtgagactccatgtccaaaaaaaaaaaccgttcaatatataatttttagagttataaaacatggaaagaagcaagataatatgataaataaatagaaaaaatactatcaacagaagcaggcccacagatggatcagatactggaactagcagagaaagactttaaaacatctactgtaaatatattcaaggatgttcagaaaaagatggccagaatgaataaatagttgggggattacaacagagaaatgggagccataaaaaagaaacaaatgaaattctagagtaaaaataaacatctgatgtaaataatggattgaataggcttaacagcagaacagaaactgaaagaaaagattagtgaacttaaagaatggttaatagaaattattcaaactaaagcacagggaaaaaaaatatttaaaaacactttacccatcatcaatcagtgacctattaaatggcctaaaatgtgagtagttgcaatcctagaataatgagagagagaatgggccagaaaacatatttaaagaaataacagctgaaatatatgggatacaatgagaaaatatcaatctatagattcaagaatctcagtgaattctaagtagtagagacacaaataaaaccacacccaggcacatcatagtcaaacttctgaaaaccaaagataaagaaaatataaaagcaaccacaggaaaaaatgatatgttgcatatagaggaataatgacaaaaaattatggctgacttcttatcagaacaatgaatgcctaaaggcaatggaaaggcatccccagttgagaaagaatttgtggaggatgtatacaccatgctctgaggacagataatagagggtacaatctggttaagggatcaagacaggctttctgaagaaagaactatctgaactaagatcagaagcgtgagatgttaagtaggcactgagaagggaagatgttcctggtatatgcaaagcccccattgcaaaagaaaacacttcacgtggaaagaccgaaaagtggcaagataggtgcaacacagggagcaaggaaaagagatgagccacactagccattataggacacaatatggattattgttttcattctaagaaaaataagattttcaagtgttttaagctgtgcagatcacttctgctgtcatgaagcagcaaatttgtgtttgaaaaattctggataaagtagagaggcaccagagtagctgaggagataccaggaggccataggagtggctcaggtgagaaatgatggtggcttggactagttgatggtatctgtgaagatggagagaggtggacagatgtaaggttgatttagtgatttagtagatagaagtcataggacttagtcattgcttggatgtgggagatgagggacacaggggtatcaagactgacttgtaggtttcatctagttgggtggatgaaggtgccatttactgatgaaggaaactgtgaaaaggagcaagaattatttatttttattcaacaagcattcacatagtgcctattgtgtgccaagcactattctaagaaagtttgcaaacattaacctcttttacaagagtgagaggttggtacaatttttgccccagttttacagatgaggaaattaagaaattaattaacttgcccaaagcattaattggtaaatgctgaagtaggattggaacccagacagtgtggctccagggaacaagttcttgggctctgcactaggttgcttacaaggaagtataatgaggatgagtcgcaggagactgaggcattcaagtggccatagggacctggaactgataagagaagttatggctagtgatgaatatttgaaaattattggcataggaaaagtagtttgtcttgatgtaaagaaattgcctttttttccccttaaacaggagccttatgtctagagctccagttctgttgctgtgctgtgagtagcatcccaagcatgttctttgaagagggcagaacctttttcctgaggagtatgacttccatgtcttcctcgtcggatttgttctcttctatttgctctttctcacatgtttgctgccccctagtggcccttggaagctctgccccaagtgcaaggcagtttaaacccttgggggttaaatgcagctggtgcagagtgacctggctgcccctggtacaggaccgggcagctctgaactccaggaacatgtggcacggactccaccccaattacatggtaccttcagttaaacacacgggataagcacaccagcaggggacaaactggaaagcgttttgttctgtgacagtgatgttatttaccaagtggctactgacaaagcgaaaattcagatttcagtggttgctgaattttggccatatcaatcatatctttattgtgacagtaaggggcccatcaatgagtgcttctgtctcataacaaaagagtaactggcaggtttttgctttgttttgttttttattttttattttttattttttttaatttttcagtgttacttatttcttgcttaaccaaattagtcagtaaaaaattacaaacctggtccagtgcagtggtttatgcctgtaatcccagctctgtgtgaagccaaggcaggagaatcacttgagaccaggagttcaagaccagcctggacagtatggtgaaaccccgtctctactaaaaacacaaaaattagccaagcatggtggaacacacctgtaatcccagctacttgggaggctgaggcatgagaattgcttgaacccaggagatggaggttgcagtgagctgagattgcgccactacactccaccctgggtgacagaatgagacactgtctcaaaaaatatatatatatgtatgtgtgcgtgtgtgtgtgtgtgtgtataacctaaagaaatcaataaatattgaggctacaagaaaaaagaaaacaatggctataattcattgaatgatatctgtatatcagccactttatagatttcatctaatttaacattcacagcagcttacaaggtattgatgatattatttcacatatgatgaaactgaggctgcagggataagtcctgggctttcccaggaccctatagctatggaggcagagatgagattcagacccagtcttcatgattttaaaactatgttctttccctggtgttatgatgccttcaaatgaatctataattacttacttagcagttacctcacaaaaactaagctatgaaaagtagttttctcctccaaagagtcttcaatgcagtaatgaggttaacatgcattcctagggggaaacaaactattaaaaataataactttaccatttaaaatgccatttcctcctttgcttcctctgaatagctactataaatagaccggagatgttctataagtaaagtatacagccctgggccactatccttgtccatttgcacttccaccttctccctacttcccagtccccaggccctcctgccattcaatcacatcctcagactcttacatgacacatatatggcttgatctgagtacaaggaggtcgcttccacccatttatgaacagtcacatcacatgtctgttgaaaacagaaggctacacatttgtatgtaatagttatatttaaaagaattgatatcaaaatgacaagagtggttatgatggctagcaggattttgcataatttcttcttatctgcattttccgcaattacttacctgtgcgatgaaaagaatacagttcaatttccacattctaaagagagaaaaattgttatttttctcagagaggaaacaggaattttattgaagcatctaaaagcttcaaaacttcaaagatttttgcctcttaaggacatagagatgggggttttcattaacttattaaacacaaaagaattaaagaaaattacaaatattcctgtcagcatagcactgcagaacaagccatggaattgctaaaataatctgagctctgtttgttgttgttgttgttgtttgagatggagtctcactctgtcactcaggctggagtgcaatggtgccatcttggctcactacaacctccgcctcccagtttcaagcaattctcatgcctcagcctcccgagtagctgggactacaggcgtgtgccactatggccggctaatttttatattttcagtagagacagggtttcaccatattggccaggctggtcttgaactcctgaccttgtgatccgcccgcctcagcctcccaaagtgctgggattacaggcataagccactgctcctggccctgagctctgttaataggaaggaaaacataaggagaaatactaggaaacagagaagaagggagggaggaaggtgggaaggagacaaaaggaagggagggagggagagagaggggaccaaagaaagagaaagaagaagaggctgcaggatttgttgtattctttctagcattattattgtttttatttaagttcatgtttctccactccttacctcttaattttattatttaccattcacaaatcacaaagtaatgataaaaatgcacaaatctctaatttttaaaaattttacttgacaaataataactgtgggattatcccaacaaatatatatttgcgggatgaaatgttatgtttttatatacgtttatattgtggaatgattcagacaagctaattaatatatccatccttacatagttattttttgtggtgagaacatttaaaatctactgtttttgcagttttgaaatatgcaacaccttattattaactacagtcaccatacttcgcaatagatctctaaaacttattctaactgacggaaacattataccttttgaccaacatctccccatccctcccccttcccccagcctctggtaactaccattctactctctgcttctgtgaatttgacttttttagattccacatataagtgagatcatgcagcatatgtctttctgtgcctggctatgttgcttaacatataacctgaacatcctccacgttcatccaggttattgcaaataacggaattttactccttttaaagattgaatagtattccattttctatgtataccacactgactttagccataaatctctacattttgcttttatgtttgtttttcttcaatagagcatctgtcttttgtaaaaaataattactattgtcagccaggcgcggtggctcacgcctgtaatctcagcactttgggaggccaaggcgggcagatcacaaggtcaggagaccaagaccatcctggctaacacagtgaaccccgtctctactaaaaatacaaaaaattagccaggtgtggtggcgggcacctgtagtctcagttactccggtggctgaggcaggagaatggcgtgaacccaggaggcggagcttgcagtgagccgagatcgcaccactgcactccagcccgggcgacagagtgagactcggtttaaaaaaaaaaaaaaaaaaaaattgctattgtcgagaaatagttcttgcagtctgcttccccttctaaaatatctgaggataattagtctagatgacttggaatactgaatttgctcctccattttttcttatttaccgtgaaaacttgataatatggatgcaaaagtatattttcatatagtcaagaaattaggaaaacaaaatggacagaaagtaggtcaggatgcactagcttctatcatggaaacaaacaaccctcatattttagtggcttaaacaggtgaccatgttttgctcattgtcctagtctatgggtcgggagggtagctctgctcattctagccgctcttggtcctggtgacagccaccatctctgaggttgccagtttccatctcagaggtaaggagaattctggggttctgcacagccatttaaacacctcagcatgaaagctacacctactctgcttacaactcattggccagaattggtcccatggccctcctaaccacagcgggccaggaagtgtcatcctgccttgtgctgggtagctgagagcagacagcctaaagaagagcacagattttattacagaagcataaaaagagaagctataatatcagataacataagtttatgttgaaatgtataaaattgttcatactttgctatcttgacctacaaaaatggcaatttcataaggttcatgctaataagtttaaaacaccttttgttgtcttttttctgacaccactcctgacaccaaacatctggtcttccacactaattctccagttccctgagaccaactgggtatccaacaattcaaatcaattctggcactcactcctggagttagcccaaatcctacaggttaaaggcacattctcacaaggctgctcccacttcaggcatcagccgaaaacagggttcccaggattcccatgcttttgcccaagcaactacaaatttgaaggttcccaaaactcccccctcaggttcaatgatctgctagaatgacttataaaacacagggaagaactatacttactatgacagcttctcatcaagggtacaaatgaacagccagatgaagaggaaacttgagggggggtgtggattctggagggtggggtgcaccaccctcccagcacccaggtgtattcaccagctcgggagcacccctgggccacatcatttagggttttttatggaggctgcattatgtaggcatgattgattaaatcactggccattgattgttggatcagtctctaccccttcccattctcccaaggtcaaggggcgggctaaaaatttccaccctcttgtcacatggttgtttcctctgttgacagccccccatcctgaagctgtctagggacctaccaagagctacctcattaccataaactctggtaggggtgaaggggctgattatgagtaacaaaagacacttctctcactcaggaagtgtttttttgtttgttttgttttgttttcattttttgagacagagtctcactctgtcactcaggctggagtgcagtggtgcgatcttggctcactgcgtcctccgcctcccgggttcaagcaattctctgcctcagcctcctgagtagctgggcttacaggcatctgccaccacgcccagctaattttttgtatttttaatagagacggagtttcaccatcttggccaggctggtcttgaactcccgacctcatgatccacccgcctcggcctcccaaagtgctgggattacaggcgtgagccaccgtgcccggcctcaggaaatgttttaagaacttctatgccaggaactaggaacaaataaagaccaaataaaatatatatttttattataccgcacacctccttcaagaataaatgtaaataaatatcacctaacaacagaaaaattctcaaactggaccaaactacaaaattcatctatattctatttaaaagagacacgcaaaaggaatgattaaaagtaaagacataaaagtaaaataaataaatgtcagcttaatatgaaatctagtgagatttgaggaggagaagtgtttaatgggacaaagttgattattctgtattgatgaagttataatctacagtgacaaaggaccatgatcctctacactcctaatagtatagaatcaaaataggtaaagcaaaaactgctagaagttagcagaaatgtatgtaattgtgttgggagttttaattcattattttgcacataaaaaagataaataatattacataaaatcaaataatatttacaattaaaacttgtactgaccattttgccatgaaatagactatgtcatcattgcaaggatctataaagcatctatacaattagcaatatactactggggcatgagaacatcctcaataaatttcaaaaaggagaaattattgaaggcacattttccgatcacaatacaattagacattaatgatttttaaaatttcaaacattttcagattgaaaagtactattggccaaaggggaaattgaagccataatttgactatttaggaaataatgtcaatataataattatacattaaaacttagcagatgtgactaaaattatttacagggaaaaattcacagttctgtatgtttttattatttaagatgaaagaaaagaaaataactgtgttcaagtaaaaaaaaattagaaaaccctcagccaaagaaacctagggaaagaaaaattaaataactaaaatataagaagaaattaataaactataaacaaaatatagtgaaacagtggcattgataaataaatctaaaaatatttacttgggggaccaaacactctggcatagctaattaagagaaaacaaatattcatgattagaatcagaaaaggaatataaaattatgtatagttcaaagagaaatattaatagaaatttttatgttcagaattttaataatatatttgaaagacttgatgagttaatttccttagaaaattaccatacttaagaagtagaaaatttcaaaacactgaagttatgaacataactataaaacttgccagataatttttaatgaagttttcagaaccacaccatttcacaaatgaatactgataaactttcaagcagtacaaaattcacctgatagttatcacagacaaatatagaacacttgccacttcatattggtgctagaatccctttaaattattagtaaatcaaaaccaacaacttataatttacgcatttattttaaaatattcattgagtctctctaaagtgcaagagactctactaggcatcctgtgtgtgcagagtctctgccctcagggtggttactttctcctcggggaaacagacatttccaactcagctacagaattagttacataagccaatgagataaatcctagaaggagactcgcagtgttctgtaacagtgtgtggcagggatccttacacatggctcagtggagaagggctgtagtttagagataggccaccaagatttgaatcaaagatctgcagcctagcagccttattccctgtgaaacctttaacccagaggctctcacctgggggtgattttgtcccccgcggacatttggcaatgtctggagacatgtttcattgtcatgacttggacatgctactggacctagtgggcagaggccggggatgcagctgcacatcccactgtgccctggacagcctcacagcaaagctgtatctgccccaaaatgttaccagtgccaacactgagaaacactcctctgtaggatgatgaatccctgggggctcctgagagtcagatccacatttctaactgtccactgggcttttccacttcatgtgcctcaggcatgacaaactccaaatgtgtcatcttctcctgacctgtgttttgttgttgttgttgttgtttgtttgtttgtttttttaacaagatcttgctctgtcacccaggctggagtgcagtagtgtgatcatggctcactgcagcttcaacctcctgggctcaagtgatcctcccacctcagcctcctgagtagctactgggactaccagtgtgcgccaccaacccttgctgatttttctattttctattttttgtagagatggggtcttggtatgttgcctaggcttatgttcatttttttaagtaaacagtgccaccctctacccactctctcatgtcagagctcagagtgccattcttaattcatcctctccctcaccactgaaatatttaataaagttctgaccatctacctcttgacatctctggaaaccatctactgctttcctttgtcaggcttctacttacttcttcagtttgcctgccattcatacaccttgccatctcctacaacaagcatgctggaaatattctctgttttagttgtactgaatacagcacagctggcatgtgccatgctcctattggccacagaaccctcacatattctgctctttttgtctgcagcagtttgaagttgcccccgatccctttccctgacacacacttcactggatgagttgattcctccaggaggttttctatgagacaaggcctgggtgcccctcaaatgcacgcccatggcatttcactaacatagaataacactctattgtcggaaccagaaagacacatgtgaaattcacacttgaagcatatttgggttaggaagacagtttcaatataggagtgaaggaagctggagaggatgattggagtgctggaggaaataaacgaattgaaaggcaagaccatccatctgggaataccccaccacagagcctacagaataaccaggaagtagaaaactggggcattcctagagcctttttaactgttgtcaaaagtctaggctgtctgataacacacaagtagtctaatgcatgcaagaatacaaagctgggggcgggaagtgagggtagggttacctctgaggagacaattggcaatgtctggaggcattttttggtttttgcaattgggtgactgctactgaaatctgatgtgtagaagctagaaaccctgcaatgcatgggacaaccgccataacaaagaattatctggctcaaaatgtaaaacaaggttgagaagccgtgctttaacttaatatttctcagcctctatatcttcatctctgaaataggaatgtccacattagcattgttgtaagccctgttactagaatatagtaagtgctcaataattgttggatttttttcacttacattcttttgaaattctgtgtgttatctgttgcttaataataaaccataacaaatcagccctaaaatttagtgactcaaaacagcaatcatttaatagtctctcgtggtttctgccggtcagtcattcagcagcagcttggctggcaggtttagacttcggatctcttagaaggttgtaagtcagatgtcagctggggctgctgtcatctgatgggttgactagggcaggaggacccacttccaatgtgtctcactagtgtggctggcaaactagggaaactgtcagatggaggtatcagctagcaactcgggctctccacaggactgcatgtgcatcctcaaagcatggcagctgcctctccacaaacaagggagccaggagactgaggtagaagctgcagtgcctttatgacttagcctgagaagtcacacattgttactcctgctgaattctactggtcacactgacaagctctggttcagtgtggaagggcacttcataatgctgtgaacatcaggtggtaaggataattgagaccatctcaggggctggcaaaaactctaccaaaacaaaccaaggtattagaaaaaatcaatatagcatttgcagatgtttaattattgaactaaaaaattgcactgattcaacttaaatattattagaattaaaaagagttaaataatgtggcaatatacaaaataagtatggtagatatcaatagatttcacttacaccagtgatatcaaattggaaaatatgaaagtaagaaaatcttagttataaagtacctagagataactttgaaaagaagtatgtggaaactctctgaagaaaaccataaaatttcactaaaggacctgaaagatgggaagaaattgagaggtacatcatgtggctggatggaaacactgagctttagataacttcacttctctacaaattaatatacaggtttaatgcaaatctaaaaatgtcaaggagatagatttatataatttgatgtacatgtgttgtatgtatatatatttcattctaaaattccacaaattatctagaagactgagtggaaaacttaaccaagaaactttggggaaagaagtgtggatgtatgtacatccacattgaacattaatgtatgtttaaaaagtaattgacaacatcatatggaatgagcaaaaactggaaatattccctttgagaactggaacaagaaaaggatacaactctcacctattcaacatagtactggaagtgctagccaaagcagttaggcaagagaaagaaatgaaaggggcatccaaacaggaaaagaagaagtcgaactctttcttcccgaattatatgattctgtacttagaaaaccctaaggactctgtcaaaaggctattagaactgataaacgattttagcaaggttgtagggtacaaaatcaatggacaaaaatcagtagcatttctatacatgttcaaactgagagccaaattaagaatgcaatccaatttacaatagattaaaaaattgagatatctaggaatacatctaaccaaagaagtgaaagatttgtacaaggagaactacaaaacactgataaaataaatcatggatgacggaatcaaatagaaaaacatcccatgctcgtggattgaaagaatcagtattattaaaatggccgtatttcacaaagcaatccacagatacaacactattcttatcaaactatcagtgtcattttttacagaattggaaaaaactatgttaaaattcatatggaaccaaaaagagcttgaatagccaaagaaatcctaagcaaaaagaacaacactggaggcatcacattacctgacttcaaactgtgttataaggctacagtaaccaaaacagcacagtacttctacaaaaacagacccagaccaatgcaacagagtagggcacccagaaataaggccacccccctacagtcatgtaatctccaacaaaattgacaaaaataaacaatagggaaaggagaccctaataaatgatactggaaaaactggctagtcacaagcagaagaatgaaactgaatccctatctctcaccatatgcaaaaattaactcaagatggattaaagatttaaattctcaaactataagaatcctagaagaaaacctaggaaacaccattctggacatcagccttaggaaagaatttataagtcctcaaaagcaattgcaacaaaaacaaaagttgacaagtggaacctattaaactaaagagcttctgcatggcaaaagaaactatcaacagagtgaatagacaacctacagaatgggagaaaatatttgcaaattatgcatccaacaaaagtctaatatctaaaatctataaaaacttaattgaacaagcaaaaaacaaccccattaaaaaatgggcaaaagacatgaacagacacttctcaaaagaagacatataagcagccagcaaacatatgaagaaatgctccgtgtcactaatcatcagagaaatgcaaatcaaaaccagaatgagataccatctcacatcagtcaggatggctattattagggtcaaaaaacagatgatggcatggctgtggagaaaagggaacatttatacactgctggtgggaatgtaaattagttcagccactgtgaagagcagtttggagatttccaaaagaacttaaaacagagctatcgtttgtcccagcaatcccattactctgtgtatttccaaaagaaaacaaaccgttacaccaaaaagacacaggcaaatgcatgatcatcgctgcactattcacaatagcaaagacatgtattcaacctaggtgtccatcagttgtggactgaataaagaaaatgtggtacatatacaccatggaatactaggcagccataaaaaagaatgaatcatgtcctttgcagcaacatgcatgcagcgggaggccattaatactaagcaaattagtgcaggaacagaaaaccaaatactacatgttcttacctacaagtgggagctaaacattgggtactcacagacataaagatggcaacagtagaaactgggttctactagaagggggatggagggagtggggcaagggttgaaaaactaattgctgggtacaatgctcagtacctggttgacaggaacacgtgtaccccaaacctcagaatcacacaatatacccaagcaacaaacctccacgtgtacccctgaatctaaaagttgaaaaaaataaagataaataaataaatagattgaaatggtatgagtgcagcaacataatgacagattagtggaactatataaattgaacagaaattgaccctaatataaatttcgtaaataatagtgatagaataaaaaatatttgagtaaagaatatattaaacaataagtattactaatacaattagttaactactttgaaaaaaactttaagatatatttcctcttttacccatacctcaatccctgatagatttgagtgaaacataaagtatgaaatcataaaaactcaaaagaaaatatggataaataagttagagacagaaatcttttaagcctaaaataacagaatgataacaatggaaaagaaatcaggatatttgacaatataaaatgttgaagttttgtaagttaaaaaaataagcaaaataaaaagataagcaaatattgggaaattgtgtcatatttacaacaacggtggataatttcccattttcccttaatatatgacagaagttgtaaaatatgattcttttttttttttttgagatggagtctctctgtcacccaagctggagtgcggtggcacaatctcggctcactgcaatctccacctcccgggttcaagcgattctcctacctcagcctcctgaatagctgggattgcaggtcgcaccaccacacgcagttaatttttgtatttttagtggagacggggttttgccatgttgaccaggctggtctcgaactcctgacctcagttgatccacccgcctcggcctcccaaagtgctggagaaaagcgcgggtggcggcaggcacggaaaggacgccatgaaggcctcgggtgcactaaaagagtacaaggtggtggtctctctttgcccacccccaaatgccacacactgcccctctactgcatgcgaatctttgcgcctaaatcatgtcgtcgccaagtcccgcttctggtactttgtatctcagttaaagaagatgaagatgacttcaggctggattgtctactgtggacaggtgtttgagaaggtccccctgcgggtaaagaacttcagcgtctggctgctctatgactcccggagctgcacccacaacacatacagggaatactgggacctgaccaccatgggccggcaccgcacccaggcccactgcatccagatcatgaaggtggaggagatcgcagccaacaagtgccgccgggccacgcttcaccaccaagaggcccaacatcttcttttaggtgcaggttcctcgccccgggtgtgccccaaataaactcaggaacgccccgggggagggagggagagagagagagagagagcgagagagagcgcgcagtaaaatcctattacaaaaatagacacgaactatctctccatttattgtttttatttgatacacacttattgagcacctatggtgtaccagccaatgtgatagatgtgagtcacacgtgaggacatgtaaaaactttaaaaagactgtgaaatcaatgagaagatatttactcatgctagaaaacaaaccacaaactaatgaaaagtactgtcattttgcctatcatattaaaaaaattaaaaactatacaactcaatgctgttgaagatgtcctgagacgggcactcagtgcagagggaagtgtccaggggtctctacgtgtgctttgcaagcagtttggtgctcagcatccatggtgtcactgagttatcagggtcctcagagaataacagagcaaagtactcagaaattggtgcaaggaataagctatacagatgttcatttgcagcattatatatatatttaaaatagtgtaaaattaagaatatctttaaaaatccaacaaaaagtttacttgaaatcctatttagtaataccataatatggaataatgtgtagcctttatgaaagaattctcctaagactatttaataaaataaaaatctctcataacataatgttacataagtaaatcacaatgttaatggtatatgcagcatagtatttgttggctgaaaaatacacatgcatgcattgaaaatagaatggaaggaaatctctaatataataatagtgcttatcttggggtgatgacgcttgaggtggtttttggttttctctgaatgcttcttaaaaaatttgttataaactacttgtaattagtaagcattgtttttatcataaaaactgtgaatatggaagaaatggtattaagttttagaaaagtaggggtgagggagagtaatgtagatgcaaatgcactaatcacctccccaaattacggagctgccttgaagcctggtcattaattcatccacactatcttcctccactatttactcaccaagtagtctgttcttatgcgcacgcacacacacacacacacacacactaccctcccaccctcccccactcactccctgcaacaatttcagtcattgttaatttgctggataggtggctgtgggtttattcaatcaaatgctttacagagttttgccaatatcctgctaattgatccacaggccacctctggtgatttatggtgttttatagtgtcagctcttattgaattttcttactagatttttgtggttaaaattgtttcatacattgagatctattatagtgtatggcattcaatacttgtactggaagacagaggcagaggtttaaggaataaggaggtttaaagaatcaattgtgcagaaggccccttatcagatggctctgctctggttcctgttgatgggggcccagtgggaagatgtgaccttttcattttttttcttgtctgtgtaagggatatcagaaatggtaagaaatgatcttacataacaactatgccagggacagtttattttggatcaatctagcagactgactcctagcatagcctgttctttagagttactaaaaggccagggacattgatttccatgtcaagactcataagctctttgtgtgtgggggtcccctgagaattccccttatgtcccagcaagtaaatagagacctccagtgatgctggtcccagtatggcattgattttaaaaggataagtttctcacacagtcgtttgtagaatttaaaaagagactacattttaaaaaatatataggtaataagatactggtcaaaataaaatgcaggtagaaattcacattacaattacttttaaaaatcataagtagcctgttcttttcctgtgtcatgtggaattccatcatctttatgtcattataaattatgcctaatcctgataaaatgtgccttatttatttgatgatactatttatttttgcaagtttaaatgctttaggccaatgcagtcttccctgtccactggcacactccaggtttgaaactagatctgaaactgaagctgactgacgatttatagtacgtacaaaattagctcagctttcctgtctcctgaggagcaagttctttatttggcacatgctccagcttctctgttttcttagttttacttttcctaaagtgaagtcaaccacctgaaccatacagaatgctctgcaaccctccttcactcacggagcttagaaagtgcgttcagcagaaatacaggcgtctctaatcccacttcgccagattatatttgtactcagaaatgtgttggatcttctcagtgttggccagaagcctcatttgggttttctcttggattttcaggatgctcagggctctttggtctcctcctttctctagtcctcctcttctttctctatctaatgtaagaacagattttataatatatgtgaaagagaaatcagttcattcattaggtaaaatgtgaagatgaacaaacctcccttatctcctctccatcctcctactcaggcaatggatgaccctacttcacactttgttgagacaattgcagggatcagaaaagagcttccactgactcccactgccacctgccgccatgacgctgcctccctgcctttatatgacaggtgaacggcccgcatgtccaagcttgtgaaacccaccttatcttgttgttgttgttccgtttggttttgttttaggtgtttagcagcctgaagccatggtttttcgtttctgtctgtactgataagcagataagagggatgaggaaggggctttactggcccaaccaaaaatagaaactaagaacccatgactgtattctccgccatgactgggacccacctgcacaccaggccttgccctttgccacctgctaggatgtctttccagcagcttctctctccctcagttagaccatttccgtaggcatccaccagcaatttctcccagatcttgtcatctcccacttccttctccatttaccacacattgtcttctcccctcttccagcagaacttcttccaagaagcatctggactgcctgaagttccttcctactccctcagtaaagttgttcttgttagaaccaccaaggatctccactttggaaattcccctggcccattttcagccctcatcttctgtgctggacacggttgactgtacctcccaggaaatgcagcttgatgtgcttccaggaagtcatcattccctgttttctttttccaaattcgtgctccttcttgggctctttccctgactcccccagacctttaactgtgggctgcccctgggctcagacctggccctctcctgctatccatacccttcctggtggtcgcatctactcttgtgacttgaaataacatatattggcaggtgacccccaaatgtatatgcccatttcagaccctgcccctgaatgttcccctgaatattcagctcctgcttgaggtcttcaactgggatgtcttataagcatctcaaacttaaaatattccagccaacatccttatctgatcatcagccatttcaatcttcctcatgtcagtgaacagcgattccctccttcctgtttctccggccaaaacctgtggtgtcatccttgactcatcctttctctgcaccccacatccaaacctctagcctcaaaaatagatctggaatctgatcgtctctcggcacatccgcagctcccaccctggttctagcaagcggcagctcccccatcactgcagcggcttcccacctgctcctcctgttcccacccatgcggcccgttctcatcacagaccccagcatgggccttctcaaagcatggaacatgtcacttccctgttcagagcctcagatggctcccagagccccaaccatggcctccgaggctctatgtgatctgatcccccttttgccttctttccccttcccctcctctctctccactccagtcacatggcctccctgccactccccaggtgcacctgcttaagggtgtcaggcttggtctcccctctgcttccagtgctttttcccttgaggtctaagttgtcacttctcctcctcctcctaagtcacccctaggaggtctttcctgaccaccgcatttacaattgcaaccacccacgctccctaactcccttccctgcctcacactccacaccctcatccctttctaatatagattataatttacctaactgtcttgtttgtagtctcctccccattaggattcaagctctgtgaggacagaaatttctgtctgtgtttgctgctgtatctggagtgcctagcatagtccctggcttacaggaagtcagttgcataaatgaatacatccagcagttttcagtgattgagagcaaggacagtgttatttctttgagctgggttagattatatttcctacccatttatttcagattcaacatttggtgtgggcttgaggttgggtattcaatttgtgctatgtgtaagggcattccccttccagctgtggggactctgtgataatgaactgactgaataagttttatttttatgaactaattttgaacaagtagcagacaaagcaaaatgcttctctgtgtccttttttttagggtgtgggagggattaccttacagtttcaattgagtgagaagaagcattttaaataaaatatttgttcataagccagaggccctgcactttcatcagatcctgttgccctctaaagtgtcccatggcatttaggccaaattgcaaatcctctcggtgagctgcaaggttctgcctcatctagagcctaacccgaccatccacgctcttcttttttactatgctggggcctcactagtcttcacttagttccttgaacctgttgggaattcccatcttcatacctttgcacaggctatgcgtctgcctagaatgtgcgccctccttgtccccatttcatttgttctgaagctgatgtgttttctctgcagatagctcctctgccaccttctccaaaatatctcccaccttgattctcttatggcacctgatttttttccttcatggggtatagtaatttgtaagtatatttttattggtgtatttgtttccttgactgtctccctgaaactctatgttgcttgagaacagggaccattgcttgttttgtctaaaccacagcagtgcagcgactattacagtagatgctcagtgggcctttccccttggtcaagaatcaccaagagctcccttcactggggaactcttctgagttagaccatcttctgagacagagcatctgctgaagacagatggtcttcacagctcactggggaggctgaagaggagaaggtcagaatgggattggggtggtctcagcatggaaagggagtggtgagtgaagggaccctggatcctctgataaatctctgtcccagatgctgggtcaggactaggaattcttatcaccttttcccaaaggagtcagatgctccaaggagagagtgcctcctctaggtaacaccagtggtgacagagcccatctgcacttttggtttaatccaagatcctcatggaaatagcatcgtgcaggagtgcagggtcacaagatggagtggcgattccaccactgaacacctgtgaccttacccgtccagtgtcagggaggggcaggaccttgtggatttggtccaaatttactctaggaaatagcaatccactccaaaaaagggcgattaaaatgccgagtcacacagctagttaactgcagaatgacaactagaacctaagttacctcaatcccaggccactgagacgtaagacaagttttgccagcttgtcttttatttgatgaattgtagttcctggtgagcagaaatacaaggagaaaaagttttacaaatttaagcaagagcacaatagcacacttagaagacttttgagaggaggatgagtactcgtgataatcccagtacaatgagaaagccagcaccccgtttctgtgatctgaaatggatctcggctcattccctttacaactttgttggaaagagaacgaacacacaaaggacctcaagacactgccagaaaagaacactttgagacacttgaagaaaagaaccccagccaactatatcctcaggtggacaataacactcttgctcactaggagcaaatgggtttgaggaacagggagaaggcagttaagagaggggaagtctccagttagaggaagactggaaatgtaacccaaatgctgaggttttcatgcattcccgacacagtattctcttttcccgttttgtttggggctgtttctccccccatgaaaattggcatttaagatttttgatggcttaagattctaggatcctgcactcattgactgggggagtggaggtgaggcgatttctgacccgctgcttctcatcacagcagttctgcacccctcacctccgcccacccaagcaagtggcaaagagcactgctgagagtcccttcagcagcctttggccctgtcactgcaggaagccccagcccgaatcatttgcgtcatggccatcactgtctcaggctcagctccaaaacggcatctcctatctcctgtttcctgcagactgagcccctctctgcgacttgttgcaccaggctctccacagctggtgtccaacaatagctgacattgggtggacacctgctgtgtgccaagctctatacatgaattagccctgattttcaaacaactttatcgtggaaatacaattattcctcatttacagatagaaaacctgttattcagaagttgtgcaatatcacaatagcaaggggagagctggagtttaaacccagacctgacttcaaacacaagctctttcaagtctgtagcctcctctccagcctcagctcttctttctctcagtccactctccctcaaatgcactgcagctaacaaccagactgcttgctaagcctcttctagctctgccttcagaattagatcctcctctttctttttctgttctctttctttgctttcttttttttttttttttttttttttttagagagacaaggtctaactatgttgcccaggctagtctcttgtattcctggcctcaagtaatcctcctgccttagcctcccaagtagctgggatttaatattatgggtgtgagccaccatgcttagctcagaattggattcttatggcatcctgcatgtgcaagaactcaaagtcctgccctgcatcctttaagtcccaacatgtctgacactctctccatgagcctttttcgagtccctcatccagcttaactgtgtttcctttccagctgtcatagagcaatgtgactttattgcactctgcctcagatattagttgtgcagctatttagttacaggtctaatttctactgctagattgaaggacatgtatttacagcaggagcaatgtcttgctcagcttagatcactgaatgtgcctcttacggctgtgtgcatgggtcacttatgtccctccagccaggatgcttaatgggcaaacccagttcagtggctggtgcatcactttaatgaacagagcaggaggaaaggcaggtggcaggacaaggcaagggctgctgtggcaagggccccgcatcacactctttttcgctgacttcactcatctgctgagaacttccttccctgtgatgccatccggatgacaggagctggcgacaagggtcagatctgccttctgtaaagtcgtttccagcccctatgggcatgtttcttgcctagtgttcagtgttcacaggctgtctcaaatcccactacatgccaggcccagagcagagcaagaataagaagagagaccgaacatatgattaagtatttggaagttataaagtgagacacaaactgttcaagaaaatataataaatagatatcattaaatatatcttttaaaattgttaaataaaataccaaatttaaatgcaagtcactaataaagctgattttaaacactttcaataattatattttattaaatattattataagaccatttgcctctctagcatccaacagtcatctaactgacaatgtatagaatcaatattatgcttcacagcatgatattcacagcatatcttgaacagaaattcccagtgttggctgggtgcggtggctcacgactgtaataccagcactttgggaggccaaggcaggcagatcacctgaggtcaagagttcgagaccagcctggccaacatgggaaaaccccatccctactaaaaatacataagttagctgagcgcagtggcaagcagctgtaatcccagctactcgggaggctgaggcaggagaattgcttgaacctgggaggcagaggttgcagtgagccgagatcatgtcacttgtcactgcactccaacctgggtgatagagtaagactatctccaaaaaaaaaaagaaagaaagaaagaaattctcggtgtacagtttggggacccctggaaggcccccagagccttcagtaaggtctgtaaggtcaaaactaatcaaaactaatttcattgcaatattaagattttatttgaccttttcactctcattatctcacgagtgaacaccggagtttttcagaagctccatgaagtgtgataatcacaacccattgaagtcagaagtatgtgtgagaatccagctgtcttctgttaaaccagctcttaaagacattttcagaaatgttaaatgatgccataattctcactttttttaattttggaaaatgtatttattttgcataaaatatgttatccattttatgggtttcttattgttctcaaatgaaccaatataaatagtttgcatgttttgccttaatttctaacataataaatactgatagatataagccacataaataaaagttctttagcatcctcaataatattcaagattgttggtcagtcctgaaaccaaaacgtttaccaagcactgatttagacctacagatatatcgatgtaagagtaacatatattgttcaatattgcaaaacgtccctcaaagtgggaccccaaagtaggaccttgacttggaagaggaaaaacataagactggacacagctgggaaaggatgcttttttaatgcagcaatctatttcctccatgttttctgagagaaacagttgacaagttaattaaattgtcatttctcctacctgagcgtgtcatttctgaaatcttcccccagctgcggctgccttgagtgtcaggagtggaacagccacacctcttcccagcaccaggatgcgtctgccctttgattcaaggacaagggaagtagagatgtggggattgagtcaggggcctgggctaataatggggtctccagcagcagggctctcctgtgtttgagatacgtgactctaaagcaggaccgtggggcggggacccttctcacctggttctctgcaggctgcctagtgacaggtaatcttataggaaatgggaggactgtttttcccagatctgaaataattttcttttttaaacattttttaattgacaaatgaaaatcatatttctttatcatgtacatgttgttttgaaatatgtgtgcattgtagaatggctaagtcaagctaagtaacatatgcattatctcacacacttcttatttttttgtggcgagagcacttaaaatctattctcttggggccaagtgcagtggcttatgcctataatcctagcaatttaggaggccaagaccagcagatggcttgagcccaggagtttgagaccagcctgggcaacaaagtgagacccatttctacaaaaaaaaaaaaaaaaaaaaaagacagaaacagaaggaaggaaggaagggaaagaaagaatctattcccttgtcaattttcaagatcaataccttgttattatctacagttaccctgttgtacaatagatcacttgaacttactcattctttctatctaatgtatcctgtcaaatgtatcctttgaccaacatctccccaatttcccttccctgaaataatttttattctattcttaataaaataataaccttatgaggtacatttacaagtattattccattttctttccacaacaaacatgggaaatcatataatttacatttgatgttattaatgaggaaattgtggaggaaaaaggttaagaaacacccaaggttgcagatctggcaagtggcagagccaggactgccccaggtcttataatgtgaaactttgaagggctctgattttattccttttgtgctttattcacatttatgtgctttctgtatggatttttttttttttgctttaaggttctcatatttgaatttattaagtgtagttatattaacttattataacttttgggtaaaaaatggaccagctctttttaaaaagagcaagtcttactgctaactgggtcttgctaggacaatatttatagacacagtaaaatgcagctcaagacaaaagggggaaatggaacaggttgttgtgagagcttcctgggattagatatgtagacaaactggatcagggtctcacctgtggagctctgaaaaaccgtgatactcagacctcaccactggccagttaagtcagaatccctggaggctaggacccagacatctgcattggttaatgctcttcaagctatttcaacatgcatcccaggttggcaaccactggactaggaaatcaaaactcagcctgcataggtccatgaggatctctgaagttcatgagtcatatgccacttggactgtaaccattcatcaggagtgcagtcgggaatgagcccacccaaagtcataaaaaataaagaacctacagtggtccacacctataatcccagcactttgggaggccaaggcaggtggattgcttgagcctaggagtttgagaccagcctgggcaacatggcaagaccccatctttattaaaaaatttttaaaaatagctgggtgtggtggctcatgcaggtggctgaggtgggaggatctattcagcccaggaagtcaaggctgcagtgagccgtaattgcactacttcactccagcctgagtgacagaccccatctcaacaaaaaataaaataaaataaaataaaataaagaaactgagtgggcaaaataaataaatgacagtgagctagatagcaagctaactctttttaatcccaggaaaatgcttagacatgaagtaatagattatactgaaagtactaggaatccaagttttggcaaaggccagtggtctaaacacaagaactagttagggacgtcttagtctatgtcagtaagtcatatggcttgcaaaaaatcagagaccacagagatagatcagagagaccttcgagccatgtccaagatggaaaggacaagccagagggtaagtacattattgcccttgctttcaagagaggagctcaggaccctgagagggtggatgacttggagggagggcaggtagagaaatgaattgaacagagagatgatgagaaatcagcacagtccaaacagacaagtttcccttgaagaaaagagacctctgagatccaactattgggaccacatgaagcacagagcatgcagcccagtgataatgccatcaagactgcccaagcctatgatgggggtgccctatgacagccttccttgattttgaggctagcttgggtcctcaaaccttcagagatgtagtgcaaccaggatcgctgacttctgcattttcctttctcctgattgtccagttgaccattgctcagtttttaccctgggaaagtaaatttaatgccagtttcattatagtaaatatttaaaggaatatttagtaaaagtgctggcaaatgataagctctcaaaaatggcagctattattttttctttactacttctattggcaaatgcagttttcgtttgtcactttttaaatgatttttgtgcccggtaaaagttcaaactgccacccacccccccaaaggtgtttgggaggagggatatcaccaaccaaggcctcacccagaatcacaccttataactactaaaaagtcatagtctcggcctacatagactttgaaaattgtggacagagttcaggaagctccatatgctacatgaatgcctgccttttgttgaagcaccctgaacttcatgggtcatcatttaagttgtccatactaatgaaatgtgaaagtcaatagatttgaagaatttgcatacaatgatagcaatgacattctctcattcatccactcaaaagttattgagtaatttgctgtgtcccgggcattgtttaatgatggttgggggtagcggggagttgtttaaggatggttgggggtggtggggaggtacgtagtagtgaacgtaacaaagtcctcatggaatgtaccttgttgtgagaggaaatgaacaataaactaacggagtgtatgtttgttttcagtggtgttaaattctgtaaagagaaataatacagggaatagggaaagagagtgagcatggcaaaggatgttacacaggggattagggaggagtagatgagcaggtactgtggagatgctggaatggaggcctgatgaagggagagccagaggcccagagatgtctgggggtgcacattcctggcagtgggagtagggagtgcagaggccccgaggcagggttgtgatgggcgggcaggaggaagagccaggagtccagggttgctggacccaagggaaaaggaggcaatggtgggagaaggaagtcatggaaggtttggcagaggggatgtgatctgatttagagttcttttcattttcttctttgtttggagacagggtctcactatattgcccaggctggtctccaactcctggcctagagtgatcctcctgcctcagcctcccaatgtgctgggattacaggcataagccaccatgtgcatccctgatttaggttttttaaaggtttctctggctgctctgtggagagcagaatgtaagatagaagtcaggagacctgatagaccaggtaagagatactggtggctgaggctgggaagatagcagtgggagactgagaagtggtcagaggacagggcagattttgaagccagcattgtctggatttagacagcttgcatttcagcattggctggattgtacctgaggagtgtgaagaatcattaaggatgcctctaggtgttcagtctggtacctgaaagaatagagttaccatctacggagatggggaagagcacatttaaggctgggataatcaagaacttgtttttggaggtgggcttgagatgcatattagatatccatgtagacagagatagttgaggaaagcaacccaccagcactcattgttagattttctgtgtgttacaaatgggaaacatattccccttgtcttgtttcatcaagagtgttatattaacatctcttctttctctagggctttttcaattaaacacacagcccaaaccaccaggactgaactttctcaatgagaagaggaggggaattagctggacatgctgcagtgaaggctgtaggtagtagagtcacaggagctcttgcaaattagacacatctaagtgacactgtcaaaatccgggagcagggagggaggaaggtggccatgtgtatttgaaaaaaatccccaggcaatactggtagtattcttctctcttgacatttttctgcaaacattgtaataaagctttccataattttaagttgaacaccctccttaaagagaaaatgtgcactgtgtttggtaaatacagtctttgctaggaaagggaaatatacagactagaagatgagatgtcacaaggcagagctttgaggccccgctctccactcactcatcctgtggccccaggctagttcctccctcagtgcccaggcttgtctctgagtggagcctttatttgactcccagagcccaggaggattgtgagatgtgatagctgataaagcctcttataaattggaaaatgctgtgcaaaggttttgttgtcattattcacccaccctctcttgtcagagacatttttctaaaagtccattttgccctgttattctccactcttctgacaaatgtgcagtggttcatctcacccactgttggtaattcagctcaaagacaaattcttctgctgacattcagggctccccagacctggccccagcctacctctcttgccttattcttatattttagttacggggatatccaggtgcgctatacgcagtcaaatacaagctccacacaggcagggccttttgtctctttaactcaccaatttatcccatggcctacaacagtgcctggctggtactaggcatttcccaattcccatccagtgaaagaatggagtgccatctccaacactttctcttttctttttttttttttttgagacagagtatcgatcactctgtcaccaggctggagtgcagtggcgtgatctcagctcactgcaacctccgactccctggttcaagtgattctcctgcctcagcctcccgagtagatgggattacaggcatgtgccaccacgcccagctaatttttgtatttttagtaaagacggggtttcaccatgttggccaggatggtctcaatctcctgacctcgtgatctgcctgctttggcctcccaaagtgctgggattacaggtatgagccaccacgcccagcctccagcactttctaatgctgtccctacatgcagtggcagctctacccttacaggggttgggttccagactctttatgagacctccctgatgttcttacttgtctgaatgatagcttggactttaggaggtcatgggctagtgtggaagaggaggaacgaggaccctggggacagtaatccagccaccattggtagatcaggcatatgcccattggcctggcccataggtggtcttattaacagaagaacagaactctgtaaaatatttaaagaggtttattctgagccaatataagtgaccactgcctggaaaacaatctcaagaggtcctgagaaagtgtggcccaggtggttacagtttggttttatacattttagggagacaggagttacaggaaaggacataaatcagtacatggaaggtgtacactggttaggcaggaaaaggcaggacatcttgaagtgggggcttgcaagtcatagatgggttttagggattctttagttgacaattggttgagagagttgagctttgtctaaagacttgaagtcagtagaaaggaaagcttgagttaggataaagcgggttgtggaggccaaggcctttgttatgtagatgaagccttatcggtagaaggcttcagaaagacagattgtaaatgtctcttttcagaacttaaggtgtcagactcttacttaatctctcctagatctaagaaaggtctggaaagtgaaggcctgtctgcattcatgtagattctctacagatgcagatttccccctcaaaagacagctttgcagggccatttcaaaagatgtcaaagacatatatttgggggtaaaatatttttattttctccagggtctgctatctgtcatgtgatgttataccacagtcagtttggaaagtaagccacatgacaccaagataaattttaaaagcctgtttaatgagattttatggtttgtagggtgtgacttgcattgcatggctttaggttttgtttataatttggtattggtatcttattgccacaaagagcctgttctgtctataaaatagaggtcttgtgatttttaacctcaatgctggttagctgtgcctaaactccagaagggagggggtataacgaggcatgtctggcctcccttcttgtcatggatgggaattccatttttcaggttcctctggggtcatcctggccaagagggggtccatcccgtcagttgggcaatgtctgaattttatttttggtttacagtccctaggagcttgacagggacgtcataacgtccagagccccagtgacaagtagtaggggatagtccatgcagtcagagggtctctgaagccaacagggagtcccccacatgagtgcccatggtggggcccagggaggcagtgcttgggatccaagccagctgttgtcatggtggagacctaagagccatggtggaacgaagttccaggagcagttttcagtccagggagaatagcaggacgaggcagggaccccatcccagaggagccaggatgaagtttccatcaagagaagactgcatatggagaatactcacagtggtaacatgaaccattgccaagagaaccccacctcagttccctttactgtttagatctgcaggggggaaaaatagttttctcctccacgctgttatatgtacaatgtttatttagaaacagaatgcttgttccgtggtgctgcaaagaaatagcactcgaacataaatttagttctctcagcaaggcaatttttactttctgcagaaagggtacacctgctagcagtcttgctacgagagtacactgaacaaaggaaaagcagacatatttatcctttacgcatttggatcatccttactgctgtgtcttgcatccattggctggagctagacttcacaatctaaactgaatttgattggctaacagtttaaaactttttttaaataggtaaaggcaagggagaacaaaggaaaagaggaagttgcttatgccaagtagggaagggacataggctgcaagctggaacgttcctgtgagcatgtcctgcacaaatatcttggttaaagtacaaggacatagaatgtacttattcctttatatttagcagctacataggatagggcttaacaaagagttattagcacaaagcaaggaaacttgaaggaagttagtctttaaaagaaactactatttctaacacttacgatttattcttcaacaacaaaggaaactttgaagaggaaactttttactttctacagttctttatgaattcttagctgggactccctctaacaaaagacagattaacattaacaagagaaaaacaaacagaagtttaataatgtatatctcatctgttcatgggggaaaactcagagaaatgggtaaatctcgagtagatttcaaagtattatcttagaagtcaggcttaaataacatcgttctccaatacaaagagagaagggcctagggaaaggcccagttaagattaggaggccaggaaaagcactttaaacaaaggtaaggctttttatgcagttttaagtccctgccttctccattaattcagtctctagtgattcagggtcacccttctcttcctggggctgagagagagaaactcttacaaatggagatttcctttatagatgtaaatttctcttacaaaagggtaacagtttcagagcttctctgcatctgcagtttctcaaaataaacagctcgaaataatccttatgccaaagaggcatattttggggtggcatattctggtctcctacaatcatatcttaggataatgtgtcctaagccccatcacaaccagccaggatggttattcacctgatgaaatggaggctcagagaggccaactagctttcataagaacacattgctagttaagttttacggccagcacttgtgcaaaggtctgtccagacccaaagcccatgctctctcctctgtatcacaaggcccctggaaaccagccttgataacaaggcatcagggcaaaggtgtagttataagaacaactgaagcccaactaatacccagggtcacaaagtcagagtagaatagaagccagttgtattttttgctgtgtcacctgaaattccccaccaaggactaagcacaagtgtggcccagagcctgagagggagctcaggggacagctgagcagtaagtggcaaggtgtgaggagaggaggactgggaacagagctaggaaggtgacctttggtgacatacctcttccattcagcacatgtcacccagcacccggggctcttctctgaagttatgcatgtgaggcaaactttcctagcagggtgtgagggctttgtcttcagctcagcccctatgatagtacaaggcaaaatctggatatgtcactagtagagggttgtgactgcaagttgtccaggttcttggcattttgaacaaagaattggacaaaatgcccagaaaagcaaagaaagaatgaagcaacaaaagaacgaaagctgggatttattgaaaatgaaagtacgtcacacctgtaatcccatcactttgggaggccaaggcgggtggatcatgaggtcaggagatcaagatcatcctagctaacacggtgaaaccccatctctactaaaaatagaattagccgggcgtggtggaaggcgcctgtggtcccatctactctggaggctggggcagaagaatcgcttgaacccgggaggcggaggttgcagtaagccgagattgtgccactgcgctccagcctgggcgacacagcgagactatgtctcaaaaaaaaaaaaaaaaagaaaagaaaagaaaaaaaagaaaatgaaagtacactccacagtgtgggagcagacccgagcagcggttcaagggcccgaatacagaatcttcttgggttcaaataccccctagaggtttcccattggccacttcatgctcacctcctgtaactgaagtggtagcccacaatcagtctgattggttacaaacagccaaattcccatctgcagtgcagacaaggtcaaagggagtagcctctggtccttttgttacttaagcatggaaagttagggttttcctttcaatttagtcctaggaagtcggcatgaaacaaccttaggttccctgtctccagaccctattctgctgcctcagatacgtgtatcaaataatgcgccatttcttgtagcttcagtcctcaaccttcagcatcacatgcctaaaggagtgctccagatctgaagaaagcctctagtgtggtggtaggattttgttttttaaattagaaactttaattttagtgcattatataacctttaaacccttagggcaggggtcctcaacccctggggcacagactggtaccagcccatggcctgttaaaaactgggccacacagcaggaggtgagcagcagcaagcaagcgttaccacctgagtgccacctcccatcagacaagcagcgacattagattttcgtaggagcatgaaccctattgtgaactgcacatctgagggatctaggttgcatgctccttatgagaacataagtaatgcctgataatctgaggtggaacagtttcattttgaaaacaccccccaccacacacactgtccttggagaaattgtcttccatgaaatcgatccctcgtgccaaaaagtttggggaccgctgctgcaggggcaaactctcatgtgcattgcagtggaaacctctcagtgaaatgcactgttttccaaacactttgagctgctcactcccaaaaggaaaaagggtgctgcatctcctaggaccacagaggctctggtgcctttggcatgtccactaactggctttaagagcaacgtgtacatccacacaggtgacctgaccacaacagggaagatctccaagacaatggcaatagtcctgcaactagctgttcccatggggggaggggggaggatgagagagggagggtgtttctaagatagcattttcttggcagagagaggtgaagtgactcagcctcccaggagccttccagaagtcctggggaatcagctgccactgttgctgtaaaactagctcctcccggtctcactggatgcagtcagaaaaaagcagattattcacctggctaatacttggctcctcggtccccatcccagtcccagcttccagttttgtggctgtagcaacatttcctgaaggggtcaggacttatttgattgaacctgctgacattgggagagcctagtctttggtcaggattgtgcagcaggtggaagagagtttaagcccaggtcagtctgacttcaaaagcttttgtccccataaaccagaaagtatctgagacgggtctcaatcaatttagaaagtttattttgccaaggttaaggatgcacctgtgacgcagcctcaggaggtcctcacaacatgagccaaggtggtcagggaacagcttggttttatacattttagggagacgtgagacttcaatctatatgtgtaagatgtacattgtataatatgtaagatgtacattgattcagtccggaaagcaggacaacgccaagcagggagggggcttccaggtcacaggcagataagaaaaaaacagttacattctttagagtttctgattagcttttcactgaatacacaatttacaggaatagtcacttatgccttagtctggcttagtgaaacaatagggcaaaaaaagaaaaaaatcaggtatgcattgtctcgtgtgagcagagggacgactttgagttctgcctgttatttgtccacaaggaatttccttttgtgagagagggagggaggtgtatatcatttttatagttgtgagggaggtatatagcttttttataattgtgaggggggtatatggcttttttatctttgtagctatcttatttaggaatagaataggaggcaggttggcccaagacaattcccagcatgaattttccctgtggcttagtgcttttaaagtcctgagatttattttcctttcactctcccaatctttatgttcagggatgttccactgtcatgccatccttgatgcagacaccaatactgaatacggagaaggtcccactccccaggggggcctggatcagcctgctgttggagggagactttccctagaatgaagacaagaccagagggcagggaggcaagaggcccaagggggaggggaggagtggtggaggaggggctggtggcggcagtggaacatctgcatgacctacgtattttccagctcctttaaagaccttagaagagacctttgtttatatcccactatctctcagtctcatagctctaagcaataattcctacatcactttggtaagggagctttttcattgtaagcccatttatactcataccagataaacagagaaagatgcaataaactgttttccaaaagtagtggcatctatgacattgacgtattgtttttaatcattttttaaaaactcaaatctatagacaaattgctgcttttgacttagatattttcattggcccatggtcatgcctgcttaattagcattacttataatggagaaaaattaaagaaacctaaagttacaaaaatagaattaccttgctaattatattataaatattcatgtgttaaaatgttatggttattgaaataattttgtgatatatttgtaatcacataagaggaattcttctactataatagttaaccatttaaaaaagcagaatacaaaaatgtgtggtcccaactatcttgtaaaacgcatgaaggaaaaatgcaggaaatatttctgcataattattctggtagtctctgtgttacataattatggggccttgctgttttttcttaattttctgtatttttcaaatttttagcatggactggttttcctcaaaagtcccgactctggacttctctcaggcctttggaatttgcagagtgtggctcagcttttcttgttgcccaggaaggtctatggtgtgtcctcctagtggtgacagtgaggcccctggttcatgacaagacacacactcatgaatgctcaactctgaacttggcggcgcagctgtggacgcagctgcggaagcctcaagttgaaacatgagccctcctctctcctctctcaaccctggtgctctgatgtccaaggaaaatttatccatgtcacttttgtttgtcttaattcaggtttatggctcctttgcatcattctggattgagaaatgaggccaaatgcgaactaatggaaaaaagtaaggctgatgagttcatttagaaatgaactgttccaacaacgttcttcttgacatctctcaagagggccagccgttcagggtgcactttgcggcctccacagctctgctccttgctggaaacatcccccttctgtgtcctccacttgcccaagtctgacctgtgccttcaaggcacttaacatgcagttgttgttgaaatatctcaaggtgactatacctcccctttgcagctttttgtgacaaccaccaattagagacagtgatggcctccttctgagtgcttgcctgctggtcagaaccaggctgagctgatgcttggtaaaatatagctgcctgggccccatccagcctattgaattagaatctccaggaagaaggctgttttatttttaattttgttttcatctcatgcattcagctttttctgcctcatttgttttgacctgagaacagagatcatatgctgaacaacagctagcccagagctttacaaacaatagatattcaatggatgtttgttcaattgaactgaattagatacagtcagagcaagggcacatttcagtccttaagttggaacccttgccaaaatgtcacaattacacttgtttgtttgtttatttatttctaacacttcctaatcagcaggtagaaatttattaattatgaaaattgctttttatcatctttcagattgtttttgcatgctgcaaaacaatgtcttctgtggacattgagactgtggatgtgtgtggccagtagtctctagggatagtactcagagtggtagccaaggagaagagtggttcaggcacactcagaaggtgccattctccaaggtggttggcagggatgtccaggcaccagtcacagcaaggatccatcatgcctccgctgctcctgtaatcgagatgaaaattactgcccagattttgatggacactctaagactgaaaaatacagctgcattgggtttggctctaaggattcttctccagtgtgtttataagatggcaatttaaacatatatacagtggagtcactagaaaacaacatagtgatttttctaaaaaaaaactaaattgggtcaggcatggtggctcacgcctatactcccagcactttgagaggccaaagcaggaggattactggaggccaggagttgaagaccaatctgggcagcatagagagacctgtctctagaaaaacatttttttaaattagccagacatgatagtacatgacggtggtcccaactactcaaaaagctgaggcagaaggatagcttgagccaggaattcgaggttgcagtgagctttagtggcaccactgaactccagccagggtgacagggtgagaccctgtttctggggaaaaataggaaaaaaaacaatttagattggataggacttagagtatgtgccctggtacctttatattctagttggaatagagtgcaccattcgccctgtctggaatattcaccccactctctccctgcagtggtgctttcttctaacaacctcattttggcaattaggtatggaaaactccatagaatatttggagttattaaattttcacgcgaataagtcctaaatctccagggcagaggccatgatttctatttcagttcattttccagggtttggcatgtgcatttgttgactgaataaataaatgaagccctgctgggaaatgcacccttagcagtttacagtccccctgacatgtgcttctaactgcctccaagtagtattaataaagcagtagtcatatgccagcctccgactggggatcataattgaggcactgacatgatgagtttatctctgataaccgatggcaatgagacctgtcctttgcaaagagcaaagccctagtcttgcagtgtgtgaggcattaagactcagtagcatgtacctgtggctctagcttcctcagcactgatgtttcctcttggaaaaacccaaattactttcattgtctcactttccttttaatacttagtctcttggagctttgtagaaagcctgagaagcagtgtgaatggcaagtcaggggcctcgctgcaatgagctggtctccgttgccaccacttaccacgaggtgcaggctctgtctgccgcccccacatctcgaggctcctttcacagctcttattctctggagcgagaccgcactttaatctctgctgttttccgcatacaaggtaaaaaatggaaaattagagatgttatctgaataattaattcaagcctcaaatgaaaaggaaattctaaaatatccagatcattgagacttctgagtttctattagtctggacatagatggcttgtcttgtaaccagtggaaatggcagtgagtgcccttgaatctattaccgtatcctcgaggccagagatgtctaagcatcagcttacaagtgaaaaatgtcttagtgagatgataatcatcggtttgccatctgataattgctacagagagtcaaggaggtagtaccaattcaactgtttatctcatggaatttaatgtgaacctatactacactgttgagcaaagattccacgaggccggaatcggtgggagaggccgtggggctggtaccttcccggtatctttggtgtatatttggtgcatctttggtgtatcagagacaagcttaggagatggtcacgggcatctaagcaatagagatggactgcacgaaaaccgtgccttttccctcatctgtaaaattgaaaatactgtccaaaatcccacagcagactatagcttttgtccgtgagttcaaaggttccaagtttagtcctgcataattgagaaaaagacttaaaaaaaaaagtttccaaactgcctcaattgttgtcccttccttttagctctgaaaaatcagaaagattagctgtgtggaaaatgtcagaagagactttctgttaaatatgttaaagaatttcagcagtaagtgtcgcctgagacgtttaagaaatcatagtagctaagtgtccccttccttttaatgttcttctagaacccagtgaaactttggactgaggtgattcctccacactcccagcccacatcacagagtcttagtgatcatttctcctttgctgtcagagctgagtatcaaatcccatttttttgttttcaaaatagaattgttcctttcttttaccattcccctgaataattgctaataaagcaatatgccactcatctaggtcacctgatttgctggttttgatcacagggatatcttgatgctgttggacttttccccatggagctcttactctgttagacaggtgtccattctgctgtggctcacttaaaaagcaaggctttgtctttgcctcgttgtgatttctttcttctatcaatgttgagagcttgacggaggtgctggtgggttaattctcctccttatcctttcaattcccccattctatcctaaatcactacagataggcctattctatacatatattgccagttcttccttatttccttcctcttccaataggaatctcttgaggtaaaccacctctgccagtcctcctatcacagcctgctgctgagatggtgcagcctggtgtggctaaggcgtgtggcagccagaattggaactgagtgacagttagagctagaaagagcacaagagtgggcagagtgatgacagggaaggaacctgggaaggaacgtgctacctgtggccccatctggaatatgaactggctttgtctcctttcaagggtggaagagggatagaagagggtggaagaagggtggaaggagcgagagattcctttatattgccaatataggtatgaaatgtaggagagagagatgactttatattgctaacggccatgcctgcttcactcttcatcatggctctaagttgctctcataaatgctctgagacatcaacactgaatttatatcagatatggccgtgttcatccggggcactttgatcacaaaaggaaagtgctgctgctgctggttcaaccccactgtgtactgatgatgggcattatggttcataatcccaatgactggcacacttatcagagctgcagtccaacatggggccttcttctggcttgatgggtgatctggaaaagcaggtacgatgacctcccacactgatgtgagagctgcacactgtccctgcacccgcccaggagccgcccctgctactttgtcagtaacttctgccacggtgccacttgtttagacttgagggaccacttgattggtaaagcttctccctgcatgtagaccttggcattcaggagagctatacttgggctccccaagacacagcagctctgtccaccttgctctccccctcattgctgcagtgtgaagtttctaaggtgaacaaaacctccgtggccccccactctccaatggagaaggtcttatttcttggtgtgccatgggagacccctttcacacacttccagctgcccccaacactgtctggcagacagctaagaggagctctgctgaatctggaagctcagcatgcttctagtaaagatacgcttttccacgagaagttccttctgcttagattggatttccctcagctcttgccccttccttccaggtccagcttccatgtcctcccatctgggaaggtggtcccagcatctctctcccttctaggggggaccatgcccaccaccccattattgccctcaccattgtgtcatagttgactgcttaaatgtctgcctcctgcaccaaactctccgaggctatgagcactgtttaagtcctctctgtatccatactcagcatttagcacaaggcctggtacacactaaagactccatccacatttcctgattgactgggctaaaggaaggaagaagaagccagatgcagtggctcacgcctgtaattccagctctttgggaggtcaaggtggatcacttgaggtcaggagttcaagaccagcctggccaacatggtgaaaccccttctctactaaaaatacaaaacaattagccaggtacggtggcacgcacctgtaatcccagctactcgggaggctgaagcaggagaatctcttgaacccgggaggcagaggttacagtgagctgggatcgcaccatttccttccagcctaggcaacaagagtggaaactctgtcaaaaaaaaaaaaaaaagaagcaggagaataaaaccaaagacaggatttacttaaaaataaacccaaagatgctgggtcaaaccacccaggggatataagaatttaaaagagagcatctttacagcaccttgatcctccatgacaaatgataacatgcttttgagtattaatttcaatgaggatacaaactcagcactgcatctgaaaccctcctaagtgtatttcttagaactgtaatccctgtctggccccatcacctaatagcaggcaaatgaggacacgaccatgaatggaggagggaaacacactggcttacaacagcctgaggctcctcaggcttctcaacaagcctgaggctccctcccaagccaggcagctcaggccatggatgaggcagctaactggccgcagggagtctcaaggtccacttggggccctgctgctcccctgctgcgtggtcagggcaggcagctgcccttctcaggcttcagcttcccggtgaataagaggaggggctggcccagaaccctcccatgactgtcactgtgggttcctgtgtgattcacagtattgtgggttggcttttggagactggactgtagccaagcaggtggtggtgccctggttacgggaagaggcacagtgaccccactcagcacagcacaagccctgctgggctcaggatggagtgaggctgaggtcatcatgggggctcctcacaaatgcccggtacggggccgccccgggaggatgatgtggctggctcacagcagctccacctccctttctctcctgtatggtccgcagggctcctggagctgggcgccttgggcccctggagccgcactgtggttctgggaggtgaacacatatccttttcctctgcaggtatcagtaggtaaagaggaaacttttccactttcaatcaggctagtgccttcctgaggaagaaacagtatttcctaacattgagaagggaaaaatgggtctctttctcacatctgtaagttcccattcattctgtctctgtgtcttacacacacaccacacacacccacacacgtgcacacacacatgcgcgcacacacacacacaggaataccagttctcacctttcctttctgtgtaaaccagaggaggtgctaaatattatgaacaggaatttgccccagctaacctgacgaggccctcctggctgccaccttcctccctctcccacacccacagccccctgcccattcctctgcccatacaaaccacccagatttcagcaacttcgctgctgaacgcctccaaacataaacctcccaaataacccagagctgcaccaagcagtcctagacttgagcaaagcagtgaatggtccaatcatgcccctcctggagcctggcctccagctggtttctcttacgtgtgagtgagaatggtgtgcgagcgacaaggagcaaagaccaccccaccccccgccccccaacacctgccatcaaagggctgcagagtcaaaagtgggaggggatgttcaaccttacacttattggtggatttttttttatgagcgataaggcattatgtgttcctaaaataatgtgtctgactggcattttaacaagttccttgtattttaaatcatgacttcctgtgtggatattatctggcttggcttgatttgcttattaaaattttctccccctaatgttccctttcagccagcaatgagtgggattttatttctttttcaaagaaaagaagcccacacaatttagtttatgtaattctgtgatattcttccacacaatggccagcacaaaagaaagcttttttagcacatggctttgaggctgaaagcacaaattgaggcacaggtttcaggaacaggtgtctgggagctgaagagttagacagagatggtggtttagcagccacctcccactctcctcccttacacctgagagcccctacacccgcccctgtcccacaacatccctcatacacagcagttcccaagcagaggtacaaatgggtaagcaggactcaaatctcaggatgtgagagggagaggaggacccaggggcagtatttaatctcatcccaacactttcttcttatttgacaggtgatgaaggcaattcccagagaggtggagcccttctttttagcctaacgaattgtttcccttaacagtcgtgactcagaggaaatgcgtgggctgcagtgatttttgtgatctcttgtgcctgccattgggttgggtaggaggtttctgcttttagactgttaggaccagcagggcccagcagcaagtagagctctggataaagctgccctggcctgtctccaaaccctccaacccaggccatccccacttctcctgtactgcctcagggattcccggtgcttctgctggtcctgcatccggacacctgacccatcccagtgcagtccaggaaccaggaactcaattcgagcaattctgggcaccaagcctagtgcttacaagaattcctgagctcaaggagcagagccccatgtccaggtgcaccccagcccacacgttacccacaagtgcattcattcattcaacacagttatttatttatttatttatttatttatttatttatttatttatttatcgatatggagtctcactctgtcacccaggctggagtgcagtggcgcaatcttagctcactgcagcctccacctccctggttcaagcgattctcctgattcagcctcctgggatagctgggattacagacacgtgtcaccacacatggctaatttttttgtatttttagtagagacggggtttcaccatgttagccaggctggtctcaaactcctggcctcaggtgatatgcccgccttggcctcccaaagtgttgggattacaggcgtgagccatagcacccagcctcaacaaagtatttactgagcatcatctatgttcttgccaggcactacttttgctggaaatgcagacctaaaggagctaggctgggctgctgtcttggtgcctgccttctaagtagaggggactgacaaaaaataagttgacaggtaaggcagttttagacagaacatctcattcaggctctgatcgaaatctccattgaggccagagaggaagctgcgggactgagaacagtcactgagttcagagtggaagctttggggtaaagcttcccctagaagtgactgagccaggtagactttggaatgtggtcggaaggcaacacagcacagtcgctcagtccctaatgaactctcttcctgcgatgaccttggcttttgtcaaagccttgtaccaggaatctgccactataatcgtgattaaaagtctcttaagatcttactcaccacatttcattgtgtttcctacagaaagtctaagatgaaacatttcgttaagaacttggaggaagaaaaaagtccctgtattctgatcataagaactaagctttccttttatcttcttggctgccgagaagctcagagaagtatctgaatctcaattactgcaattctgtccatctgttttataatttggagagaatgcttaagaatgataaaagtgccctcttataatcgcccataaacaggctcaaatccccatttcctgccacacgatggatgacctcagaatttttattaacattctgagctgggttttctagcaacctgagaatagtgaaactggatagtgttttgttgttgttgttgttgttgttgttgtttgttgtttgggggggacagagtctcattctgtcacagagtacagtgcatgatctcggctcactgcaacctccacctcccgggttcaagcgattctccctgccacagcttcagcagctgcgattacaggcgcccgtcaccacgcccagctaattttttttttttgagacggagtttcgctcttgttgcccaggctggagttcaatggcacgatctcggctcactgcaacctctgcctcctgggttcaagtgattctcctgcctcagcctcccaagtagctgggattacaggcatgtgccaccacgcctggctaattttgtatttttagtagagacggggtttctccatgttggtcaagctggtctcgaactcccaacctcagatgatccgcccacctcagcctcccaaagtgccagcattacaggtgtgagccaccctgcccagcctaattttgtgtatttgtagtagagacgaggtttcgccatgttgcccaagctggtcttgaactactgacttcaggtaatccacccacctcagcctcccaaagtgctgggattacaggcataagccaccatgtctggccttgataatgttttaatgagatgtacaacagtccgctgcatagagcaaatgctcagaactatttttgtcttccttcatattgctacttcctgatttctgtctgttttgtattttcctattttattatacatttcttggtttgtaaattttctcaaatcctttgtagaaaaagataagctttgattttttttttttttaaatcccattacccacctggtggcgtaacaaagccgagtgtaggatagcaaaagctgcaggcatcttcttgatcaaagtaaaatctgctcatggactaaaaaagtattacgttctttcttccaactaagtaatgccagtttctataacctcatcttatatactttaatgaagcttccttcaagggctgtgtatttcgcttacaatttttgattccttggtgtagaggccatttttaagagtcattttctctattatagacatgcctttgtctgctttcttttcatttctgagatggcactcactcacggctttatattccaagacagaaatgctattaatgacttagttagataaaaactgacagagcagaatcttttgtctccaggttcttaaaaaaaaaatccatgcataataacatgttccatccctagaagtgatgattttctgcttttaagattctgtttttttacaggttttgtttttgttaatgtgctatactccatgagactatcttaaaacatattaaacccacaaggcctattccaagattaagaaaaaaagaaaaacaacaaagagcacatcacttaattcaaaacatttcaacaattacgatgtcatttaagttggaaagcaaaacaaataaacaaaacattggtggctcttctgctacaaataggaaaaaaaaccaaaaacaaaaaaaccagcagatggtttttactcccatagcagggcactttgtacagtgtatttaaattgctctcagaggctcacttatcagacccattttttcaagcgtcaactaaaatctatgcttgacatagcccgtaactagggccacgtgattacaaccaataactggaaaattacagtgttattgaaactattgctgatattcttgtggtcctcctatcagttcatattgtctatcaccaaagggaaaagaagacaaaagatacttgagttattagtgggttggagaaaaggctgggagaaatttagtgatatccgttgatttcccatacatacagagattgggagggccaccctttgcagagaggaaagagaaaggaggtctcctgttggggagatctgctttagaggttaggaagaatggtggagttgtaagacattggaatcactgtctaggaagacagtggccttttatccagggctatttaaaaacaggacagagcttcatctatctcccacagttcagatgtgaagagagaatgattaaattgcttcttccagactgatgagtctatagtatatgctagaaacacttgtgaatgtctgggagaaacatagccacaaacgaattgcatgttgagcaatcagctctatccacctgctgtgttcaagaagcaactgttgacatttgctcaaatgtgctcaccacaaaccaaaacaaaataaaataaaaatggggtaaataggtgagggatggatgtgctagctaacttgattgtggtaatcatttcactatatatatatatatatatacacatatatatatatatatatacacacacacatatagtgaaatgtattattatatattatatatactgtatatcttatatattatagaacatataatatataatatataatatacagtatatataatatattatatattatattgtattatatataatacaacatataatatataaatataatatattatatattatatatgttatatataatataacatataatatatttatatataatatattatattatatattatatatttatatataatatatttttatatattataatatatttatatatatttttatatattatgatatatttttatataataatatataatatatatatattatatgatatatttatatattatatgatatatttatatatattatatgatatatttatatattatatgatatatttatatatattatatgatatatttatatataatataacatataatatatttatatatatataaaatcttcacattgtacaccttaaaagtcatacaattttatttgtcaattatacctcaataaagctgggaaattaaaaataaaaaggagcaactgttgtgagtctttaataaaacatctgtttaggacatgatggaatacaattttaagttcatctccttcctacataactttgtgttcatatctttattttcttctatgtaccatctactactaaattatcatgcctttctgtaatttttttttttttttgagacggggtctcgctcttgttgcccaggagtgcagtggcacaatcttggctcactgcaacctccgcctcctgggttccagcaattctcctgcctcaacctcccaagtagctgggattacaggcacctgccaacacgcccggctaatttttgtacttttagtagagacggggcttcgccacgttggccaggctggtcttgaactcctgacctcaagtgatccacctgcctcagcctcccaaagtgctgggattacaggcctgaaccaccactcccagccattttatctatttttataagccatcttaaaccctttctggaacaagaagggatatcactgaataaaataatttctataaattaaagctttgggggcttttcatggcaggaattatgccaggtacaggggatatacagaggagaaaacttcacagtgtaggagtgaacatggacagatcaactagcaacagtacctaagaatccctgcaggggaatgggattcctgtgcatcatggagcagaaagttccactcttgggaatgggaaggaggcaaggagcggttacagcagagttggtgctggagcataattctgatgcagaagtgcagatcctgcctgcaagtaggaatggggaggatgtgtgcaaagacagggtggtgggagagggtggggtgcaagggacggctttgaggctgccctgcttaccccggacaaatgtcatcgttccaatccagtaatcactgacaaacgtcttctttgactaatgtttccttctctatctttgctctcaccatgtggacagtgatcactggcgtaatttgacagtttcaggagagttctctagtttccaggggattttggtaaaaatacaatagcagaattgtcttcagcaaaagagaaagaccctacaatccttttgaggccctgattgaaaccacgtacataaaaatctttatcttaggctcttcatcatgaatgcaaatatatcctactcaatcgtaaaccttacaaataaaggagcctctcccctgagcaccagtatatagagcacctttacaaacacactaggctgtgtaacccttggcactttgattttgtaagaaaacctgaaggtttcttgaatttaatgcaagttcataagagtgaggactctggggtgacatgaaggaagcctgttcagtgacggagcctggctgagtgcccaggccctatgtctcagtgaggtttccttcctaaagcattaccagtaatatcttagcaagagatttttatttattgagcaggtactgtactaagaacttgacttgcattgtctcattaaattctgacaacagcccatttacagaggaggaaaccgaggtccagaaagattaaattgtccagtgatagacccacagctgggaagctggtagatgctgcctcagctttgattatggtctaattcataattattttgaatctctgtaatactgtaagatggtattagcccacttaaagtatgtgggaactaaacaaaccttgtgctcttgcagcagcctttctgtttggggattttacaaaggtctctggacagagcctcctggagggctgtcagtttactgagatcctccctgaactgcccagaatagccatggtgccttgagataggtgggtggttcctgcttccctggccttcagcgctttgccagtcttcctgagaggagggatggtttccaggcaacaccatggtccatctattttcatactgctatagtgacaagcattttgaaaaaataagaaatatggccccaataaggtgatgagatgctttttggagtctgtcttgtctgcctgtcataattctgcagcaaccatcagtagggccaaaggaattccaaacaggagacacagatgagtgaaagggcctgcctgccccatggccatagaggaccaagactcagaatgccaacgctgtgctttctcaggctaatagactttttacaacatcctggtcttggaggatggaaaaagtgcaggcctaaattactgctaactagattgatctaactgaaagagtagactattgctgtggtctgctcatcatagctggtaaacaaaaagtcaataatttgcatttgattaggtgcataagaagttacagttcctgggatctaaacttcatgagtcaacacttttttaggccttaatcttctcttcttgaaaactacatatagaacaacatgaacttcaataaccaggaccccccaaaaatgttcatttaaacgcaattttaatatactttgatgaagtcagaatcacccttgcttgtttctgcatgagttctatttgctgcctgtccttctgtattttcaaagttatctgtgcccaaaacgagttagtgctctgcatcaggttggctcattttaagtgctcaaagttgtaaacaatacaaaaatgcattttttctcatcaggtacaatgttttctacaataacattggctccaagggagatacagtcctctgagattggattttattgaaaatcatcgtattcaaagagtactaggatgtttgaaatccttcatagaaacttcatacagcccgaaggcattctgtagagtgaaagatgtaaatggaggagtgactgcctcacccagcagggaccactcctaattctgggctgtgtgtagggacctgaatgctgcagggatcactcagaggttaataatgataatcatcgtttgccttaaagaaggataaaatcagatccaatctaattgacgttggagaactcgagggatggcatttggttggggaatagtcacaccttcagggtcattctgcacatcccagtccttctggtatcaagtgggttagagccgggagaggcagagactccaacaaaacatggaaacgcaggacaccctggtgcacttgtgtttttgttcttgctgtccccgtgtgaacccagagctgcagcctttgtcacgaggaagatgctctatgccatgtttcatatctgcccagcagggcagctcactcacagcgcgtgtctcccagcacatctttcgttttcgtgtgatgacggtgactgagttgccggcgtgccctgaccctgctcactgtctctttgctcccacagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattggtgagtagaatgtgccaagtgtattattcataattcacttttacatatgctgtcacattttaataaactctacaatataattaaaatatacaagcaactgtgttatatgccagattctaacacactgaagaccactgttgcatgaccttgtttttctgcaaaatggacaataaggtctctcttgccatctccattccatggaagaaaatcatgagatatagcagagtcaggtgtggttaaacacaaatgtcattatcatttgcaactatagaagctcttctacttgtgaataagttaatatcaaagcctgtttttaagtctatgtgcttataagacaaagtaacaccatatgcccaaccaatgtatgtagaggtaatttcactttagtttccagcataatctttgccagctcttccaacattcttactgctttgtattcaacagacaagctgggattatactcacaggcatacaggcatggtgttggagaaagttgacttgccttactttaggtggagatttattcaaaattttgaaagttccaaagttgaaagtttactagaagaaattgttctatgtgaattttctcaggtctttgcaaacaaaacaaattatgcaaataagttggatgctgaggcaattatttttatgaaagtttcaccattcccacggattggttttgaaaatcttataattatgaaaaccaatttaaatgaaaaatgtatttcatctattttatgtgatagaatcagctgtcatggaaattgatgtgtttacccaaaagtcgagttataattgctggaaggccacaagagtcaacagattcaacaccgggtcatccgaggccaggccttctgccttcagtctgtgctctgcaacatttgcacattcagacacacaacaccggatttaacatcacagaaagtaatggattgttatgagtagtttacaacctgcacagtttttctgataaaataaaagggatcttagctgactaactagttctcagggaaatattcttgggtctcttaaaggtttttccatcagcttggttagtgcgtttataatacacacattaatgtaaagatggaggtacataaattgttgaaatttttacacaaatagctgtgactagctgaactggatttccaaaagttaaaattcaatttatttctgaaaaaaaattgttcttgaataaaagtagatactatagattaagaacagagattgcaaaataacagcctaaagagcatttttttttttttttgagatggagttttgctcttgttgcacaggctggagttcagtggtgcgatctcagctcaccgcaacctctgcctcccgggttcaagtgattctcctgcctcagcctcccaagtagctgggattacaggcatgtgccaccacgcctggctagttttgtatttttagtacagacagggtttctccatgttggtcaggctggtctcgaactcccgacctcaggtgatccacctgccttggcttcccatagtgctgggattacaggtgtgagccactgccctcggccgcatattttgtttcatttacattgttttgttttaaatttgattgattatccacacttaaaatgtagaagtttcaagttgaaacacaactttctagcttctttcacaaaagcctccaatttggcagcctgagcctgtgataccacatggttctaatcagctggagttaagcgtctgcaccctccctagactggcctgtaaccttcagtgttgccacagtcccctcccacccattcggaccttcatcatgagtgtcttttgtttagcacttgaggcaattaggtttaggctccgaatctagggttttggtttgatttggtttggttttggttttggttttggtttgttttttggtttggttttttattgaaatggagtctcactatattgcccaggctcaaactccagggctcaagtgatccttcagcctcagcctcccaaaatgctgagattacaggcatgagccaccatgcccagcccagatctagttttgagtcaactcaagggcatcttcccgcagctggtgagtgctgatgttattcctcaagttaggtacccactggaagagaagcctgtttggggagaaggtaatgagctcaagatggaattactgagtgtggaacacctgagggacgtgcgtccacagtgagtgaatgaatgaatggttctgaagctcaaccagggatccgagctagggttgtagatttgggataacagacaccttgggggtggataagctcactctagtgttgtgtatagaaagagagcaccagatagtcacagtgagagggggcaggggagaggcagacgaggaactcaaacagaagaagaggaggtggtgaaggggcaggataaccaggagactagagagaacaaagaagagggtagtagaggagggggtgggtagccatatcaggtattacgaaactccatgaatgaataagatctggtgttaacatgacattttgactgagacaaaagtaaccacaacttatcatcctagaaccttaatttgacagtttgttattctcattgtagctacacatatataactgtgaagttatgtaatgcaaaatgccaacactttcaacggcatagcatttcaaaaataacttccaaatccgaaattgtctgtgaatcttaaaagtcaataatgtgtaagtccttagtagcttatcttccacattttccgtgctttgccagagatcaaatcagagatctaggctgagaaatgtagagatggtgatttcatctcatctgtcatttcatgaatgaggagatgtcgaatcagtggctcccacagtcacacagctgcctcccctggctcaggactcatgctgccacaggggtagcacagcattgtggtgcagtgttgggtatgggccatggcacatccgtgtgccatcaaatgtccagcagaggccagggttgtgatgctttcagcatggtaggacttctagagctctcaaagcaaataggactgttctgacataagagggggaagatacctggatgtagagggtgaagtgtggctgctgatttatggaacccaactcttgaagaattaaagtttttcctttacatcaggcaccctattagaatctagaagagcagaagctgtataaggcacaaacagaattcttgtgtccaaagaaacaatatgaaggaaaggccacagaaggggagaaagtggcattgatttttaggagctcctctatcactttatgcttagagttcctgcttctgcaagagaatggcgcttctacatcattggcctagtagtaagaaagacaagtagattctccccatatctcccgtcccattattattgttattattattattattattattattatcattattactattattttgagatggaatctcgctctgttgcccaggctagagtacaatggcacgatcccagctcactgcaacctccgcctcccaggttcaagcgattctcctgattcagcctctcaagtagctgggattacaggcatgcaccaccacccctggctaatttttctatttttagtagagatggggtttcaccatgttggccaggctgatctcaaactcctgacctcagttgatccacccacctcggcctcccaaactcctgggattacaggcgtgatccaccgcgcctggccctgtcccattatttagtgaagtcatggtccagccacagtgggagaatcctgggagattttttcccaagatttggttgtcagaaagcatgaattactctgaaaaatggaagccatatcttttttctgatgggtgtaggagacctgggtagtatattgattctctcttttaatcagttatgggctcacttgctcattccactcttaacagcaatagcatgtttgttgtccactcttctattatagattatggcatggaaatcatagctatgatttttattttgaagacaaatccagagaaaatatattacttgtttcttaggtatgtctgtttctgtaagctttattagacctttctgattaaaattataataatccacaaagatcctttctctattataaactgaggagcaggtggtaggattctacacaccagaagaaatgcataccactcagaaaatgtaatcttttcctgaggaacttttctgtacatgttatgtacaaaatgtacgatgacaaaatcttgaacagtactgatgtgagctagtgcttcaagttattattaatggttttacatagtaagtgtcatagggatttgcaatagagggccctatttttggcccagattctaagcagaaatagctgcttattagatgttggacactggtctaagaccactagctgtattagctcaaggaatcctttcaacaagattttgaggtaggtacttatagtatttatcctcattttgtagtgagtgattaaataaactgcctaagatcacataataatggtagatgtaagcttcctgcctcaaaggggatgtaatattgctcccacaaagaggcttccatcatgacaagaatgcagaaaataacagcctcctggtagagagcctagagcacccattccacactgaggtggagagtgtggcttggcccacagcatccattccagttctcctctcccctccccttttctctcctcccctcccctcctctcctctcctctcccgtcccgtctcctcccctctactctcttctttcctctcatctcctgtgccttcccctagtgcagaatctggtcctctaaatttacatttcccagactcccatgcagccatgttctggatgcaaattcgattcatttagctgcacctgtgcaagatcgggaaggtgaatatgtgaaatgtggggaagcttacatctaccattactatgtgatcttaggcagtttatttaatcattcactacaaaatagggataaatactataagcacctacctcaaaatcttgttgaaaggattccttgagctaatacagctagtggtcttagaccaggctcttgggcctgtggctgctacaagcatggccttgagaaatggagcttttctgcagcagcatcctgtgtctactctctagcttcctggacaccaacaggcagtgggggtgggggcaggcagtgacctactccgcttgccactggctggtcactgtcttcgccggtggagagacagccgccatggcctggacagcagcctcctgccctccagattgcagtgactgtactgagttttcatattcagcaggtcccagggcagcccttgcgagtgaggcaaaggcatcagcctcgttggagagccagttaggcagttatcctgattccagaggccctgcctagagtccacttctccagccctgaattccctgcattaaatccctttctgcataaaatatgtagactgattttggatttctgcagctgaccctgtcaatgcagtttgattcctaagcaaagactagtaacttttctaacaactggtaacaaatgcctttggggaagggtttgacctctcagcccaggcaagaatactgactactctatttttcttgtgtgatacttgtgattaagtgttattgttagtgtgagggaaggggatgcttatcaggactaacagccagtcctttaaaatatattgtgtttaaatgtgtacagcaaaatatacttttttctcattattgtgtgtgtgtgtgtgtgtgtgtgtgtgtgtgtgtgtgtgtgtttgccatcctcgtcatcctttgctgattcttcccacctccccttcatccttttctcattcatgttcctgtggttccttgataattaacccccttttgtacattctatattctaatgaaattacctgttttcttgaataaatctccaaatatattagaaactccctgagaacatagaccgtgacttgttcaccagtgtatccccagggtttagcactatgtctggaacagaacaaagtacccaatacccattatctcatgcatgaatggacatccttcttccaggtgttattgtctataaatccctgaccctgactattaaagggaatatcccagtgatcagagtggagaaattcggggaaatactatcccttggagaactgctataatgaggcaaatttctacctgggtgtgaaacttgttatatctctgctgaagacccagggagctaggaaaatattatgcctttttgcagaaatgaggcaattactgtaaaagatgtattatgcaatcttcatggtaacccaaacagggctgtgagcacacactgtgaataaaaagacaggcaaattttgcaaacaagcgattttccaaaggatacaaacagttcttatcggtaatgagtgttcatttgcccagtcatttttttgccagagaaggggcagcctaaaatgtgcaatccacatagcagattacaagtaggcttaccagttatctcatttagtgctcccctgtaagtactccccactttgcagatgaagaaagactatagaagtgacactattggcaaatggcacaaaaggcaagagctgggccctttggcttcaagctcagtgctttttgcacttcatctcttgtctgttttctcagtccagccagatgcagcatgtgaactgcagggtgtcaggagagaaaagggcaatcatgaaaagggctctctgcagagctggggctctgggcctgccctcaggtgcccttgcccaggttgtccctccagcccctacggtggatttggactctcaaaacttggttttccccacagcctcagatccacctagctcagattatttctggtgaagtggaaactacaagggctccatagaagatcaaggtgaaagccacatccctgtcttagtctgcactgaaagtgtggggtctggaaccaaggaggtgacaggcagcttggtattctcagatctgtcctcctcaagaatgccgcatttctctccaggcactggttttaaagagaacatcgggccgggcgcggtggctcacgcctgtaatcccagcactttgggaggccgaggcgggtggatcatgaggtcaggagatcgagaccatcctgggtaacacggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactggagtccgcagtccggcctgggcgacagagcgagactccgtctcaaaaaaaaaaaaaaaagagagaacatcgataggttgcaaagtgatgagcagagaacagcaggaggtgaaagcacactgtcacccagagctcctcccaggcctcgtctcctccctcagtgctctcctgaccacccgccccccacccgccggcctccttccttgtcactctctatcacagcaccctgttcttttcctttcttttcttttcttttttttttttttttttttttttgtgagacagagtctcgctatgtaaacaggctggatatgatcttggttcactgcaaactccacctcctgggttcaagcgattctcctgcctcaacctcccaaatagctgagattataggtgcctgccaccacgcctggctaatttttgtaatttttttttttttttttggtagagacaatgtttcaccatgttggccatgctggtctcgaactgctgacctcaggtgatcttcccacctcggcctctcaaagtgctgggattacaggtgtgagccactgcaccccgcctcctttccatctcttatcacaagttacaatcaaacatttattcctttgcttagtgtttacagtctgtcttctcaattgtttgtaagctttggttcagaagagaccatactggttttgcccaacaccacagcccctgcaccttccccagcatctggcagatggttagatttcagctgctgaatgaacaatgaatgcatgagtgcatgatggatggatggataagttcatgggtgcgaccatgtataggatggtggtgatgcccaggtgggaggagagatgattcgaagtggagtccgtgagaactagaccccaaagggagattttttctttatgtctcgcccttaggctcaaatagggatcagttcatagaagctttaggaggaagattttcacactgagctttcacacatagaaaagctatttaaaagtgaagtgaaccgcgatagcagtaattatttctctgtttctggaggtgttccagaaccagctagatgatctcctgccagcagtgctatggggttgggaggcgatcccggcataaaaagcgtttggtcccaatggcgtcttggggtgcttcctgctctctgattctctggttccaggtgctttttcttctgttgagatggaagcagcatttgtatcctttgcttttcttttattcccctaaatatgctgttgactgatatgtttctctgctctgctttcttcctctgggaatatagatgaggtcttgtccgaaaactttctggactataaaaaccgtggagtcaatggttctcatcggggccagatcatctggaagatcgatgccagctcgtactttgtggaacgtgagtacctttaccattcttgtggcttggcagacatggatgaagcagaattcaactgtttcattatttgttcccgttgcactgcctccactaagaaatgggccctctaaaagagaggtgtagatttaaagagatccttaaaaagatgttcagtagtaagtggtgaggtctagggcagttggataaaagccagccaaccagcccagagggctgcccctttaataccaagaaagagttggttcctattcataagcctctggacttgggaccctttggctcaggtcccttaactttcactccatggctcctccgggggcatctccaatgtggccatagttagaccaggtcttctcaacaggcatcctaccctccagttttgcctttgcttgaccaaatccttcaaggcttcctgcccatggtcccagtctgtcagtgattttccacattttgctctgacctttggctctggccacagctcccccggagggctgtgagacattggtactaccagcctgtttctttgatttttaatctactgacatttctgaatgtataaactttctatcatatatcttatttatatgttttctaaaattttcttctgcctttgaaaataaatcattatcagagttatggcaggcttttttcatgggtccccatactggtgtatttctcattgcatgaggaaatacctaggtgggcttcgtgtgtaggtatttcctacatacgaagctcagattatgggcttgacatttgccagctgagggaatgcacagcttaccttcagtccacagctccttctcctccacttgggtatggagtgatttcatggacaaacttcttcatgcactttctggttgttagcagatgttcattcaatgtggcatgtcagaaaggaaatggagtgatctgttattccggctatccagttctcagagaaaaagatgcatggctaggaatctgaagttatccattggcatttgacttgtggtccaggaaaaactatatcctcaagtatattttgctttcattttcattcactcttattttcattcactcccttgacaaacatttttgtaagacctgctgtatttcaaggactatagatgtgaagatgaaagtcctggtgtctgtctttgaagaaacttatggtatccccgctcccggcaatgacaccaatagctctttcttgtgttggctcatgcagaatgaatagacaacgaggaaatttttatgctatcagggtgtagagggaacatgattttgtaagatatggtttctggctcttgtgtttgagataggcataataaaactcccagcaagagaatttcttttcttttttttgagacggagtttcgttcttgttgcccaggctggagtgcaatggcacaatctcggctcactgcaacctccgcctcccgggttcaagcgattctgctgactcagcctcccgcgtagctgggattacaggcacctgccaccattttttgtatttttagtagagatggggtttcagaatgctagccaggctggtctcgaactcctgacctcaggcaatccacctgccttggcctcccaaagtgctgggattacaggcgtgagccaccgcacctggccagaatttcttttctttacttatctccctggctctggcttttctcctctctaatccatgccaggcaaaatcccttaaacccaattttgctaccatctgccccaaagctccatggatcctctttcctattgcatcagctgcaatctctctgctcagctgccaagccccaacataaactcgccctcagcccacagccctacttctccatcctccccagcagacacccttcaccctggtcatgttgacctctcccattacctaacaaatagcatcattcagcataggaaatatgggcttatttggggtgtaaagatggctccagcaagtggtacctgatataaacctcctaaagttcaagaagaatggaaaggatacaaacttgcatgagtagtgattgttagacataatactcgaatgtgtgcacaaacctacaatggaagtttggtaagagaggtttttctctctcaccatgcaccaattttttccctttggcctctaattaattgagaaatagacataagaacccattttaaggtcacagtaaagtagcagttctcaatggtgctggcacaaacacaacttgaaagtttttatcttttttaagtccagaagataaatattaaggaagaggaaatcctaggtgggaatttcaatatacctgactcagattcaaagggcagtgaccacatcccataaagccacatctcttctacactttgatactatatgatctcctgactatctcctcatttgcatggcccaacacaccaaaaaatggggaatttgtgttgtaaattaatccagccctagtgccattctcttcaaagcagttttgaaagatttctgtaacatatatagaacatttcttgtatatttattccaaataaccacttcatataattgtcctcatgggcagtatgaaaacacactttaagtattattagaaatacattataggccgggcaaggtagctcacacctgtaatcccagctttgggaggccagggcaggcagattgcttgagcccaggagttcgagaccaacctgggcaatgtggaaaaaccccatctctgcagaaaattagtcacgtatgatgatgtatgcctgtagtcgcagctacttgggaggctgcggtggaagcatcacctgtaccgtggaagttgaggctgcagtgagctatgatagtgccactaaactctagcctggccactgaactccagcctgggcggcagaatgagaccctgtctcataaaacaaacacaacaacaacgacaaaaatacattataatataaaaccatctctttataatacataaacattggcataatggaatgaaagcatattcaaacttggtcaagcagcagcatcctataaaaaacaaatggcttgaccgtgcgcggtgactcatgcctataatcccagcactttgggaggcctaggtagggggatcacccgaggttagaagttcaacctagggtttcaccctggcccatatggtgaaaccccatctctgctaaaatacaaaaattagccaggcacggtggcatgagcctgtagtcccagctactcaggaggctgaggcaggagaatctcttgaaccagggaggcggaggttgcagtgagccgagatcgcaccattgcactccagtttgggcgacaagagtgaaactctatctcaaaaaagaaaaaaaaaggcttgcagaaggcatattccaaataactgaaagttgaacactttagataatgacattgtaaaatgtttttgtgcagacttgagaagatgttggtccacaatatacctgttggactagcaatgtcccagtgttttgggaatatcaatgaaagtgcaatgggaaaggcaggtacttacattttgcaaatatatcaaactaatgtagtataatttgtcaaaaagtaaaaatttattgagacaaagcttcagtttgcaaatgattagagtattaactcaaggcacatatattaatataaataaaataagatgctataatgaattatagctttagggatctgaatgcattaaaattgtatataagatgctatataaatttacatgttatgtgaaataattagtgctttcaaaaatgtatgattgagaggtgccaaattaacaagtagggagagattggctctacgaaacgttctcatatggctatccttccctaacacatccaagcatcaaagctctcttgctataataaaaatgcagaatcccagccatgatccaaagggttacagaagcttctattatgaactaaaaataagactctttgcagtctcccggcagtaataaacacaattaatctaattggtaaattatactctcttaaaattaaaaataattttgtaaacattaaaaattggccagattttaaacattgaagtacaacagaagctcattctttctacctggggattaaattaacataataaaataaaatgaggtgtaccttttattttggtttttatttttccctttattttttccttttgttatttctttttatgagattggatgtatattgcagatgacctggagtctgcagggttctaatagcacttttctttggggataatgattcaatttagaagtaggtaattgctattgatttatacaatttttaatggtctgactaaatctgattttgaaagtaccatcaaattaggaatattttaaacaaatattttctgcactctccaaggagtaacatacctgataaaaatactaaagaaaataaagcctgaatcatttcttattctctggcataatttttctccagtgggcacctggctatttgaccatagtgtcaatggctataacatgagaactctaaagatacaaacttgaacactgacagaagacagaactggtgaaatcttaagttgacccatcctataaagtcatatgatactgtattattgtagtaactcaattatcattttttaatacatgcatttgggctccgctggcccattcagaccttcagagggagctagcacagtccttgttcattgtgtattttgtcagaatccttccaagtcagggcttggattgccccagaacactgagatgaggtgatcctgaaaagaaggtatcctgtcttgatctctggccaagatctgctctgtgtacctccttgttcatccaattttagtaggaagaactgggcagtgtgtctggactgacctctgattacagcaaaaagagaccactgccaaaggggctgcccttctcccccgcccttgtgttgtcgtcactgtcgtaggcaccgcctcctcacagctgtccaggcataaatgagaaatcaggagtcattttcaacctccgtgccttgccctagtgtcctgcccccgccagtcagcaccactcatcccggatcccacctcacctcccgggtcagtcttaggctcggcctgtcttgcccctcgtttcctcgtgtggaaacctggctggatgcacacccagattgctgcacgctgtggtctcatcattccctgcacccatcagaagaacgcccctcaacctttttagcacctcattttaaaatccttttccatcatgccatctgtctcagtccgttgaggctgttataacaaaataccttacactggggaattcataaataatagaaatttatttctcaccattctaaaggctgggaagtccatgatcacagtgccaacagattctgcttctgctgagggcctgctcagcttcaaagacagtgccctcttgctgtttctgcgtaggaccagaggggccaaaggggctggggtgccccttcaacctctcttacaagggcattaatcccatttaaatcatcatcccatattttaaaaacacacaggggctcctgatgatacataacagaaaatctaagcagccaaccttactgacagtttgtaatgactccccccttgaccatggtgaggtgaacctcacacaggtaggggctgtcgggatctgcctcctcactctgggcttcagccagtggcttctaagccagaggcagcatgatggccacggtgacttggggctcaaccccacgcccagggaggccctctggactctgagattctgtttcttcatctataaaatgaaagtgatatatgtcctccacaaggcggccccatgaagatgacctgaaaaaactcaggagaagtgcccagccatgtgtcagggacagtaagagctcagtcaacaccagaccccctgccataattagagggctgtgaattaggaattacaggtgtcactctgagaggaaacagggcaggatcgtacatccaccttttatttctgctctggaaatgaacatattggtgtcttggtgacaattgagacatgaatggctttatgctgagagttttctgtggggaaaccctctgctctgcagccaaagctggagaccaaagggcactggaggaaaagcagggctccaggggagccggtggccttctctcccttgacattcagagcaatgtttccctgcggcgaagcagccagagccagaacaagctcgctgggaccagaggcaccagcaccaagactagacacaggggcttcatcaggccacagtccagatggttaaggtgacatgttgttagagccttttatttcaacttgggcatgttttcaccaggactgctctgcctttagagccagtgtggctaaggactgcaccgcgggctgccattttcaatcactgttgtgttatttccaaggagatgtctcaatctgtgctacaataaatacttgggccataggcgctaagcccttaagaaggttaagtctacatgaggagactgaaccccacctgtgcaacgtaaaggtgtgatcattgcactgcttcacaggttttctgttaggaaaaagtatgactccatatacatatctgcaagataataggcgtatttatattattgtgccatctgatttttttatagagctccgtggaaaccaagactccccccaccgctgcccacccactttagcactacgctaaattgaaatcatggttaaaattgcactgtgtaacggtcgtgaagtaattcgtgttgcttatattcttacttgtgtttcttaaattttaggaaaataatatagagttcacagtgatactcctgaaattctttttatcctttcaccacacaattaattcccctccctgctgtccctaccacctaaacttctccataaacctacctctggttatacctcgtactcatgttggtcttcccttcgttatttccttccagttttgctttaaaatcccaaaagaattaatcttgctagagaggcatcccctgggtagaggaaggagcccaagctaccaagtccataggcactctctagcagccccaagtgaaagggttggaaatattcatacagtgataattttgtccctttgaggttatcatgcatcatgtgatatcatatattagatattatgcatcctgtgtgctaatgggatgtagaaagaacataatagtgattaaagagcaagattaaaggcacggcagggtggagctgagaagtacaggaaagataagtgcttagactttatgtagtctatgaaccatttatattattattattattattattattattatcattattattttagttttaggatgacatgataaaacggatttggggccaggcatagtggctcacacctataatcgtagcattttgggaggaagtggcggaaggatcactagagcccaggagctcaagaccagcctgggcaacaaagtgagacctccatctctacaaaaaataaaaatttaaaaatgttagctctgtttggtggcatgcaccagtagacccagctacttgggaagctgagatgggagaatcacttgagctggggaggtctgcagtctagcctgagctatggagcaagaccttgtctcaaattaaaaacaaaaaacaaaaaacaaaaaaaacaagggtttgtgactattcgtgcaaggcaacttcagggaaacatatccaccttcagcaatcccagtcaaggcctgcaacatgggacacagaagaagcagtgaactagaggggctgcggttgctgctggtccctgtctgaactgcatggggctgccagaggccaatctgactgaacacggccaatgagacaatggcgtgtggcagtggagggcccagcccacgtgggaagacaagacgcaggcgtgcagtcacttctcagcacatcaaggattccattgcatctgggggacatcaaaattgacctgcagtgcatggaggtctcagtccctcagattaaataacaaagcatgactgagcgttattacagaaaacagccagaaagatataaccggaacattccattcagattcgcagcaatacaaaacgatggtgccggcttccagtcagatacatgtcagatcttcccaatgagaagaaaacactcaatcgacataaataaagggtcaaggccctattaacccaaagtcacacttttctggattaaccttaagttgccaagtcggtgtgagaacataacagatacagctgtctctcttagccctattgtgctggaggcctgctggggatcgtgctggtctccaggggctcagatctagacatgcaggctccgtccctgcatgccaaggttctggcattacactggggagacaagcatgtacttctttttgtgctttgtgtgaaatagtaagaggaggagccctagcctgaccttggggcaaagacctaatcacctccaagttacaggaactcggccagttgggaaggaaggtctgggctcagggccaagtggcatacaggggtgggaaggggtgaggctggggtaggtgagacagaattggaaaagaaacattccagggaaggagcccagggtcagaggttctaggcagtttagacatatgcctgcagagcacacagagctatgcaaatgctttaagtagaaaaagcattccgattaggcttgcattctagaaactgcattctggcagaagtgtggcgagaagactgtaaggtgctgatattagaggcttgagaccaccaagaaactatggcataaaaacaggtgagaaacaaagaacacctggaatgagaaaaatggaaggggctgattcagaaagaggcttaggaggtaagatcaacatggcttggtgaggaactggatgtgtgcctggggagaggaaaggggcagaaggagaatcagctgcctctacggcacatcatccaagactgaggggtcagaaagggggcgagtttggggattgaagacaccaagttcaggctgaagtgtctgtgggctggaaagatgcagcacacagttgcccggacacggcgtgctaaggagaagaacccggctttgaaacagagatgggaaaggaacaagcaactgctgtgtgaagtgagggtgtgaaggactttgtgtagggggagtgtaaagtagtgtttctcaaagtgtagcctgctgaaaattgcaaggcagtcgtttacccagggtggttattagaaatgcagattccataggcaagagcctttctttttaataagcatgccatgttattctgatatgcctgtaaatgtgaagatgactgatacagactgtgagaagaggagagttgaggacggaattccatcgaggagcaagaggaagaagaagagaaagagagatcatggagttaggcaggttaagggtggccataaattccctgatgctcctcctattgagaggcggggtccatgtcgcctccccttgagcctgggtgggtgctgtgacctgggctggtttccaaactaaagtaccaacttccagcctaggcctcaagatattggaagcttccacttcctccctcctgggacactcactcttaaagccctgagacagctgggctgggagaagccctggctagctgtgttcggggctgtgtgacaagagcatgctggcaggcccagagtttccagccatcctcaaccaggcaagaggccacatcatacgtctagccctagctgctgtcaatggcaacagcatgtgagatccgcaggagaactgccatgctgagcccacacctcacagaactttgagagataataagagggtgctgctgaagctgtcaagtttttggtttgatgattatacagccatagtaaccagagcaccagagaaaccatcaagagcaaggccctggaagtcaagggaggagaaaccatcaaggatgtcatcaatatgacctgctgagcgccacagagtcacagaagatacagaagtcacctgtggagggtggccatgtgggggctatgggctttgtctaaatagttcgaggagttggtgagaaagactgtaggctgaaaggtatagagtgactggttcatcctggtttgctggaactctcctggtttgggccctaatagttctgtgtcccaggaaaaagctcaggcgtgaacatgctggagtggttggtgaccctctggtgagtctgcactgataaagaagaggccaggggaatacagcagtcctgtgggatggctggcaatgacagtggctctgagaaggtaaccaaatgaggaataaaatcaaagggaagtcttttatttatttatttatttatttattttatttttttatatactttaagtcctagggtacatgtgcacaacgtgcaggtttgttacatacgtatacatgtgccatgttggtgtgctgcacccattaactcgtcgtttacattaggtatatctcctgatgctatccctccccactccccccaccccacgacaggcccccgtgtgtgatgttccccaccctgtgtccaagtgttcccattgttcaattcccacctatgagtgagaacatgtggtgtttggttttctgtccttgcgatagtttgctcagaatgatggtttctagcttcatccatgtaagatcggggtggggccaggcacagtggctcacacctgtaatcccagcactttgggaggctgaggcgggcggatcacaaggtcaggagatcgagaccatcctggctaacatggtgaaaccccatctctactaaaaaaaatacaaaaaattagccggacgtggtggtgggtgcctatagtcccagctactcgggaggctgaggctggagaatggcgtgaacccaggaggtggagtttgcagtgagccgagattgcgccactgcactccagcctgggcgacagagcaagactctgtctcaaaaaaaaaaaaaagatcagggtgagcttgcacatgtttatagactgagtggaataggccataaaaatagggactctcattaacttagtgcttacaggtatcaacgttcttggcaaggatgttaccatgaggtggacgccatcactgttgtatccagtgagaaatcttattctctgagcatcatggcagcttgcctaaggttcagagtggtaggtggtggagctgggatttgaggtcaggattatctgttgtgcttcagcaccatggcagagcccatgggaatgtcagagatatgggacattgaagggcagtttgatggattgaaggccatgaggagtcagtaggcaacaggatccagagaacagttatgggacaggactttcctagaagctcttgactggctaggggtgggatgaccagaagtgtgggtgacgcaggtggcaggtgcaagatgggaacaaagagacaggaagaaatgtgtttctgctgaccattctacagtgcccgctttcctaacaagaagagaaataataagaagaaattggaagaactcaggagtgattttcatctacacagatgtggtacagtgaaattggatctctacaaaaataaataaataaataaaaagcttctcctcttcctcttcaaagccactctacatacaaaatgaatctcttttgctcaaaatcacagacacacggagctggaacctcaacccgggctgctgagaccctctaaagacttcaacaacccaaggaagggactgttaacccattttgatctccatgagatggatacagatccccaggcatgcgcacaggccacattcttgaaatggggccttgctctaaaggcctgttgcaggtgtgtgtggcgagaggccaaatttggcaggcaagaatatggggcagacaagggacactgacctaactaagattctgtgtctggacctgcagccaggtgggtgaggcagtgtctgaagggcatggcaagctgatcaccacggtgtccaattacacagacagacacagcagatgggagcaaaggcggctgcggtcacttcaggagtgtggcctgtgctcatccctggggaacagtacatgggctgcaaggtccgacccctgggctgttgtttggggtaaggctactgtcctgagtagaggaataacactaataataccagcagctaaacttctttgagccatcccaatgtacctggcatcatgctgagcaccttaaatatattgcctcatttaatccttatggaaccctagatggcagatatttttatttttcctttttgttaatgagaaacctgaggcagaggaagataattcaaccggtcccatagtcacaggtaacaaacaagtgataggactgggatgggaaccaagacagcctgccttcagagactgctctttagccaatagaccaaagtaggccagtaggggtcccatgactaaggcagaggattggtgcaaaattctggtcccatagagagctcagtactggcttatccactggatagaactttgaagtaggagtcattcctgggggccttacctccctggtatgataggcaaggaaatgtggggggcatcagagaatacagacatcactagactatcacattctaccaaaatggaggtctggaaggaagatcaaggtggttagtatacagtctttctcatatccagatgatcccaagtggggagctcagtgtgcctcctataaaaagctgtagagaaagtcacattaaaagaaaaggcaacacaggatttcaatcgcttcctcacaggtaaatccagaatcgcccctgttttggtgcatttgttatgtatggatggattccatttgtatatgcatttataaaagtattacttattccctacagaaaatttgaggaaaagatcaaagcaaaaatcgtctataatttcaacacctagataacattttagaagagtgttttattgctagtagcatttccccttagaaggcttaataagtatgtattcaattatataatgaatgaattaagctggtgctcagtattccagtgcaggaagcatgagacttatgctgaaggacagcagccattacatcttgtctttcctatagatgcccctgagcccaaaacgttgggtttccctgctagaggaagagacagggaaatgcgggcagagggaaggggccagatggtctctgggtcagccacagggagataacagagtcaactgacctatctaccttccccttgtaataaagaggtggcagaaagttaccacctttgaaaacagaggactctgctctctgtcaaacatggcccaatccacactgggaatctgaccaaccagtttagcaactcctcctccctccactgggaccaggaaacggatgttagaaaagcagtggaaagggagaattttcactttttccactttattcctacgttatacctctctcttttaacctattgagtgtttcagccaagtcaatggttgtgcatagccacagctgtttttggtgaggacagagatctgtggagcttcagaaagtcctgcctgaacattgtgtgtgccttcctgagtactttcgcagcttctgtgcatcttatctacccaggaccaattcggaggtcactctcaggactttctgacatcagtcaagataggtctctagtcaactgcaaggccattgtcaaatggtgccagctacattgtccactccagctttcaacaaccaggaaagtgttcagagtccaaacaatacaaaaatatacaaaacctctcccaaaatgttgttaatgcagatgtctctgtctcatgtatcacacgttcccaaaattctagagtcaatatggtacctaagaatattgaaaaatccgccaacacccacaaaatttagacacaaacaacccttatccgttgcagcagctactaatctaagccttgttccttctctctaagcaaaaccagagtttgcagaacctggtacatatttagacttacattgctgttgccagctgtgttacctgaggaaagtaagcagacaaaaagcagaaaagaaaaaggagaaagtcatccttgttttattgtcattagaatgaatgtcagtctcttccaggttatccaaggcttatgaatttaaatcccaaatcagagaacccaccttagaggggagaaattgtgacattatgcttctcatatcctttggggaaaatacagttacaaatagtctaccctctaccagagaatggcatatgaaatactctatctctataccgagtctagaaatttggacctacagacacagccttttcttggaacttctgttcttttcttcatatttaccctcgaaaagaagaggcttattttacaatatgaattttctataacacagaacataaatttctggtgaaaattaaacacttaaaacctgcctaacccttcaacaatgaaaaggttaagtattaaaataatatgatgaaatatttttcagaaggggaagagtagattatgtcaattctttttaaacagtcaataatagaagggaaaaggcagaaagagttcaggaacatgcagaaaaaagtagtcaaaataatccacaatcaggccttacccttactgctagcctaatcaccagcagttcccaaattagagaaaaatacatttcaggcaaactcaatataaaaaattaatattcaaatatcagaaccagttaaatggaagtctagctgcttgacacatatgaagtggttatggtgaccttacaacctcgctgctatagactaatgtttgtgagtgggccctcctaatggaattaatgcctttataaaggaggaagagacacatgatttctctccctttgctatgtgagaacacagcaagaaggcagccatctgcaaaccaggaagagagcccttagcagaaacctgatccaccagcaccttgacattgaactttccagccttcagaactgtgaggaataaatgtctgtagtttaagcaactcagtctatgatatttttatagcagtccaaaatgacttagatactcacaaaacaaattcttacaatatttggaatctttctttctttttccttccttccttcctttcctttccttccttttttatctctttccttccttcctcctttcctctctttctttctttcttttttctttcttcctttcttccttccttccttccatctctttccttttcttcatttttcctctttctcccttgactccctttctcccttcatctctctctttctctttctcccttcatctttctttctctctttctgtctttatctctttctctctcctttctttctttttctttctttctttctctctccttccttcctttccctctctctctctttctctctctctccttccttcctttctctttctctttctttctttttctttctttctctctccttccttccttcctctctctttcttcccctccctttctttctttctctttctttctttcttctttctttctttctttctttctctctctctctctctctttctctctctctctctctctctctctctctctctctctctctctctctctctctctttcactctattgcccaggctggagtacagtggtgggatcatacctcactgcggcctcaagggctcaagtgatcctcctgcctcagcctcctgagtagctgggaccacactcacacaccaccatgcccagctacttaaaaaaaaattttttttagagatggggtcttactatgttatccagactagtctccaattcctggcctctagtggtccttcacctcagcctctcaaagtgctgggattacaggtgtgagccaccactcccagccaagatttggacttttgaaagaaaatccagcttccctctcaggactctgtgcagaccatgactttttcttttcttgtttattttctcttatttcattttaaattcaaggggtacatggcttgtttgttataagggtattacatgcataataatgaggattgggcttctaatctacccatcacccaaatattgaatattgaactcaataagtaatttttcaacctttatccctctcccaatctccccacttttggggtcctcagtctattatctccatctttatgctcatgtgtacccattgtttagctctcacttatacattaaagcatgtgatgcttgatttgctgtttctgagttagttcacttaagataatggcctccagctccatccacgttgctgcgaaggacatgattttatgttttatggctgtgtagtattccatggtgtatatatacattttctttatccaatcaactattggtgacacttaggttggttccatgactttgctattgtgaatagtgctgcaataaacataggagtgcagatgtctttttaattaatgatttcttttcctttgggtaggtacctagtagtgggtttgctggatctaatggtagttctatttttagttatttggaatatctccatattgttttccatagaggttgaactaatttacactcccaccaaaagtatatgagtgtccccctttctctgcaaccatgccaacatccattgttttttgactttttaaataatagccattctgactagtataatatctcactgtgattttaatttgcatttctctgatgattagtgatgttgagcatgtgtttgttgaccacttgtatttcctgttttgcaaaatgtctgttcatgccctttacccagtttttaatgtggttgtttttttcttgttgagttgtttgagtcatctgatatagactcatctctgagcctacccagacaaagatatatttgagagccccaaggtgacatctctaggtcagtcaagtggccaagagccccaaggtgacatctctaggtcagccaagtggccagtgcatgctgcaacatgttgtgggaaggcacacactatttcccaggtgttacaggatggtatgtgcatgtacttcatttctcaccttttcttctaacagtctgacactaacctgcttcatcacagcatctcagtgtcttcagatgctcttgctggatggcctctccaactcagccgaatagccaagatcattgtctcccaagaggcaacaattccagcaaattctaaacctacagacattatagtttcatgaaatcccacaccaatggagcacaatgtctttttttttatagaagacactcacttgctgtgaaggctgcatttgcagtgtcaggggccccttagaaggaacaaacatccagttcctgcaccctgaatctgaatcaactgcaactgggagaagcaactaccaattgaatatgcaccatgccagatggcctggcatatttatgtgctttgagttgccatgtcctgtgtgccagagagctaaaactggtttcaggcaactcagtcctccaccatctgaccagccaagattattctctccacttagattgaaacacagagacctactccagtgatctaggattagggacttttgtggcacagaaggcactagactcagtgatgatattactgctgctcttgtcgttggcctgggagacactgctgggataccctgcctccagcctgaatgcttgggataggcttagaaagtactcagctggttccatccaggataggggactgcagcgtcagtgctgtgtgatgccctgttttcatacttcatattcttcactcttgccttctatatccctcaccagggattttttattttattagtcttttcaaagatctaacttttgattttcttgatcctctatatatgtttgttttctgtttaattactttctgctctttattctttatcatttccttctttctactttccttggatttaatttgttgttcttttgctaatttcttgagattgctgcttagctcgttggtttgtagccattcttgtctaatgtatgcaatgagactgtcaattttcctctaagcagtttttattttgctttattttggtaaaattcttgctgaagcacaacacacacacagaaaagtgcacaaatttaagtgcagagcttatgaatttttcagaaagggaactctttcacgtaaacagcgctcaaatcaagaagcagagctttactcacattttaatctgttctgtttctcttcatccttctcacacatctgtgtttctgtctgggatcattttcctctaaaaaaaaaaaaagagttccctttagtatttcttttagtgcaatcccactggagataaatagtctcagtttttgtttgtctgaaaacatcactatttcacctatagttttgaagagtaatttcacaatatatatagcgggaactcaaagttaggtgtttttctctttagcacttaggaatgtcatttatcttctgaaaagtcaatggttagtctttttgtcattcctttgaaggtaactatcttcccccatcttatgcttctaagacttttatctttgtctttggatttcatcagtttaactatgatgtgcttaccagagcttcttgtttttatcctacggcttatcctgaagcttaatgagaagctattatcttctcaaaagttggctttaccccattctctggaactccaattacatacggtggatcattccattgtgtccctctgttcctttttctctatgtactttctcccctttctttcctctaccttctttcaatccggatattttcagtcgacctatctcccggtttacgaaccctctttctgctctacctgatctcctgctaaacacatgcataaagttcctaatttcagctattctatttttcagtaataaaatcctcatttgattcttttctattggttttaattttctggcaaaggctgtacttaatatatccattttctatgtacatcattgcttctttaaagtctttgccagatgacttcagcatcaggattctgtttccctgcttctatctattgctgtacttggtaattttctgtcaattgccatacattgggtatgaaatattatacacttgagttactttaggtgatgacatcttctcccaaagagggtttgccatgtcctcagctaggcagttggggtgctgatggccttgtccaataagaggggagctccgcggggtgcagtccaattctggtaagccacagtctccctctggctatcccatgttccttaggacccctctcaagggctttcagtggggcccctctccctgccagatctcctcaataccaagagatggaaaattttgcctctacttttcaaatgttttcatgattagatttttagtcttttgccctcaaagcttcagtatttgtgaatgtctgaggggaaaccagttgtgtatttgagatctcctgtgctgtaactctcgccccatctagtgagccaccaggaaaaagggggtacaggttaccagaaacctctcatctagaagttttagtcctatctgagattccactgctctgcagtgcctggaaacattttgttttaaaatcagcttacttagttagctgtagaagcattcatgtgctgcaactactctatcctagcagaaagaagaagtctctaattcccaccccccaccccttttttttttctaagacggagtatcgctctgtcgcccaggctagagtacagcagagcagtctcagctcactgcaaccgctgcctcccgggttcaagcaattctcctgcttcagcctccagagtagctgggattacagtcgccagccatcacgcccagctaatttttgtatttttagtagagacgggggttcaccatattggctaggctggtctcacactcctgacctcaggtgatccacccacctcagccttccaaagtgctgggattacaggtgtgagccactgcgcccggcctctaattacctttgaactgtgcaagcaatagccccagggatcaaaaactctgtctgggggtggtgacagtaatcaacactgaaatgaaaacaaaatgcattttttgattgtttttgaatttagaattggccccctgacacgtgaagtaagtatttcccctaaattaaagctacagtgtcgtctgttggtgggagtgtaaactagttcaaccattgtggaagacagtgtggcgattcctcaaggatctagaactagaaataccatttgatcccctgatcccattactgggtatatacccaaaggattataaatcatgctactataaagacacatgcacacgtatgtttattgtggcaatactcacaatagcaaagacttggaaccaacccaaatgtccatcaatgatagagtggattaagaaaatgtggcacatatacaccatggaatactatgcagccataaaaaaggatgagttcatgtcctttgcagggacttggatgaagctggaaaacatcattctcagcaaactatcacaaggacagaaaaccaaacactgcatgttctcactcataggtgggaattgaacaatgagaacacttggacacagggcagggaatatcacaccccagggtctgtcatagggttggggggcagggggagggatagcattaggtgaaatatctaatgtaaatgatgagttgatgggtgcagcaaactaacattgcacatgtataactatgtaacaaacctgcacattgtgcacatgtaccctagaacttacagtattataaataaataaataaataaataaataaataaataaataaatagttacagtgtcattttacatattggttcgttttggtcacttttgctatgctatcgtatttaaagacattaacatgggatttattcttctaaataacaaattagtcaagtaatatacagttactcatgtaaaaaatatatatcagctatcacaattacttcaaaaagaagttgcaattaaccatttttcattcacataaccagacagctcagaatttagctattagagaagcatgagtttatcacgtggcaatttgtataagttaggcaaatgtgaaattcttaaaaatacaaacatctactgtttattaaacatttatgacttttccagttattttaaaattaatttaattttagtttagttttagttaatataaccagtccgtaatacagcattctaaatcatgatgacttttggaagtacaaatccaagttagatgatacctgtatcaaattataaaattttgactgtcaatatgacattctgtaatacaataagattttttctgttagagccatatattactttaatgataattttactacaaaaatatcatttgagtagcaaaaatatcatgactttcagggctgtttatagtagagcaagggtttgttgttgttttggtgcaatttaatatggctttaaaaattatgtaattttatccctttgaatgagttcttagatacaagttgctaaaattaaatgcagcaggacaagtatgtataaaagatgactgtttcattctggtgttggttaaaaaccagactcacgcctgaaaagctttaacattttaccttaaggagattcaacaggtaatatcagtttttaaattaacataaattttccagtgtttactatgaatatttacacttagagtggaatcatcaatgttagatgcctcgtcaatgaacattatttccatttatcctcatttatttggaaacccttcacccttcctttgttttgatcaaaagtcacagcctttctctaagctgcttatttcttaaaatccatttaattcataaaaagaaatacaaatggatatactgccatataggatagactggcaggactcaaggttttatacaattaatgttgattatttctctaaaagtactgctcttattgtttcctcttgctgaaactaaacactcttcagactcaatttatatcacattattctactgttacttaatctttttgagcatctgaagacattgtactttccattcctccttctagataactcttgaggctaactcttacagagtaattatagcttttttggttaaaattgcttttcttggggtttgaggatatagtctcacatctattttgtaaatgacatattagcagatttaagttcattattcttaagaatgtttatacatagaggccgggcatggtggctcacgcctgtaatcctggcactttgggaggcgcaggcaggcagatcatgaggtcaggagatcgagaccatcctggctaacacagggaaaccctgtctctactaaagatacaaaaaaatcagctggtcgtagtggcaggcatctgtagtcccagctactcaggaggctgaggcaggagaatggcatgaacctgggaggtggagctggcagtgagccaagatgcaccactgcactccagcgtgggagacagagcaagactccatctcaaaagaaaaaaaaaaatgtttctacgtagataatttgatcctttctgcaaaataagtgacttcacaatggaaggctgtgctgatctatctctgtctaattcatcaactctgattatactctggttcataagatctcagtgtttttgcattgcagatattgtaacacctgagtagctaaaaacttgccatgatgttcagatattcacggtgctggcaaactgcaatgtctgggcaacagtattcttttttttttttttaattatactttaagttctagggtacatgtgcacaacgtgcaggtttgttacataggtgtacatgtgccatgatggtttgctgcacccatcaactcgtcatttacattaggtatttctcctaatgctatccctcaccctgccccccaaccctatgacagacgtgtgtgatattccctgccctgtgtccaagtgttctcattgttcaattcccacctacgagtgagaacatgcagtgtttggttttctgtccttgcaatagtttgctgagaatgatgttttccagcttcatccatgtccctgcaaaggacatgaactcatccttttttatggctgcatagtattccatggtgtatatgtgccacattttcttaatccactctatcattgatggacatttgggttggtttcaagtctttgctattgtgaatagtgccgcaataaaaatacgtgtgcatgtgtctttatagtagcatgatttataatcctttgggtatatacccagtaatggggtcaaatggtatttctagttctagatccttgaggaatcccacactgtctccacaatggttgaattagtttacactcccaccaacagtgtaaaagcgttcctatttctccacatcctctccagcatctgttgtttcctgaccttttaatgatcgccattctaactggtgtgagatggtgtctcattgtggttttgatttgcatttctctgatgaccagtgatgaagagcatttcttcgtgtgtctgttggctgcataaatgtcttcttttgagaagtgtctgttcatatcctttgcccactttttgatggggttgtttggtttttttcttgtaaatttgtttaagttcttggtagattctggatattagccctttgtcagatgggtagattgcagaacttttctcccattctgtaggttgcctgttcactctgatggtagtttcttttgctgtgcagaatctctttagtttaattagatcccatttgcctattttggcttttcttgccattgcttttggtgttttagtcatgaagtcctctggacaacagtattcttaaagcatatttttatgttgacagatatctcctttcagcactttgaagttctcattcccttgtcttccattgtttctgtttgtgttaagaagtcgtctgtcaatatgactcttgctcctttgaaggtaagctagctttttccttcattggatgatgatgttgtttttgtctttttttttttctctgatgtctgattgctttgttccttttggattcatagggctttttgaatctataccttgatgtctttcgatgtagcaccatcatctctctgctgtccttttagatttcagttacctatattttagactatctgctagtatcctgtgtgtttcttgctctttcgtctatattttccatccttttcctctgcatgcttctttctgggtttttttctgacctatattccagttccttaaaatttctcctctgtgttgtttaatctactgttaaacctattcattgagttcactatttcaaagtacagtttatcagaatttctcggattcaaaatttctgtttggttcattttgtagacttaattctttgctagtagtttcaatcttgtcttctttttgctcgagtgttttaagtatatgttcagtgacatctacttgttttttgtttttaatttagaaaggggactttattttgtataagggtttatagtctgcagggtggccattccacaggctgtgaagtatagactccgctcagcaaagactggaaacaggcactttaagggaggagagagcagaagaggaacttatgttgaacaggttggccaagtatacatatttaatgggttatagcaggagttatgaatattcacaaaggggttcctgaaatatgcatattgaaaaacatgtatgtaacatacaacccaagttaacattagggtagagacttaacatttaaatgaattactattaggccgtatacatcaaaagctaaagcagggacatggaggcactcaggtgtgcagcctctgtaaacaagccagaaccagtctatggttggcaatctcttatcagaagaaagttactgaaatcattctcttttatggttttttatttttatttttattattttattttattttccataagttattggggtacaagtggtatttggttacatgagtaagttctttagtggtgatttgtgagattttgatgtacccatcacccatgtatacaccacaacatacctgtagtcttttatccctcgatcccctctcactcttccccacaagtccccaaagtccattgtatcattcttatgcctttgtgtcctcatagctcagctcccacatatcagtgagaacatgcaatgtttgattttcccttcctgagttacattatacttagaataatagtctccagcctcatccagatcactgcaaatgttaattcattcatttttatggttgtgtagtattccatcatatatatacacacacacacacacacacacacacacatcatatatatatacacacacatcatatatatatatacacacacacacactacagccacttgttgattgatgggcatttgggttgcttgcacgattttgcaattgtgaattgtgctgctataaacatgcctgtgcaagtatctttttcaaataatgacttcttttcctctgggtagatgcccagtagtgggattgctggatcaaatggtagttctatttttagttctttaaggaattgccacactgttttccatagtggctgtactagtttacattcccaccagcagtgtagaagtgttccctgttcaccacatccacgccaacatctactgtttttttattttttttattatggccattcttgcaggagtaaggtggtatcacattgtggttttgatttgcatttccctgataattagtgatgttgagtattttttcatatgtttgttggccatttgtatatcttcttttgagaattgtctattcacgtccttagcccactttttgatgggattgtttgtttttttcttactgatttgagtttgttgtagattctggctattagtcctttgtcagatgtatagattgtgaagattttctcccaatatgtgggttgtatgtttattctcctgactgttccttgtgccatgcaaaagctcttcagtttaattaggtcctaggtatttatctttgtttttattgcatttgcttttgggttcttggtcgtgaaatccttgcctaagccaatgtctagaaagttttttcaatgttatcttctagaatttttatagtttcaggtcttaggtttaagtccttaatatatcttgagttgatttttgtataaggtgagatgtgaggatccagtttcattctcctacatgaggctagccaattatcccagcaccatttgttgaaaagggcatcctttccccactttatgtttttgtttgctttgtggaagatcagttggctgtaagtatttgggtttatttctgggttctctattctgttccactagtctatgtgcctatttttataccagtaccatgctgttttggtgactatggccttatagtatagcttgaaatcaggtagtatgatgcctccagatttgttctttttgcttaatcttgcattggctatgtgggctcttttctggttccatatgaattttagaattgtgtcttctaatgctgtgaagaatgatggtggtattctgaaggggattgcattgaatttgtagattgcttttggcagtgtggtcattttcacaatgttgattctacccatccatgagcttgggatgtgtttccatttgtttgtgtcatctgtgatttctttcagtagtgttttgcacttttctttgtagaggtctttcaactccttggttaggtatattcctaaggttttttaaattttttaaaatttaatttaatttaatttttttttttgcagctattgtaaaaggggttgagttcttgatttgattctctgcttggttgctgttgatgtatagaagaggtactgatttgtgtacattaatcttgtatccagaaactttgctgaattcttttatcagttctaggagctttctggaggagtccttagggttttcaaggtaaacgatcatatcatcagcaaacagtgacagtttgacttcctctttactgctttggatgccctttatttctttctcttgtctgattgctctggctaggacttccagtaccatgttgaagaggagtggtgagagtggtcatccttgttttattccagttctcggagggactgctttcaacttttccccattcagtattttgttggctgtgggtttgtcatagatggcttttattgcactaaggtatgttccttctgtgacgattttcctgaaagttttaatcataaatgttggattttgtcaaatgctttctctgtatctattgagatgatcatgtgattttgttttcaattctgtttatgtggtatatcacatttattgacttgcatatgttaaaccatccctacatccctcttataaaacccatttgatcatggtggattatctttttgatatattgttggattcatttagctactattttgttaaagattttagcatctatgttcatcaaggacatcggtatgtagttttcttttttggttaagtcctttcctggttttggtattagggtaatgctggcttcacagaatgaattagagagggttccttctttctctatcttgtggaatagtgtcaaaagtaccaattcatctttcaatgtctggtagaattttgctgtgaatctgtctggtcctggacttttttttgtttgtaattttttaattaccattttaatctcactgcttgttattggtctgctcagggtatctaattcttcttgatttaagctaagagggctgtatttttccaggaatttatccatttcttctaagttttctagtttatgtgcataaaggtgttcatactagccttgaatagtcttttgtatttctgtggtatcagttgtaatatctcctgtttcatttcttagtaaggttatttgaatattctctcttcttttcttggttaatcttgctaatggtctgtcaattttatttatcttttcaaagaaccagcttttgttttcatttatcttttgtaattttttttttgtttcaatttcatttagttctgctctgatcttggttatttcctttcttctgctgggtttgggtttggtttgttcttgtttctctaattccttgagatatgacttaaactgtctgtgctctttcagactttttgatgtcggcatttagggctgtgaactttcctcttagcaccacctttgctgtatcccagaggttttgatagtttgtgtcattattgtcattcagttcaaagaatattttaatttccatcttgatttcgtttttgaccagtgctcattcaggagcagtttatttaatttccatgtatttgcatggttttaaaggttccttttggagttgatttccagtttcattacactgtggtctgagagagtgcttgatataatttcagttttcttaaatttattgaggctcattttatggcctatcatatgatctatcttggagaaagttccatgcactgttgaatagaatgtgtgttctgtgtttgttgaatgaaatgttcttttttttcttcgtttttgtttttgttttgttttgttttgttttttgagacggaattttgctctggttgcccaggctggaatgcaatggcgcactctcggctcactgcaacctttgcctcccaggttcaagtgattctcctgcctcagcctaccgagtagttgggattacaggcatgcgccaccacgcccggctaattttgtatttttagtagagacggggtttctccatgttgattaggccggtctcaaactcctgacctcaagtcatctgcctgcctcggcctcccaaagtgctgggattacaagtgtgagccactgcacccggcctgttggatgaaatgttctatgtctatctgttaagtgcatttgttccaaggtatagtttaagtccattgtttctttgttgacttcctgtcttaatgacctgtctagtgctgtcagtgaagtattgaagttcccccactactattatgttgctgtctatatcatttcttaggtctattagtaattgttttataaatttgggagctccagtgttaggtgcatgtatgtttaggattgtgatattttcctttggacaaggtcttttacccttacatactgtccctctttgtctcttttaaacactggtgctttaaagtttgttttgtcttatataataatagctacccctgctcacttttggtgtccatttgcatgaaatgccttttttcacccctttactttatgtgagtccttatgtgttagttgagtctcctgaaggcagcagatagttggttggtgagttatccattctgcggttctgtatcttttaagtggggaatttaggccatttacattcaatgtaagtatcgaaatatgaggtaccattgctttcatcatgttctttgttgcctgtgtactttgtttttgtttttatgctttttaaattgtatttttgttttataggtcctgtgtgatttatgctttaaagaggttctgttttgacgtgttttcaggatttgtttcaagatttagagctccttttagcagttcttgtagtggtggtttggtaatggcaaattctctcagcatttgtttgtctgaaagagactatatctttccttcatatatgatgcttagtttcgctagatacaaaattcttggctgataattgttttgtttgaggaggctgaagatagagccccaatcccttctagcttgtagggtttctgctgagaaatctgctgtcaatctgatacgttttcctttatagtttacctggtgcttctatctcacagaccttaagattctttccttcatcttaactttagataacctgatgacagtgtgcctaggggaagatctttttgtggttaatttcccaggtgttctttgtgcttcttgtatttggctgtctaggtctcttgcaaggccagggaagttttcctcaattattcccccaaatgttttccaggcttttagaattctattcttcctcaggaatatcgtttatatttaggtttggtcatttaacataatcccagactccttggaggctttgttcatgttttcttactctttttcctttgtctttgttagattgggttaattcaaagaccttgtcttcaagctctgaatttctttcttctacttgttcagttctattgctgtgactttccagagcatttcacatttctaaaagtgtgtccaaagtttcctgaattgtttattgtttttttctttaagctatctatttccatgactatttctccctttacttcttgtatcattttttggatttccttgcattgggcttcgcccttctgtggtccctccctgattagcataataactaacctcctgaattctttttcaggtaaatcagggatttcttcttggtttggatccattgctggtgcactagtgtgatttttgggaggcattgacaagacttgttttatcatattaccagggttggtgttttctggttccttttcatttgggtaggctctatcagagggaaggtctagggctgaaggctgttgttcagattcttttgcctctggggtgttcccttgaattagtactgtccccttttcctacggtgtggcttcctgtgagccaaactgcagtgattgttgtctttcttctgggtctagccacccagcgagtctacctgcctccaggctgttactgggggttatctgcacagagtcctgtgatgtgaaccatctataggtctctcagccatgaataccagtgcctgttctggtggaggtggcagagggtgcaatggactccataggggtccttggctttggttgttcaatgctctatttttgtactggttggcctcctaccaggaggtggcactttccagagagtttcggctgtagtagtatgcagagggaccagtggtgggcgatgccttagaactctcaagattatatgccctttatcttccactaccagggtgggtagggaaggaccaccaggtgggggcagggctagacgtgtctgagctcagacttttagggcaggtcttgctgtggctgctgtgggggatgggggtgagattcccaggagtgacatctacttgttatggaacatatgcctgtatctgatgactctgatatctggaaattctatgtatctgccttttctttgtcagctgttttttttctttcttctttttttttttttttttttacattgccttgtctttgcatgtgcttggtcaattttaattaagaacagtacaatgtaaatgaaaacttgtagaaatcagatgaggcttagaatgatgctactttcctcctgaggggttttacattttcttctgaccaatgtctagcaatccagaataacctcaattgaatttcaaggcttgagatgattcagagggctaaggctggtgtatttctcaacagtatatccgtttattattcagagtcccaccttgaatcgtaagggaattaccagagctttcctttttgacaggctttagatttttaagttttatccccttaacccggcaaacctgtcaaatattcttttcagcttctcagcctctcagatgcttcttttagaatcaacacacttacccctagagaaacaaccccaaatcctgggcttatctctgagttttcatgttctgtatcttgacctcattattttattttccactgccttgctaggtctctgatgccttcaggctagggtttctagatctaggggaaaaaactttcaggacatctaattaaatttgaatttaaaataaacaatgaataatatttttattgtatgtgtattccatgcaataatcgaaacttgcttatactaaaaattcattctttgtttatctgaaattcaattttaactgggtgtcctgtatttgatttggtaaccctacttttggcagaattatttctacattttaacagcttttctagatgttctctgaattacctagtacattattactgaaagtggaagtttacttctgttagctggtcagcaaacttgagttattaaaaacttttgagagacaaatcaccaagaaaggagttaatgtttgcttaaatcctaggtctgccatgaaccatatgtgtgaccttatgtaagtggccttaattttgacctcattttccttagatgtaaaataagaatgacaggtgacatttactgaggtctgattatatgccaagcattgtgctaaacacatttttttaagaaggctaataatgattggctatacatcataggattcttgtgaggatcaaattagaaaatattattaatgccctggtacatagtaagtgctaattaactgttaagacaaatttaagtcattgcttttaaacttaattgaacattttacttactcaggtctcctatcatcattgcatactgatgtctccagtgctacagctggcctactaatcccttaacagtgtaggaaggtgggggggcagggaagcaattttctcctttctttaagtggtaataaactgaagtgaaacaatctgtactctctgaatacatgcccttaaataaagattatagttgcaatctgtgtataaatatacatatttatagtggtagaaacttcagttttgctctacttcgtgaaggacatggtcaccccggcccaaacttgaaaatataaatatatatatattattgatgcatgtgttttaatatttatggatggctttcatttgtagcccacccctaaataagaagaaacgttaatgatttaatatcccttttcagctagaatgggaaatcattttaaattacagggatatttaggttaaataaaaggaagatcaatttataatcaagttgctaaacactggaacatagtattaaaatactcgtttaagaaaaaggaaaacaacctttgccaacaacttctcagaagagtaccatgacgtccatttccaaaagggtagtatagaggcaagatggcttcacttccccccacagaaaatttaaaacaattgtatggcaccaagatgatcaccagcaatatcccagaactcaaatatgagggtaagacagctctcagggccacaaagcagtgaaaaaaactctgagcagatggtaagagaatcagacttccatatccacaatgcccctccctcccctcaatctacctggcaccaagtgcatggaaaatttttccccaactcatgatttatacactggaaaaagtgaaatggaggtagacaaccagcttccacatcattttgggttccctgggaggagacttgtccctgcctcaacccacgagaagcattgggagtgcctgaagagagaactatccctgagagcaaccatagacaaagcaaggaagaaagaccaccacccctggaaactctgagatatagctcagccaaaggagacactaaatcagagtgagtgttcagcagcaccatgccgtggaaagcttgttccatagatccccttggcatgagcccttagccagtttttccatagtcctgggataaaccttttgggacctcctccattcaggatgggcagcaatctgattgtttactagaagtgaggcaaacctgggtttaatgtgccatctagtgtcaaaaaggaggcaattatttatagtaggggaaaaaaaagaaagatatcaacaggtaaattacaaagaatctctacacaaacatatccaataataaaaaaaaaaaaaggccagacagagaagactgaaataaataactaatccttcaatgcaaagacatagctgtatatctacaagaaaaacagcaaacagaaaaccatgacctcctcaagtgggcaaagaaaggaactagtgattgaccccaatgagacagcaatacgtgtactctctaacaactgaaaaatagcagttttaaacaaactcagcgatctccaagataagacagaaaaagcaattcagaaatttatcaaggaaatttaacaaagagattgaaataattttaaaaataaaacaaatcttggaactgagaaatatatttgctgaagtgaaaaatttattacacgttctcaacagcagactgaatcaaacagagaaaagaatcagtgagctcaaagagaggctatttgaaaatacgcagaggagaaaaaagaaaaaacaataaaaaggaacaaagatcacctacaagacatagaaaattacctcagaagaccaaatctaagaattattggtgttcaaaaggaattgagcaacagcaaggagaaaatttattcaaagaaataataacagaacacttcccaaaacttgagaaagaggtatatatccatccagatacagaaagatcagagaacaccaaacagattcaactcaaataaggctatcccacagcatataataatcaaactttcaaaggtcaaggacaaagatggcatcttaaaagcagcaagagaataaaagcaaagaacatataaaggaactccagttcatcaggcagcagacttcttaatggaaaccatagagaccaagagggagtgagatgacatgttccaagtgctgaaaggaaaaaaaaaaaaactgcctcccaggaattccgtatccagcaaagttatccttcaaatacagaaaagagataaattatttcccagagaaacaaaggctaaaagaattcactaccaccagacccatcatacaagaaatgcttaagagagttatttaatctgaaaaacaaaaacaaaaaacactagtgagtaaaaaggaaacgtttgaagatataaaatccactagtaaaattaagtacgcagacaaacccaggatactctaatactgtaattgtggtgtgcaatctattcatatctctagtaggaagcccaaaagataaattgatcaaaaacagtaatacctttagcaacctgttaagagataagtaatataaaaatatgtaaattgagacaatgtaaaatccaaatgttgggaggatggagttaaattatagaggcttttttttaaatttgttctttgtttctattctttgtgatctaagataagttgtcatctccttaaaataacttgttacatctataagatttttttgtaagcctcatggcaaccaaaatgcaaaacctataatagattcactaaaaataaaaagcaaaaaaacatactaccagagaaaataacttaaccacaaaggaagataggaaatatggaaaaaaggaagagagcagttaaaaaccaaccagaggccaggcacagtagctcatgcctgaaacccagcactttgggaggctgaggcaggcagatcatgaggtcaagagatcgagaccatcctggccaacatggtgaaaccctgtctctactaaaaatacaaaaattagctgggtgtggtggcgcacacctgtagtcccagctactcaggaggctgaggcaggagaatcacttgaacacaggaggcggaggttgcagtgagccaagattgcgccactgcattctagcctggcaacagagcaagactccgttaaaaaaataaataaaatgaaataaaaaacagaaaacaagcaacaaaatggcagtaatcagtccttacttatcaataataataacaaatataaatatgctcaattctctaattaaaagggatagagtggctgagttaataaagaaacaagacccaactatatgctgcctataagaaacccacttcagctataaagacacatatagactgaaagtattgaggtggaaaaagatattccatgcaactagaaaccataaagggcaagagtacctatgcttacatcagataaaatagactacaaatcaaagactgtaaaaagagataaagaaggtcactatacaatgataaaggggtcaattcagcaagcggctatgaaaatctatgcatatctatgcacccaacaccagagctcccaaatatgtaaagcaaacattaatagatctaaaatgagagatacactacaatatgatcataataggggacttcaataccccactctccataatggccatatcattccagcaaggaaatgtaaataaactacacactgaccacatggcctaactgacatctatagaacatttcactcaactgctgcagaatacacattttttctatcaacacatggaacattcttcagaatagaccatgtattaagccacaaaataaatgtcaacaaattcaaaaaagtagaaatcttatcaagtatcttctctgaccacaaaaggaataaaacaaaatcattaacaagagaaatctcagaaactacacaaacacatggaaattaaactacatgctcctgaacaactaatggagaaattaagaaaaaagttttaaaattttttgaaacaaatcaaatagaaatacagcataccaaaatgtatgcggtatagtaaacaactcaagagcaaaaaacaatctgatttttaagtagcatcttttaaaagatgtgaatagacatttcttaaaagaagacagacaaatggccaacagatgcatgaaaaaaatgctcaacatcagtaatcatcagggaaatgcaaatcaaaaccacaatgagttatcattcaccccaattaaaacaggacagggagcaacaaatgctggtgagaacacagaaaaaggggagccctcatacactgctggtgggaatgtaaattagtacagccactatgaaaaactaacagattcctcaaaaaattaaaaatagaactaccatatgacccagcaattccattacagggtatatagcaaaagaaaggaaatcaatatatcgaagagatacctgcactcccatgttgattgcagtactgatcacaacagtcaaaatatggaatcaatctaagtacccattaatagatgagtggataaagaaaatgtggtatgtaatagtattcagtcacaaaaaagaatggaattctgtcatttgcagtaacatggatggaactggaggtcattatgttaagtgaaataagccaagcacagaaagataaatattgcatgttttcattcgtatgtgggagctaacaaagtggatctcatggagattgagagtagattggtggttaccagagaccaagaaaggtagaaggaagaagaagatgaatagagattgattaatgggtacaaatatacagtttgatagaagaaataaaatctagtgtttgatacatcaatagagtgactgtaatttataataatttataatttgtaatttataatatgtttttatatatttatatgtatttataatatgtttccaaatggctacaataattcaaatgtctctagcacaaaaaaagacaaataattaagatgatgtatatcccaattacattcatttgatctttacaaattatatgaatgtattcaatcatcacatgtatcctgaaaatatgtacatctattatgtatcaataaaaaactataaatggaagaaacaaagaagagtacagagtttgaagtgttccatgaattcttggctcaaaatatgcactgatcttttcatctagcaatagagttcaatgcaagattgtatgtaatttccctgacctttttgctcaaaggcattgaaataattttttctttaaatggaaatctagtagtgcccgtttgggattcctggtacctaaaattcctttccacccaactgagatgaaggtgaggccatttggcccctccatgctgatcccaccggcacctacaggcagagtaactcatgcactaggcaacactaactcattgtgattaactagatagatggcttactgctttattcagagtccttccctgatccctgacttatgggaaacttgcctctcaggccaacacagtattggatctgagtgtgtagacctaacatggggacaactttgaggtgtcttggagaataagtacagaactgggttataagattgtccaccaagagcttgaaaagacaatcaacagacatgtgaaagaactatcgagaaagtgactcaggaaggaaactcaaagtacaggcatatctgaagtaagaacacatccactaacagagggactggttagcatccaggcatcacccaggtaatggaaaacctgagcaactgcaattaaatggcttcaaaaaaatttaaatagctgattaaaatttaatgaaaaagtttaaccctactaataatcaaataaatgaaacaaaaataataatcggattctattttaagcctatttttaagtgatgatgctcagtgctaacaagcgttctatgagatggtcagagtcacatttcctgatagaagtgtaaagtgttatttggaaagcaatttggccccaggaagggaggatccttaaaatatattcttttttttttttttttttttttttgagactgagtcttgctctgttgcccaggctggagtgcaatggcgtgatcttggctcactgccacctccacctcccgggttccagcaattctcctgcttcagccttccgaagtagctgggattgcaggagtgcaccaccacgcccagctaatttttgtatttttagtagagatgaggtttcaccatgttggccaggctgatctcaaactcctgaccacaaatgatccacccacctcggcctcccaaagtgttgggattacaggcgtgagccaccgtgcccggcccatatcttttaacctaaagaagactactgtaatattcgtatctacagcattgaggaaacctttacatatcagttaggtttatgtttagctacatataacagagatcctaaaataacaatggtaaactgcataggtgttattctgccagggaggctgcaaaatgtagtactttagctggacattatcaatcaaaataaaactgagattctgttattaaggaggaaaggtagaatggatgccgggtaggtatctagcgatttttgctccattgtcctagggagaaaatttgaacttaaaaaataatttgtaaaaagtaattgattttcagagaaaagcctgaatttccaaatataggaaatatttgcaatgtgtaaatctattcagttgttctgtataataagtaatgttgtttgaggagttttaaatgatagttggccatgcttatttcataatgtcaattttttaaaaaagcaaaatgtattattctatagtttatagtctcaattatgcaaaaatctcagaagattgttatttcatttatacttatcttcatttttcgtattttccattctgagcacatttcaaatgcatgctaataaaattgtagacattatttttaaaatgataattgaaggcaaatttccatatttgagaaaaaatatctcaaattggagatttctcatattgtttcaaacaaaatataagggaccaagacatagcctggtaatttttttaaattttaagaaaacaaatcctataaacagtgaattggggaaagcaaatcaccttcaaatgaactaaactcatgttggctacagatcttgtcctctagggaactaaatgccagaaggaaaaggactgatgttgtcatttagtcatcacatcatcacaatcactaacatttactgagcacttaattgaatcgaagcacttttatttgcttaaccaacgtcttatgaagtcctattttaacagggggtacagggacttattcattgtctcacagattgtaaataatggagctgaaattcaaacccagtgtgatccccctaaactctttacattctgcttaaccatttatagaactttctttttttttttttttaaatggagtctcaccctattacccaggctggagtgcactgatgtgattataactctctgcagcattaaagtcctgagctcaagtgatcctcctgcctcagcctcccaagtagctgggaactacagatgcgtgctaccactgccagctacatctatagaactttgaaggaaacaaattgtgatgcaaagaggttatcattgatgggtacaggagtttagaaaatatgcctctctcctatgtacttcaataacttctcaaagtctttctgcaaattaccaagatattaatcacaatgaattaaataataggacattacagaagaaacagacaggtgataggcatccacccacctcacatcttagaactaagtgttttaaatcaatgacctctaatggggtaggatggatgctgagaagtctaaataatggacttaacttggatacaaaaatgttaaggccagaacaatttttcatgtcacagttttaagaagtcagacctgtccttgaggccacatgaggagcatcattgtcgagtgtggcctggcttgctcgtgggggaattatgttgcagttcttagagatgtcctctgtggccatagctgtctctccctgggttacaccctacttctcagtctcattttttgtttgtctttcagctgaaactaagatctgcttcaaatactaccatggagtgagtggggccctgcgagcaaccacccccagtgtcacggtcaaaaactcggcagctcctgtaagtctcatttctccgtctttggttagacctaactctggtctttcttcactttcctattttgttcttgtgcgtgcgtgtgtgtgtgtgtgtgtgtgtgtgtgtgtgtacgtgtacatacacacatatggagatatactgatagattgattatgaataaatggaaagacacctcaaaatggtcaagaggaatgagatccatagtcgaccttattaaagctcatgctacacttgtgtgttagggaggagccaagcttctttattttccttagatggccaaatgtttctaatagagacatgtgcaatcacagtgaagaagccttttctttggatcacattttttaattgtttggttttaaatatttatattttcttatgtttttatttcttttagtcttgtaaataaattaatggagtaggatttattgcctcaggttgattttagtcatagaattataacatgataggcctggaaagaccagaatctctcacccttctctgtgtataaatgaggacagtggccaaggagcctaaataatctatctcaggtcacagaactcgttgcagatccaggatttaagtcacttcttttgttccctgctgtgtggctttgctcaggcctgtggtaatagatgccatcttcctaagttacaatccagttttaatctttgtagtgcttctcacttagttcttaatgcatctgattaggctgaaatgcactgagaaatggcattccttttccttttcacataaattttaaatgaccaactggggaggctggacagaaaccagtggaggactttgtcatgctagtggaaataaaaaagactctctcttttttttttttttttttttttttttacattaaaaaaaaaacaggccaggcgcagtggctcacgcctgtaatcccaacactttgggagtccccaggcaggcggatcacttgaggtcaggagtttaagaccagcctggccaacatggtgaaacgctgtctctactaaaaatacaaaattagccaggcatggtggcaagcgcctgcaatcccagctacttgggaagctaaggcagaagaatcacttgaacccaggtgcagtgagcagagatcgcaccactgcactccagcctgggcaacaagagtgaaactccgtctcaaaaaaaaaaaaaaaaaaaaagagagagagagaaagtatttgacatgaaatatgaatgattcagaaaggactttgactccaaaaaatattccattttgctgctttgcaaatcagttctgcagcatcctgaagatgagctaattgaggccttggtagtaagcagtaaggtaagcaggcccgaggcccaaagcctggctgcctccatcctcggcaggactggacactgaactgggtttcccatcccggaactcatagcgggaagcgcagtgggaagagagggagaggcacatgtgcttttgacggcttcgctgtttttccctcactggccatgcagattggaacgtgattcctgtctgactcggacagcaatttaagtgtgagaatctagggaagtgtcctcagagtgccagaacctctcttccaggcccgtttgtttgggcatccctcaaaagagggtaccccttaaaaccagacatgtcctgacacctgttagccaatcattgagggtggagtgacaactaaatcaaggtagcttagagacagctaaatcgaggcagaaaagaaaaagtgaaccagaagctagggagacagagcaggaaggcactgagcacacaacaggcagagaaggaaggaggcaggaagtggagtgaagccaattagggaaaacccttccactgcaggcctggcctcttgccaacacacagcagttcactgaatgaggcagacacaaggatcccttagcaggaatgggctgtgcccactgatgggactggcctgttggctcaaggctcgtaggggagaggagttcctcaccttcttctgctctggaatgatactgtgggtgtgttggccagccctggaattcaaattcttacctgaagcactttttcttatttaaataaagctccctagagcatttgtcgtctctgaactcagcctgctggagactccagatgttcacctgctgctcagaccagtgcaaaatgtgacacatcatcacagtgttgtgcaatgtaggcttaaaattaagcaagaggccaactgcccagaaaatggcctctaaagtatgatgtacagccccttagggcaggataaattttcaacaagcatatgctccccaagggctgccatcaccagaaacaaaggcttgtacctcagaagaggaaatgagatgcttccatcacactgttgacataaggttcagcaggtgcctgattgctactgccctgacctcatctttgtcattccacatgagctgctgctgctcatacttcaaactctggcatcttgaaatattttgacatattgctgtcaccctgatttttatctccttaatgattttgtcacacaaatcagtagacacttgggttgacacttgaatgtacatcctgcagacaacttctagtccccaagcatgtgagagctcgatcgcatagcccctctgccaccagggacaaagagagaaatcctgggctcctattgtcatggtgaaaatgagtccctggagtcccagggcagaaggcagtacacacaatcccacaggactgtattttcacgggcaattaggtttcataggagccactgggaggagccccctttgtttgatggcgtggcacacttttcaaagctgtttatcacgcattattctagttgatgcccagcacatctgtggagagaggcaggaactacccttctggttaagtgatcatttggctatatggtgatggagcagaaccacatttcgcttatactttttgcaacccagctcagtttgggtataatctagcaactttccgggttaaataagcctttgcagtctcgtctggggacttgagcacacagtttctaaggggaaatgctgtgaggtttccctctatcaatttgttgataaacttggagtgtcaacttctaggttgaggattgctgctgctgcattcatctcttatgaagagttgctgtgtattgccattatatcatgtccccaaagtcactgagttggtctgtgacaatacgctaaacctaccattctttgaaaaggaggaacaagctgtcacatgctcctttggtgtaatcagcgctttaattttctgagcattgtatggtctcacgatgcatcaattctttttctcattgtcttgttccctctcatctttgtctttgtcccatgggcaactgttgaggtccttgtttaaaaagaggttgtcttctactcttgtctttctggggctctcatttattgtatatcagaaactatgatggatgtgcttatagagataaatgaaatataagccctgtcactgagaactcacggttactccattataaattataatactatataaagtctccagtactggagcgtgaagcctgctgtgctgatgtatagagaaagccgtgaccaggcacctgcagcagctgtgctggctgcggaggagggggcgtggcctgaggcaggcgccatgagtgggccttggccatgccttgaagacagacaggcaaggccagcagaagggatggcctgtacaaaggcacggggtgagaaatggctcaggcctggcagggaaggagacctagttgtcttaggtttaaagaatataggacttattgtccctatatatcttcctgtttttcatactttttgtgtcttattagtagcacctatcacgttttatgtctttcttttattttctgtagaaaatcactgtcaaagcaagctcttcctctccatattctggcccttgctaactcccccttgtgcattaccattacagtcttcttaaataagccccatgatatatttttctttctctgattatacatcaaaaaacagaaatcagcccatcacgacagtttgccaaagacagggtgggtaaactgtccttagcccaacacacagtccactgaaaataaccaggctgccctgctgggtctagacctgacagtgagttttcacatcctcctcttcccactctcaggcacccagccggcatcatctgtaggggctgctggagggagtgggggccctccctttgcctgccggttctcctgcagtgccggagactctgatgcagtctgaagctgttggtgtgagccaggtaagtgagagtctttcaagtcccgagcatactgctcccacacctggtttatgagaccctccctacagagcgttcacctggcagtgcagtgggcctcctccccacccactctgaggcctgggactgcggcctccagatagaaaataggtagctggggaatgactctggtagagtccaagcaatcgggaaaggccaccagcatgcagggcaggctgaggacatgacattcccacccgtgtggggccatctactctggagtagagacttctctagatttagaggctgggtcatgtgtagtcaaagatgtatttcttatgttgtctttatcagcattaaaatgtgtggaaaacccatcaggattatgttacactggattattcttattcttacctcagattgctattgtttatttatttacttcatattctgtatcttctggctctttcaatgagaagttggaagtaaacataggaaggtcctcttcttcttccttcatgttaatctagtgcctctgcaaccaagcttttgataataactgaacagcataacattcaaagtaaagttatttgccaaagaacaaagaacggctgggtgcagtggctcacgcctgtaatcctagcactttgggaggccaaggtgagtgtatcacatgtggccaggagttcaagacaagtctggccaacatggcaaaaccccatctctataaaaaaataaaaaataaaataatattagccagcatggtggtgcatgtctgcaatcctagctacttgggaggctgaggcacaagaatcacttgaacctgggaggtagaggttgcagtgagccgagatcacaccactgcactccagcctggtcgacagagcaagactgtctcacaaaaaaaaaaaagaacaaagaacaaatttaaactatcttttcactagttcatgtttacagattcatatacttgtcagaccccctgagcagaggtaagagttgacactattctcttaaaaaaaaaggcaactcaataggacatttccacaccaatataggctaaattagcactctaaaatagggccaagattttcctcctccacatcagtctgagtctcctgcagtggacaaataattgataaataccctcccttccccaaattctaggtcattacctttggctatagtagcatttttcttggggattttaaaagtagatatttcaaaaaaaatttcaagtcataataaagcaactatggaccagctgctataggttataaaatgtcctggaaaatacttcaaccaagttagtagcattagtagcaaaaggaatccacaggttgccgactgatgggaccagctacctagaattgttagacataagccaattaatttggaagacacctcaactttataataaatggtcttgagcccttgtgcttggcagagattaaatggcaagaccaggttccaataaacatcaatcaccatgtatcttcaatattggggtgaaggtccccaaagttgccaaaggatccccttcatccagtgtgtccagatgaagtctcaattttacccttgaaatgtgtcaaaaaggagtatccaaaaactaatggagaaggagagtttgttctctgtttaattgggatggactgcattgccccagtgagatggacccaccccctgagatcccgggagagcaggcagccttacacagacctcagaaccacaggactgcccaagatgctattttctcttaattgtagttttctattcattatgttatgtaaagaactgtctctgcacaaagagggacttggggaaatttcagagtcattttcctcaactcgtaagaaaatggggctttctaaggatttagttggaattctggctttcatgatatcaccaggttcatggcactatagccatgttcttaaacttgcctcatttccagttctgattttggaaacttggccccattgtattttgggaaagtgacatggcatttattttttgacttggattttataatagcctttgtgaattgttttcctgttgccttactattacatccagaatttatttttgcagcatatcaccaatacttagctaaccagcactaaaaggaaacctcattaacaatactatgatgagacaaaattttgagacttagtccctaatattctgaaaatctgtttttaactgaagtaattctagttatgctagggaagcaagacgtctgaagaagttatacagtacaatattctatttttatttattcccttcataaatgtctgctagccttttcttagaggagaatttaagaaagcattttgatttgtaggagctatagattaaatgatacagataaaacacaataaaagtaatcttgagtgcttgagctagaattacatacatgatttatttacatgcaaaggatcaatgctgcccagacatttactagagagttttagaatgacctttttaaggggttattttacaagatcttctgactattgttaacttttaaactttgtctccattctcaaaagtcaagggtggaatagaaaaggagtttccaagggtgatataagttgatggttagatatcaacataatgtataatttattctagctgagaatccacatcacattttttctcgctgctaatctggcaaattgttttctgatgctcaaagcctcttgcctctaatcttcttttcccagaacctgcttccacttcctcagcccttctgcttccacctctccagtccatgcaacactctgcccctcaaccatggaggtctgctcagaacagttattctgggcatctttatgtagtctgtgccttcagtgtcatttatgtactcagtaaatatttgtcagtaagctccttggggctaaccattaggcatgtaaaaccaaacaagacaaatccccatgctcatcaagccacctgcctaagatacgggcaagtgtgtagcggggagacagacaagaaaacaggcaatgacagagcactattccatgcctctggaggtggacaatatagggtactttgtaaggaccaattatgggcaggcccagaacatgatgcagggttttccagaaggagtaagctgaaatgtgcacacaccacagccatgatttctgatcaagccttttatttcttgtaagcaaatttaacccagaatatagtggcagcttattcataaatgtgtctcctgcaaaagtcccttcaggttttgatcagactaatttcaggtttgatcagcagtggggacatttgtacatttgctttttgggcaaggcatcaggtggacttgcccttctagaacagaaagaaagggaagggattcggcatcctctctctagataatttacccaggccctactcacaatctctaacctctcaaagaggcattttggaagtttagattctatcctagcccaacattaaggaatctgttcagtttgaggggaagaggtccagagctcacactaacgaggcattctggggtctcaagtctggagatgctgttttctgaaacacctttcccaccagctatggttcagctgccatagtgtaggggtgggtggtttacatccttcctgtctggactctaagaagcaaaacgccaaatagcattctgtgatccccaatagttggttctaaaccttctcttcaagttgcattttctgtagaaatgacattagaaaaaatttatggaaagtggaaatggaaatcctaatggaaagtggaaatcctttctatgtttgtaagagccacattctgaaattggggtcaggacatctatgaagccctggtgtttcatgggcacatttgcacatgttgctaggaatggatccaaggcactcatcagataaacagggttcatggctccagaaagataatggacttctgtcacaggaaatataaatgtcactctttgctgacataaagagacaatttagggccgggcgcagtggctcatgcttgtaatcctagcactttgggaggccgaggcaggcagatcacctgaggtcaagagttcgagaccagcctgaccaacaaggagaaactccatctctactaaaaatacaaaatttgccgggtgtggtggcacatgcctgtaatcccagctactcgggaggctgaggcaagagaatcgcttgaactcgggaggcggaggttacggtgagccaagatcacgccattgcactccagcctgggctacaagagtgagcgaaactccgtctcaaaaaaaataaaaaaataaagagacaatttgacagtcttggtactgttaaaagtctacctttgcctttttgggagagaacaccttaatctttggcagcactatgaaagctggaattatttatttactacctaggcatttactacctgacctagaaattgtgaatgaacacatcaagataaatatattcatatgatgaatcttgacatgaatatatccagtgacctagaaaaaagaggacgtgaaaattaaatgaggacttcttaaacaaaggcttttctcttctttctctgcagcagggtccaaatgttgacttctcagggattagaggcaaggagcttagcacagaatagacaaaacgaaatgttcactttccctaaaacaaaacgaaatggatgagttcacaggtgaagtctttcaaatgatggagggatagataaatctgatacagcttaagcttttaagagcaaaatcaactaatttacatcattaaagaaaagacaaaccatctgacaaatgggccagaacctaaagtcagtttttaggggggaaaaatgcaacggccaataaacacacaaaagatgttccatcaagagaatgagaagacaaattacagactggaagaatatatctgcaaaatacatatttgatcaagggctagtattcacaatgtaccaagaactcacgaaagtcaacaatgagaaagcaatcaagccaacttttaaaaatgggcaaaacacctggatagatatctcaccaaaaatacacaaatggaaaattagcatatgaaaagatgcccaacaatatatgtcattagagaactgcaaattaaaacaatgaggtaccaaagatacctattaaaatagccaaaatccaaacactaacaacaaaaaattctgtcaaggatatggagcaacaggaactctcattcattgctggtggaaatgcaaaatggtacagctactttggaagacaatttggttgttacttacaaaactaaacatacccttaccatatgattcagcaatctcactccttggtattcacccaacggagttgaaaacttatgtccatacaaacatcttcacatgtttacagcagctctatccataattgtcaaaacttggaggcatcttggatgcaagatgtcctttagcaggcaagcagataaattgtgctacatccaaacaatggaatattattcagtactaaaaaaaaatgagctgccaagctataaaaagacatgaggaaatcttagatgcatactactaagtgaaagaagccaatctgaaagcctacataatttcacaattcatctatatgaccttccaaacatatggagacagtaaaaaagatcagtggttgtgaagatttagcggggaaggatgaataggaggatcacagaggatttttagggcaatgatattctttttttttttttttttgaaatggagtcttgctctgtcacccaggctggagtgcagtggcgcaatctcggcccactgcaagctccacttcctgggttctcgcgattctactgcctcagcctcccgagtagctgggactacaggtgcccgccaccacgtctggctaattttttgtatttttagtagagacagggtttcaccatgttagccaggatggtctcgatctcctgaccttgtgatccacccgcctcggcctcccaaagtgctgggattacaggcgtgagccaccacgcctggccaatgaaattctttaatatgatactatgatggtggctacatgttattatacatttgtcaaaacccacagaatatacaacactaacagtaaccactgatgggaagtatgcactttgggtaataatgatgtgccagggtaggctcatcaagtgtgacaaatatgccactcttatgtggaacgttggtagttggggaggctgtgcgtgtgtggggacaggggatatatgggaatgctgtgctttctgctcagttttgctgtggacctaaacctgctgtaaaataaatgaaaggctatttttttaaatgctccaatcagaaagcaaaaattcaaaagttttatggtacccagggatgataagagagtgaaagaagcatgtgtacactattgggcccatttttttcaaggcagtttagcaaaatttatcaaatttatcaaaatttatcttgggcatatttgcaaaagctatttgggatatatagacaaaattattcattgctgcattgtgggaacagcaacaacaggaaagccagtgtctccgttagggagactggatgatacactctaacggcaaaagcagcaggggagcagattgtgattatggggaaaggttctcaatacattttttgttgatggtggattttgttttgttttgagacagagtttcgttcttgttgcccaggctagagtgcaatggcacggtctcggctcactgcaacctcctcctccctggttcaagtgattctcctgcctcaacctccctagtagctgagattacaggtgcccaccaccacgccccgctaatttttttgtatttttagtagagatgggatttcaccatgttggccagtctggtcttgaactcctgacctcaggagatctgcccgtctcagcctcccaaagtgctgggattacaggtgtgagccaccaagcccggcctcaatatgttttatgaagtgcaaaagcaaggctcagagcagtgcctttaatattaccccattgatgtagtttttaattaatagttagaaaaattatttccaggaaaggataacaagaaatgagtaacagtgactacctttgaggattatgtgggggtggggtgtgcaggatttcacttatcattctgtgccttttcttttttacctgtttatatttactaacaaagggttattttcctttttttattattattatactttaagttctagggtacatgtgcacaacgtgcaggtttgttacatatgtatacacatgtatacatgtgccatgttggtgtgctgcacccattaactcgtcgttttcattaggtatatctcctaatgctatccctccccgctccccactgttttcctttttttagacttgtttatgttttctaacaatagatttcttttttaaaaaaatcacaggaattatcaaaatagtgggattgtggctttttgtgttttctctgttaactattttaacatctataatttttttaaataaatttttttacaaggaaaaagccttgtaaaatatttttaaattttttttaaatattcccttttctctcttctcatgactggtctggctttatctagatgctcaaacttgtagtgtcacaatttagtccttgatgcaaagggaaagaatgttggcatgtgctaatatatgagtgctaaaacggttgccaaatccctccttttccagagcaggggtcagacgctcatcaagtgatatagatgcctgtttagtctacccatcaaccccacagccattcctatgggaatgataaacagaaaagacaaaaccaatcaatactgaaacccatgatttaattaaatccagagatgaagaaagtgcttaggccagaaatggagaggaatttctgatgattataatgtcattaagatgccccaaacctggagcaggaagagatggaggcaaagcagactaacggtgctgggagtcactgcaggcatcacagtgagctctgtggtgctgcccatgcacgttggtgtcgttctgccttcttccttttttttttttttttttttctttttgagacagagtctccctctgttgctcaggctggagtgcagtggcttgatctgggctcactgcaacctctgcctcttagattcaagtgattctcctacctgaattttgtattttagtcgagatggggtttctctgttggccaggctcgtctcaaactcctgatctcaagtgatcctcctgccttggcttcccaaagtgctgggattacaggcatgagccaccatgcccggctcctttcttttctttcttttccctgtctcgctctgaaaaaagaatctcactgttttttttaaacttatttttttctttgcctgtgcctacaaatacaaatttgagtaaactgtcccttctaatggctggtatagtagatttacatgtttgtttttttttaatttttaattgtggtaaaatatacataacaaaatttaccatcataaccatttttcagcatgtagagctcagtgacactgtgtgcattcacgttgtccaaccatcatcaccgtctatctccaggacttttcatcttcccaaactgaaattctgtccccactaaacaccagctcctcattctccccatcctcggagcccttggcagccaccatcctacttcctgtctctaggaatttgaccacactaggcacctcatataggaggaatcatacagtgtttgcccttttgtgcctggcttatttcagtgaacatagtatcttcaaggttcaaccatgttgccgcgtgtgccagaatttcctccctttttaaggctgaatagtattccctagtatgtatatgctctattctgattatccattcctctgtaggaggatccacgggttgcttgatataggtatttctttgaggaaactccactggttatttggtcaggaaaattatttgttgtttcattctttgcattgaaataagttatcactcatttcatataaaaagtattctggggttcaaataaaaagaaacactacgaaaattcatagaggttggctccttttgaaataaattcaatgtaaagaaattctagaaaattacacctgttctctacatgattcaagagaacattgtatctttgaaacttcctgagagagcaaagaatggtaagaaggacagtaaggagataatgggtccaaccttttgaccaacagtcacaggtatgtgacttagagaccacgggaaaaggaattactgaattagaagacaaactaaaacaaaatcatccccaacccagtggaaacagaagatgaaaatagaactttttaaaacccagaaatctaatttatgaacaacagatgcactttgggaggccgaggcgggcggatcacgaggtcaggagatcgagaccatcccggctaaaacggtgaaaccccgtctctactaaaaatacaaaaaattagccgggcgcagtggcgggcgcctgtagtcccagctacttgggaagctgaggcaggagaatggcttgaacccgggaggcggagcttgcagtgagccgagatcccgccactgcactccagcctgggcgacagagctagactccgtctcaaaaaaaaaaaaaaaaaaaaaaaaaaatagagaaatataataaccagtgaaaaaaagatgaaaatattttttatctaaaaaaatacatacctaattaaaattgaaattcttcatatttcagatagctggaattgatataataaaatatatatgtaggttcatagtagaaaatttgtagacacataaataagaaaaaacaataataatccaatacacagcaagcttctgcaactacatagtccttcttaccattcattgctctaataaagttttaaaaataaaatgttcttttgaatcatgttaagaacattgtgaaatttcctaaaatttccttcagtttcttgcattgaatttactccaaaaggagccaaggggttcctggaggaagaatttttgaactgaagaatgctataaacaaacaggagaaactgtcggacgcctggaaaatagcaaaagccaagaaaatttgaatgttctcttcacagcacaaagatgtgcttggtaagatgtctatttaaagggaaaaaaaaaatagttctctactgtaccagttgtcagtgatatgtgactatgccaaatacagacattctcaagcacgtaaaaatagagaaattgcccacatgtcaaatatacgatttcaggattgcgaaaattgtggatggcagaaaccggtagtgaataaggaaactaattacttataaagagatatgctgaaatgattgcaaggatgtattattattttattacttaaatatatattgtatggcttattgcaccaattagctaaataaaaaataataaagaggtattctgtaacacttgtttttaaaaaagctccaggccaggcatggtggctcaccaataatcccagcagtttgggaggctgaagtgggcagatcacttgagaccaggagttcaaggccagcctgggcaacatggcaaaaccctgtctctacaaaaactacaaaaattagccaggcatgatagcatgtgcctgtaatcccagctactggagggactatggtgagaggattgcttgagccctggaggtcaaggctgcagtgagccatgatcaaaccattgtactccagcctgggtgacagatgagacccttctcaaaaaaaaaaaaaaaaaggaaaaaaagctctttaaaaatcaagacttgccatggtaaagataacatttgaatgaaaaaggcagtataattactggttgaggtgcatatatataatcatatatatatatatgaaatatgtatatatatacacacatatatatacacacactattttatttttatttatatgagcttgatcatctccacataacccaataaaccaaacatatactcacctattacaatacttaaccatgaaacactagaggtttttagaattaaaattaggaccaaaataagcgtgtaagatgccaccagctctaacatttaaaaagtaaaatagtacatgttccttgggaatccatataaacagaagaaaaatgtcaccgtaataatctcaccacccaacgagcctcaggaacctgcagaaaggaagggctttttgatcatctctgactgcagagccagcaattaaaataagtatagcaagtctccctgggatgggggtagccagccagcgtctgggctatgtggattctccaggccattggacaccatgccctttactcagtaggtgcccgtgagttggcaaaagtctagctgattacatcctggtttttaaatcctaaatggcctctcaataaaaactctttgtattaacatttcactgaaggataaaaaatttcaaatatagctcggcacagtggcttacacctataatcccagcactttgggaggcctaggcaagtggatcacttgaggtcaggagttcgagatcagcctggctgacatggtgaaaccccatctccaccaaaaatataaaaaattagctgggcgtggtggcaggcgtctgtaatcccagctacttgggaggctgaggcaggacaattgcttgaacccagggggcagaggttgcagtgagccgagatcgtgccattgcactccagcctgggtgacagagcaaggactctgtctcaaaaaaaaaagacatttcaaatatatagatcttgatttcagatttgtaactttcaactccagcattcaatttagtggtcacactttagtgaaaaaaaaagacttttcttcaggtaaaagtcttgagaaaaataaattcttacttcccaaggatctcacagagccaacatgagtaaagttagtctgacttgtaagcaggtgaatgaatgtagcacagaggcattcggacaagtcagagatgcctgggactgtgctcttcccatccctggcctcacccaacaccatgagacccagagtagggaggaaggcagcccaggcccatctcctcctccataccaactaccttttcaagcctgttctgaaggcagaatgttctaccatcagtgctttttacccttcttgctctatgaggacagggaagttcaggtcgatgaacaaatggattaactatgatcaactcatttcttttgcttcaaaacacacattaagactaacccaaggagcaaagccctcaaaatgcgcttactcaagagtttgtggttcactgtgacctcaccctgccccctcacaataattaatctcaggttctagtagagcattagatcccacttctttcaaccatctaaactaggtgaaagtgtccctggatttaaggtgctgtagattaagacaggactggtgcttttagatcaggggttttctccggtgggctgtttcctgaaagagtccaaaaaattagaatcaaatccttgcatatgaatgcacagaaataacattttttttctctttgtgagtttttcctatgttacttacagcaaagatggcagaagcccttaagttaatgaagtccccaggcatgttgccagggtgtaaaggcccttatctgtgtgctctctgccaatgggaagtcggaattatcaagcagcccttggatcaaagggaagtctgatcctggggactttcttatgcctcccccagagctatggataatttccctgcctgcattcttcactgcaactctcttttatgagaaatggctgctctggcagaacacaaagatgactgcatttccaaggaggttagtagacccttagcattaatgctcagtttatgggtacaatgtagttatacatccaaatttatacatttacacatagtcactaataaatagttgtgttttaaagagttgagtttaattggaaactacttaattttattagccaagtatataatatgtatatatgtgtgttacactttcagatttgaaaaaaagcttgcttgcttaaaattgtcaacattatatttttgtaatctagttattctaatctaatcatcttctttgtagacccttcatttctagaaatttctaagtctctttagtttgccttttattaaggacttagcaaatatgaggtgattttgctctcctgtgtacacagtgactactggatgaggagagaggagaggacttgtcaggaataggattattcaagagcaggagaatctaacttttcagagagcagcctgtaacaaagagctatctagaacaatcatgtggtttatgagcggagctctctcagataacctgccttagaaagattctgcattgtcctgtcagacatcccaaatacgcatggttaaaacccttggcactttcggccaggcatggtggctcacacctgtaattctagcactttgggaggccaaggcgggtggatcacttgaggtcgggagtttgagaccagcctggccaacatagtgaaaccccatttctactaaaaatacaaaaaattagctgagtgtggtggtgtgcacctgtaatcccagctactcaggaggctgaggcatgagaatagcttgaacccaggaggcagaggttgccatgaactgagattgcgctactgcactccagcctgggcaacagagtgagactgtctcaaaaaacaaaaataaaaacaaaagaaggaggcaatgtcaggcaagggcagagcagcaggaatgatggtgaaacagacaagactgtctcaaaaaacaaaataaaaaaccctttgcgctttgaacaggaaagaaaatagggacaacctaccttccagacatagaacatggggtggttattgcttatgggggggcggtgtgcccttgctcacacaagcactgtgttggactaataggcataggaagttaagagcacaactgaagtaaaacaaaacccatcaccctcacctggcaaaaccccaccctcgttaaacttaattctctgtccactctttacttgcatgcaggcagcataagagtgttcctttaatcttatgaccacagatctcaagctccctttaacgctcaatcccagaagcactgcacctctctgatgtggagagaaggctgctttacacttccattttcctcacacctagagtgcccttccctctctcactgagaaatgaaggcaatcagaacacagccagcctgcctgcacacacactcccatgctgtgcctccttccagtgacaactgtctcaggccagcctctccatttgcacatgggatcccatcccatcttgtctttatgcagccttgatcctgaaagtagctcctccttctcctgcatagtccactgtcctctccgctcaatcacttccatcccattacataacgattccactcagaactctccagtggctttttcaccatcattcctgctgctctgcccttgcctgacactgcctcattctttccacctaattccagcctcgagagtcctctttctaatccttgaatacagcaagatggttcttccctcagggcccttgcacttcaggtttctctgcttgggacagttcctccaaataaataattcactccctccccccatttagatcgttttctcaaatgtcccctcctgggagaggccttacatcaccaccctatctaaactattctccacacagctctttattttctccaatcactattttcattcatggtgctcgtgttgtaattgtgtttgcctccctcctaaagggcagcctccaggggcagagatgtacctgcctgtcctcttcagagctgttccttatcacccaccagagcagtacctggcacacagcagacggcccataaaacatttgtatccaacaaacatgggttattccctggctcagccacttaataacttggtggccttgggcctcaatttctcttttgttgagacaaggtctcactctgtagcccaggctagaattcagtggtgttatcaggttcactgcaactttgacctcctgtgctcaagcaatccccctgcctcagcctcctgagtagctaggactacaggcacatgccaccacacctggctaatatttttaaaaatttttaaatttttgtagagatggagtcttgctttgttgcccacgctggtctcaaactcctgggctcaagcgattctcctgtcttgtcctcccaaagtgctgggattacaggaatgagccactgtgcccagcctctttgagtttcttttgctcaacattacttttgtaggattaatccatatcgtgctgtagtttttcattcttttgtgtgactgtaccagtttattctactgttgatggacatttgggtttagtgttgctgctatgaatatttttatacatttttttggtgaatgtatgtgattttttccccctagatgaagttttgctcttgttacctaggctaaggtgcaatggtgagatcttggctcactgcaacctccatctcctgggttcaagcgattctcctgcctcagcctccaagtagctgggattacaggcacctaccaccacactcgggtaatttttttgtatttttagtagagacagggtttcaccatgttggccaggttgatctcaaactcctgacctcaggtgatccacctgcctcggcctcctgaagtgctgggattacaggcatgagccaccaggcctggccaatatatgtaacttttgatgggtatataattagggtgaaattattaggtcatggtttatgcatatgataatttttagtagattctgctaaagttttacaaagtggttttacaaatttacacttccaccagcagtgtatgagagctccagttgttccacatccttgctaacacttgatattgtctttttatttttagttgtgaaagggtatgtagtagtattgcagtgtagctttatttgtatcttcctgatgattaatgaagtgaacattttttcatgttagggaccccaggtttattggccattggattcctgcttttgtgaagagtttgcaaaatcttttgtcctcttttcccattgggctgtttacttttttcatgctaatttgtagttctttatatattctggatatagttctttgttatatatcttctacctgtggatggcattttagaatcttggtgctgtggtgaattaaagttcttacttttatttatttatttacttcttggaggcaagagtcttgctctgttaccaaagctggagggcaatggcttgatcacagctcactgcagccttgaactcctgggctcaagcaattctcccacctttgcctcctgagtagctaggactacaggcacatgctaccatgcatggctaattttttttttttttttttgagatggagtcttgctctgtcacctaggctggagtgcagtggtgcgatatccgctcactgcaacctccacctcccgggtgattctcctgtctcctgtctcgacctctcaagtaaccaattctctctcctgtctcaacctcccaagtagctgggattacaggcatgtgccaccacacccagctaatttttgtattttcagtagagacagagtttcaccatgttggctaggctggtcgcaaactctcgacctcaggtgatctgcctgccttggcctcacaaagtgctgggattataggtgtgagccaccacacctggctgataattttttaaaaatttttttagaaatggggtttcactgtgttgcccaggctggtctcaaactcctggcctcaagcagtcctcctgccttggcctcccagagtgctctgattacaggtgtgagtcaccacacccagctgagcctcaaattctggatttataatgatatggatagaagataaaaatagaagcccctcacgcctgtagtcccagcactttgggaggccaaggcagatggatcacgaggtcaggagagcgaaaccatcctggctaacatggtgaaaccccgtctctactagaaaatacaaaaaattagctgggcatggtggtgggggcctgtagtcccagctgctcgggaggctgaggcaggagaatggcgtgaacccaggaggcggagcttgcagtgagccgagatcgcgccactgcactccagcctgggcgacagagcgagactccgtctcaaaaaagaaaaaaaaaaaaaatagaagccccttcagaggactgtggaaagtgtgtctgaggatgcggtgaagcaatgcctgtgatgctctcagcacttgccccacatggggtaactacccagtaaaagttaattagtactgttttgtgagcttttctataatgtttctctctgggactactccagctctctggttacaaaatacatagatttcaacatcatagagaaaatgcatatttggacaacatatacaaaactggaaagtgcaaaaaataacgagttactgcctataagcaggagcttaatccctcattcaagatgtctcttttaaaggaatttactgaccctagaatagtatctgtaagatgaatagacagtggatctatcccaccagatggaaggatagatgtggggggaggggttggataaatgagtgaactgagtggatggattgcacatagttcaaaatgatgactgaaatgtggatttattatcttactttaagttctgggatacatgtgctaaacatgcaggtttgttacataggtatacatgtgccatggtggattgctgcacccatcaacccgtcatctaggttttaagccccacatgcattaggggtttgtcctaatgctctccctccccttgtcccccaccacccaacaggccccagtgtgtgatgttcccttccctgtgtccatgtgttctcatttttcaactcccacttatgagtgagaacatgtggtgtttggttttctgttcctgtgttagtttactgagaacaatggcttctggcttcatccacgtacctgcaaaggacatgaactcattatttttttatggcagcatagtattccatggtgtatgtgtgccacattttctttatccagtctatcattgatgggtattcgggttggttccaagtctttgctattgtaaatcgtgctacaataaacatatgtgtgcatgtgtctttatagtagcatgatttatgatcctttgggtatatacccagtaatgggattgctgagtcaaatggtatttctggttctagatccttgaggaattgccacactgtcttccacaatggttgaactaatttacactcccaccaatagtgtaaaaatattcctgtttctccacagcctcgccagcatctgttgtttcctgactttttaataattgccattctaactggcgtgaaatggcatctcattgtggttttgatttgcatttctctaatgaccagtgatgatgagcttttttacatatgtttattggccacataaataccttcttttgagaagcatctgttcatatcctttgcccactttttgatagggttattttcttataaatttgttcaagttccttgtagattctggatattagcaaatatttctaagaaaatgcagttggcccttgaacaacacaggagtttagggcttccaatcccccatgcagtcaaacatttgtgtataacttttgactcccccaaaacttaaccactaacaccctgttgttaactagaagccttgccagtaacagttgattaacatattttatatgttatttgtattatataccatattcttacaataaagtaagctagagaaaaaatattaagaaagtcataaggaagagaaaatatatttgctagtcattaagtggaagtggatcatcataaaggttttcatccttgtcattacattgagtagactgaggaggaggaggaggaagaggaggagttggtcttgctgtctctgagttggtgctttgtctgcaagttttttcaaattgttgcaaactccaacatgttttcaaatatgtgtactgaaaaaattcatgtgtaagtagactcacacagttcaaacccatgttgttcaagagtcaactgtaatttgttgagaattactaccggttacttctagagcacaagtgagtgttgtcttggggttctccacgtaccccctggaaatgcagaagaaggtaggtgtgaagttcttggatgctggccagtatttaatgaaagattaattcactcatcccatgatccagcaacccatgggtagcaggaagccccaggaacacctctggagggaatgtggcagctgctgcaggaagacagagccccaagatggcggtgtgcctggggctggcagcaagctcacccttggaccttagagagcttttcctaagtatccatgtggcatgtccataggaaaaaagatgttacattagcaagaaaaaaatacgtctttgcctaaaacttaaacatatttttagatgggaatacaacttagaaattttaaagcaagtcagtgagggggaaaacgtttgcctttaaaaaaaatcattttctaggcatcttttcattcagtgaggagtaaatattatcatgtttttgccattacactcacatgaatgagccatgtccattcttctttggattatccctcaaaattgctcatctattccgtgagagggagtgggtggctggaaagagctctatgcaaaatgcagcccttgtcttcactaagcagactgtctgacccagatggaacagcaaccgacacacttcctatgatttcatttacccaaaggctttgcagtcgtttggtttaatcgctattttaaaaagtagaatcaaagcagtttctccctccaacctcacatgcttagatgaaaagagctaactcttgtcactcctgcatccttaactagacttggtgataaaggacaaaacgcagttctggaaggacaataattacaaggagtttcataatttgtaagaaaaagatcctgaattcaaagaaacgggttcagccaaaggggcatctctctttccctcaacaccctcttccaatcggtcaccaagttctatccattttatcacttggcagtctcccctctcccctcccctcccctctccccacccctcccctctcccctccccttccctctcccctcccctcccctctcccctcccctcccctctcccctcccctcccctctcccctcccctcctgcgtactgacagacagggtttgtgtcagtgtcactcagacactgttgcagctgcctccaaattagtctctctgcctctgtcttctgccctctaattttgtgattcacatccttgagtatacactggactcacctgggagccttaaagaggacagatgcccaagtcccacccacctccccacccccagtctgactcacatggtcttggtaaagcctggggcagctcctacaccatggcagagccgtccctcagagagctggggtaaggggctgatctccatgagttcatgttgcccttgctaacagaagagcaaggccaattacacagttcatggtttccagaagatgaagaccagccatagtttcccaggagaaatacaactgttgttggttctacaatcaggcagatatttctcccaaggcaaaagaatatgttgaaaatgagctttggatcatgaaggaaattgcttgaagaaggttgtattcatttcctattttgttgtgttacaaattatcacaaagttagctcgtgggtctataggtcagaagtcctggacagcatggctggattctctgctcagtctattgcaaggtaaaatacctgaaatcaatgtcagccaggctgagttctcatctggaagttctgtggaaaagcctactttcaagctcattcttgttgttggcagaattcagttccttgtggttaggacagaagtgcctgtttcctgtttccttgctgactcagccaggggccaacctgggtccttcatgccgcccacattccttaccacgtggtcccctccatcttccagcctgcaatggtgtgtcaaacccttctcaccttgaatctttgacttcctctctctctttgacctctaggcccagattgaaagaatttgtgtgattcagtcagccccttataatgtccctttgttaaagtcagctatcctgattccagagtaattcacagtccctgagcacatacaccacagaggcaggaaatcttggggcccatcttagaattctgcctgctgcaaaggctcagaagggtccccctagtcatcctggtatttggaggttgaaggtggaggaggaaagagaagagccaagccatcccgactcagcccagagtttctaactacccacatgatacagaaacccactcccagggatgtgcatgagccctgaagaagcagtgctgccccagctcaaacaacttaccctacatgagctgccaacacttgcccctagatccagcgtgatgccaaagcaatcagggagatgttcctgccccccctgcatgtttctgctgtcttctaattaaacccttccagaaattctgccccacccacttccccaccagcttcagctgtgtcacctatcatctcaagttgtaagccctcatctcaggtccatggactctcaaatcagctcagatgagggaggaatgtgtccatcagttccctcatttgggccagctgaagggtgtagaagctaacagaagctcaccgcactgtgcttttattttttatttcacataaggacaggttttgtttacaaaataattaaaatagcagcttgacatgaattccttagaaaacaggatagaaacataaggccaagactacccacatattaagtcaatccagatgagtgtggcatgccaggcaacgcatttgttttcctgaggtgtgtatttcaaatagagtctggatgggcagaaacatgatccagccatttagaaggtactgaggcagcttccagaactgtgttttggtcccatcttttcctcacagcagctctttcttgtcatgaaaccatcagccctcattctcccactccctttccatctctccccaccaccaatcccattgttctccctcccctcctcacacagcccccagccagccccttcccttgggctggctttgaatggatcgaggttatggaaacggattcatcttcactcttcctgttctacctttttctaagtcttagaggatccaggtctttctctgtggtctttattcaccaaaactactacagtgttggtgtctttctgattaaaggactcaggttcctcaagtttgaaggagaaagtaagttttaaatactttttacaaaggaaactttccttcttgcttctgcctgtatgtttatctaattccataaccaactagagaaacaggaccatccatcttcaggtcttttacagacttgtagacatgcagaaaatgctaacagcagcaagacatttacataggaagcctttttaaaggatataaattaccatactgataactcataggtgttagacacagaccaatgctttttgttggttttcagcttatggtatatttataactcttctaagctggaccaaatgatctaacaaagggcaacagatttctcctccacagtgaatggagggttcaggattctgggctctggccccgatttgtctggtgtgaccagttatgtgacctcgtgggccccttgattgactagcttatgcttcacgtttttcatctataaagtaaggaatcagatattagataatctgctaacataattcttaagatagaagtcagaggttaaaaaacaaatacaatataaataacaacattagcctgatttagaacatgtattatgtgacacttttatacacattatgccattccgttctcaggggaactcagtgagatacgttttattatgatctccatttgatgcaaaagaaaactgagcattagagcaattgattgcctcaccctaacacagacagaggaggagctggcagagaaagggacatgctggctccagcctggctgcctcttcacaccatattgtacacctgcctgtgaccacctccgtaaatgctcccaaccatccatccactccacatccagggaattcaacatgcattcctgaattatttatctctttgtaaagaaggaataaaacatgacttggttattatgcaatacaataatggccaacatcacatttgtaggtcaaatgttcaggacaagaactgcaaattcaaaagcttccagggagccaggtcattatcacatgtcatcagatctaaaatgccatggactttcagaccaaccattgattttcatattgccaagctagaaaaacttcctaattttaattacaagacttatgagtggtgtactgcataatgattatcaaacgtgaagcagtgggtgcttggaatgaaagaagcagtcacaggacacctggggatgtgtgatgcttctgaggaggatactgtttctcagccccagggtgttactgctggatattctgggtttttttgttttgttttgtttttgagactagcccaggctggagtgcagtggcataatctcagctcactgaaacctctgcctcctgggctcaagcaattctcatgcctcagcccctcgagtagctgggattacaggtgtgtgccaccatgcccagctgaaacactctgtgagccaaagaaaaccccaacagtttgccatgcagcccactgcccagccttacctgtgccagtgggtgcctcttgatgagtttgaaccaggtaagaatgattggcctacagagggtgggatgatgaccccttcacaggccgaggggacagctggctgggtaatggtcatccagacaagaaaggagtggggcctggaccaaggtgccagtgatggggatgcaaagaagcaggtcattgtttctagtggaagatgcaggcccaagccctgaaaacaaaagcctgtgtggccaaggggtcgccagaatctaattctcacgcaagtcagggaaagacagttttgagggtaggtgaggtttagttagagacaactttaagatgtctatctttccattaccatttaagagatgtagacccttgagagtggtgtttctcaaagtgtggtccctccaccgccagcgtcagcgtcacctgggaacttgttagcaattcagactgctggagccgtccccagacttacaaaatcagtccttctgggggtgggcccagcaatgtgtgttttatcaagccctgtaggcgattctgatgcatgctaaagttggagaacctctgcactagagcagatgccactcaattattttttaggactcagtacaatgtatgtcctcacttttagaacagtctgcactacacaagaagctatgttagagaagaatcactttacaccctaagaaccgtcagggaaaatctactattggattaatctcagctagcattttcatttgcacagtgcttcttacacattctcatcacattgttgttgctgttgttgttgttgttgttgttgttgtcgttgttttaaagagacaggatctcattctgtcacccaggctggagtgcagtggtgtgatcatggctcattgcagccttgaactcctgggctcaagggatcctcctacctcagcctcccaagtaactgggactacaggtgtgcaccaccatgcctgactaaatttttgtagagaaagagtctcacaatgttgctcaggctgattttgaactcctggcctcaagtgatccttccactttggcctcccaaagcgctgagattacaggtgtgagccacccacctggccccctcattatttttagtaagctaaaagcagcagatctttgcctgaaggagatgtattcctggtgctaaaatcttgcaggcctgtgtggtcaaaagcaatcagagtaaagaaaatcattcctaattaactcattatttccaattcgcaccatgaaagctataggataaatgcctcatttttccaacccctctctttttcctcgtagtgattagcataagagccctgaaattgaggaccctgtgccttgtcttcaaggtggtaaagaaagcaggagctgtgcagactggaagctggcttggtgatggtggcatcagaaagcaaagggaggccacgcatggtggctcatgcctggaatctcagcacatgggagaccaaagcaagaggatcactggagcccagaaattccagaccagcctgggcaacatagtgagaccccgttcctacaaaaaaatttttttaatttgccaggcatggtggtgcacatctgtagtcccagctacccaggagtctgaggtgggaggaccacttgagtctaggaagtcaaagctgcagtgagctatgatggtgctactgcatccagcctgggtggcacagcaagcaactcttaaaaaaaaaaacaaaaaaaaaacagcagagttgtggaggcagaatatgaacaaaatatgagcaaaagagatgcaagcagccaggctagatctgaggaaatgaccccagggggttaacagactctatggagttggggtagtgagttctgaaactcttgttttaagtctttcagaccaaatattgattcatctcaagtgaattttgtgaagttgtggcaggccaggtctcactaacacaggcctccgttacaactgtcccagcactgactgaggagctaggttaaacattaaaagctgattgagccagtgcccttatacaatggctggaatgtaacaaagagcccaccaagagttttgcctaggcttttcctgggccttgaagcatgacaagataaggagggaattcttaacaggacccttttagaattaaacaagttttattgggggtctgaaaaaactccccaggcctccacaaacaagtttattggggtctaaaggaactccccaaacctttagaatttggcaggagacaagataagggtaatcatcctagcacctagacccatttaaattaaataaacttactgaggctccagaagaaggtcttcaggactcagaccttagtcatagattaaaagaagttaatcacttacatctttaggtgaatgcacacttacacgtagacatatagcttagaaggtatgtaagttctggaaaactttgtaattttgagttggtctggtgataatctctatatcttctccctgtagctggttatagaaatgaaaactctcttcctccccagttcatctgtatctcattattgggccacgagaaatagcagcctgaccctcagtttggtccgggaacaaagtcattgaattgttcttagctcagctttcacatttgtaagcaggagtgggagtgaatgatacctaattcttaaacagttaaaatagtgcgtatggaagaactggctctgtgccactcacctgtgttgctttccccagcccctttgttgggacttcttagtctttatctcaagtgtccctgaggttggggagatttccttgggattcagttggcttatgtttcttttgtttaggcccctaaagttggctttgccctttcagtttacaggtctttctgttggagaacttgaaatgtgctgcctccaacagcaagcagttagaatgacagtcatataatgagggtctaatgagggaaatgcactcagcagtgctctgtaaacgtgggtaaggtgtgtttacttatctaccatttacttgtttgaacatctcagagatttggaggtggaaaaggaacttgggcctttggttggtttgctttttagttttgtttcttgctcttttaaggtggctttgaggcctatctgattatttaatagactttgtcttggaggtaaaagatactgaactttagaggaatccctagatctctgatgcaaagtggaactcgtaattccctactttcagctgccaatacaccacagcttacatattatgataatgtaatgatattttcacctcatttttaggttccattattattatggagccttatacttttcatttataggcaaatcaaagttttctgggccagatgaataagactcagtgacataatgaattttaatctctgcctcattgtcaatttaattgttctataactaaaacaaaccttgtcagcatgtttaggggaaataattctgtaattatttgagaataatcgtgggtatgtaaatggagttatcacatcagaattgagcataatgtggccacactcctattggaaatgccatatgcactaaagggagcagctccagcttttacccaaaggaagtaaacccaggtctgggccattccaagaggcagcttagaaagttcttcgaaatctcctgctttaccttccaaatacatgctcatttggcattcagctttaggtttcttcatatttgtttttaaaataaagacaatttaacccaaaattttgggtaaaatgatgttcccaggcaggcacccttgcccttgggcatagctgcttacctctgggaacagaaggggcctgtatgagaagccctgatgtcttgggaggctggaagacctgggatataggtcagcacacatatatgactgtgtgattagatgctgctgtgtatttttagcaaaccacctcatctttcatgcagtgatactgtgcaaagaaagggtaaaatttgaataacatgctggagactaaaggccgagggagccctgtcaactgagctatagtctccggactgctgaaacagaagatcccctgccagggtgaaaagagctgatcttcacactcttttgctgaattgcagttttaggggtgtgcaacagtggtgtgaattcatatttacaacttttcaaaaggcaattgtagagagaaaatgagaatgagagtaggagagaaagacatctgaattaacctcaaagctcttaatttaactccaagagcttctcaataccctgcagaatcttctacaccccacaacagattcagtttggaatctgttaaaccatttgccaagtatgctctgttgtggaaacatttgggtgcaagacacacacagtgaaactgccagagcttcaacagagagagggggggcaacaggacccagcaccaagcagttagaatggtagtcaggcatcagacaagccacagagcaaagggagcttgtcagccctgagaagaccagccatgtccctggcaggcctgcagcctcaggttgctccagggtgaaactatttgggctgagtcttcacatcattttcacagtcaataaactgtaaagagtctgtctgtgagtatagcatatttctcaacgtcaaacatgcttctgcaacgcatctcgagtgagaagtcaggttgtcaaaccttcctaagactgggcaaacatttttacttcctggaaaatgtttattatggctaccattccctccatttttgtatcatcagtgtggtgcttagatgactttgtaaatgatgttagtgaaaagccaagaatttaggtgggattttatggagacttaaatgatgtgtctcctcactgagcttagtagcttttggaaaacatactcttttttcttcttcttttttttttttcatctacagacctgtttttgatgcaataaagatgaagaggcttctttgtaaatactatgaatgccagcagaggagtatttaaatatgaagaaccaaaatatgtatgctttaaaaaggaaggaataaatgtaccatcctttgttatcattgcatgtttgagctcatttcagcttagcatgaaatacgccatttaatcctatacttttaaaaaatatacattggaatgcacatactctagacttacgattctataaactataattattaaaattatagtttctattgttcccccaaagaacttttattcttagaaagagacaaatttggggtggacatttttaaattagaattaggagccagaggctttagccattgattgttaattgtcctggtggtgcagtatagcactgtgaggaggggtggtcagcatgtggaggtctcccacagccatgtccaggcacaggcttgcaagagaagaaaagtccacaacactaaggaatttggaagccctgattatgccatgaggactggccaccttcagagttaagaaaagcatggtctagcctgaggatgtggtctctgaactgatggctgatctccatttcttggtgtcagccattgatgggaataacagacataaaggaggagggagaaggccctctgatgtgaagaaggctaattgttgtcaaaatgccagggatttattctaggtcccattgctccatgcatagaaagccaatcactgagacaatgagtattgccaggaaagaaggctttttatttgggtgatgttaactgggagaataagagttaagtttcaaatccatctccttgagcaactaaaattggggtttatatatcagggaaggaatgtaaaacaggaacaaaggaggagtctaaggaactaaggaagatgaataaggggtatggcatccaatggtctagatctgggcatctggtgagtttcagtccctcacctgagagtcagtttcctgaggaaggaattccaatgagactgtaactgcccaaagggttcaccttgcccactgtctagacagagccgattcatcaagacaggggaattgcaatagagaaagagtaattcatgcagagccggctgtgctgtgcgggagaccggagtttattattactcaaatccatctcccggagcattcaggggacagagtttttaacgataacttggtggggcagggtggagtagtgggttggagggggtggaagctagtgagccaggaatgctgattggtcagagatgaaatcatagggagtcggagctgtcttcttgcagtgggtcagttcctgggtgggggccacaaaatcagactagccagtttgttgatcttgtggtgccagctgatccatcaagtgcagggtctatgaaatatctcaaacactgatctcaggagcaatttagggagggccagaatcttgtagcctccagctgcatgactcctaaaccataatttctaatcttgcagctaacgttagtcctacaaagacaatctagtctccaggcaagaaggagatctgctttgggaaagggcttttactgtctttgtttaaactgtaaactacaaactaagtttctcctaaagttagttcagcctatgcccaggaatgaacaaggacagcttggaggttagaagcaagatggagtcagttaagttagatccctttcactgtctcagccataattttgcaaaggcagctttaagacaaatgtaagtttcaagttttcataacacctcaggacctatgagagttttgactcaccaatcctggccatgttttactctgattcttatcaaatgagactctaagggacagacatgtgtcaaagaatttgacaatctcttatctggcctggtgccgagccccattccgtatgtcactccactggttggctccctctgctgaacagcccaggatccctgagatgcacatcacatttgggcttcagggcagtcataccaagatttgtctacaagcagcagccaagctcacaggctcaccaggggcacctgcttcagtgtgaaaagatgaataataatccctttgtactccccttgcctgaagctgtgagccctgtgatgcccagtcattactcccagtctcatatcaggcaggttgatgtgaatatccaatcacaacctatacagcatcaagaatactaagagaagaaagaaaaagactgaacccacacaatctacaaatagtgagactctgagcaagagattatggatattttcatttttctcttcctagtacagattaccttctaaaaaatggacactgtggatttgcttaatacccagagttttaaaattattttctgcaaacatacaacacatgcaaaggcaaataggaagagtcattctgccttcaaatactcaaaatcatttctgaataaaaccttcctagaagagaatggaagcaaaaaccctagctattttgattaacctattactaaatattgagcaatgatgaaaaacaaaacattttagcaacattgttttcaaatacctactagattctagataatccatgtaacaattgtgttctgaaatttccgaggaaggcaattgattaattaagagagacctcagaagagctccttaatgccttgttcaggctcctctccagcagtttcctggaaatccctaaataataataagtggagatgcagcagttcaacactctactttgctaaatggaaatacattataattacaatagtaaacatctattgacctatcattctagtgccttaggccctgctttaataaatactttttgcaaatttgaatgtgaaaagacatggtttgcataagtagttacaaagggtcttttctattacagtaattgtgtttgttgatttccattttcctgaaaagtacccatcacccccactagcagatcctctactactgggaaaaacattaggttgctagaaagttgttttaatcaatagttgcccagtgaaatcactgtcttcgttgcctgtagctggtaaaatcactgtgaataaccatgcttgtgttgaagtgtgaatatccatttcagtgcttgttttgtttgtctcccattttccttctttttacagatttttaaaagcattggtgctgatgagaccgtccaaggacaaggaagtcggaggctgatcagcttctctctctcaggtatgttttgctcacctgagactttgtggagagactaagaatgtcaaccaagagtgaagacactcacttccatttcactcttacctacaagtcagtcaacctctctgtgcctcaatttctcaatctgtaaagcaaaaatgttttttaaatctgttcaatttcccttgaccacataaggataatagagagtttaggaagtaatagatgtgaaagcatgttgagatgatggaaagggaggctgcagttctacctttcccccaggtccatgtagcagtagttgagcatatacaaggggaagtaaggaaaacctgggaagagaagcagctattcaactctttgtctaaacaaaacctcacatggggcacaactggcaaaacagataactgagccgctcaaaaatgctcattcatggaaaaaaaatcagtggaatccaattaagtctgttaactaataatattttagtttaatatttaagagtaagttaacgttttagttttcatgaatgtaccatggttccatctgtcatgcatgtctgtgtgaagagagtccaccaacaggctttgtgtgagtaacatggctgtttatttcacctgagtgcaggtgggctgagtacgaaaagagagtcagcaaagggtggtgggattatcattagttcttataggtttgggataggaggtggagttaggagcaattttttgtgggcagcgggtggatctcaccaagtacatttcaagggtggggagaatattacaaagtaccttcttaagggtgggggagtatcacaaaatacattattgcaagggtggggagggtgtattgtcataaggtcaattgatcagttagagtggggcaggaacagatcacagtggtggaatgtcatcttttgtggttcttcagttgcttcaggtcatctggatgtatatgtgcaggtcacagggcatatgatggcttagcttgggctcagatgcctgacaacatcatatgttaataatgggacaaactgggcaaaggttatgtgggaaatctttgtattatctttggaactcttctgtaaacccagaattatataaaaattaaaagtttagggctgggagtggtggctcacacctgtaatcccagcactttgggaggccaaggtgagcagatcacctgaggtcagaagtttgagaccagcctggccaacttggcaaaacctcatctctgctaaaaatacaaaaattagccaggcatggtggcgggctcctgtagtcccagctacttgggaggctgaggcaggagaatggcttgaacatgggaggtggaggttgcagtgagccgagattgcaccactgtactccaacctaagcaacagagtgagactccatctcaaaaaaaatgaaataaaataaaataaataaaagtttaaaagaaaaactgagctgctctggctaacatgatatacaaagctcagggcttcacacactcaatcccaccctaaacagtctttaaggggacacagcggcataaagcctgaggactctgttgagcacagttggaaaactactaccttagcttgtcaaatcaacagatgttgcaggccatgaatgccagaggtcacaggcatgaagtacatgtgcctccttgggagctacactgttaactgggcttttcaagtctaagtgagcccagtaaagcaaatatgttttgatccattgacagtgttagcatgtgtatatctaggctgaagaaaaaaaaaaagaagaaaaaacttgtaaccacccaatgtgttcaccttgcccactgcctagacagagccgatttatcaagagaggggaattgcagtagagaaagagtaattcacacagaactgtctgtgcaggagaccagagttttagtatcactcaaatcagtctccccgagaattcggccatcagaatttttaaggatagtttggtgagtaggggccagttagtcaggagtgctgattggttgggttgaagatgaaatcataaggagttgaagctgtcctcctatgctgagtcagttcctgggtgggggtcacaagatcagatgagccagtttagccacctgggtggtgccagctgatccatcaagtacagcatctgcaaaatatctcaagcactaatcttaggttttacaatactgacattatctccaggagcaatttgggggtagtcagaatcttgcagcctccagctatatgactcctaaatcataatttataatcttttgactaatttgttagtcctacaaatgcagtctagtctccaggcaagaagggggtttgtttcaggaaagagctgctgttgtctttgtttcaaaggtaaaccataaactaagttcctcccaaagttagttgcgcctgttcccaggaatgaacaaagacagcttataggttagacgcaagatggagttggttaggtcagatttctttcactgtctcagttataattttgcagtggtggtttcaactcactaattttgtacttctaaggcaaaagctagcaactcctattgaaatgcttaagaaataacaatgattaataccaaccttcaaaaacagtagaaaccaggaatactgcacaactatgtgccagaaaccaagaggaattgtcactaaccaaaggtccagtgaagtccaagtcctgaagcccaagaggaatgccatgcatggtgagcagggcaggactggggaggggacagtctctattcctttatctctgctttgcctctgccatgaagacatgggctcacagacctaccagaggaggaagccccaccaccaccccaacttggttcacaaagctactttataaggtgatcagggttggttcatctcctgcagtccccaaacacatcatttttcttacatttattccaagacaaccattcccagcaaaggaaagtgactaggaatataaagttagtagctagcggagcaagcttggaatggtcatggacatataatgctcagtagttggctatgtatatgtatgttgcattcactatgtctgcctaggacaaaaagcaaatactgttgaaactatcaaaataaattccatgcagccaggcatggtggctcatacctataatcccagcactttgggaggccaaggcagaaggattgcttgagcccaggagtttgagaccacctgggtaatataacaagatcccattgctacaaaaagtaaaaaaagttagccagccatggtggcatgtacctatagtcccagctactcaggaagctggggcaggaggatcacttgagcccaggggttagaggctacagtgagctctaactgtgcaactgtactccaggctgggcaacagagcaagaccctgcttcaaaagactaaaataaaataaaaataaattccatgcctcaaaaaaagacaagacagaaagatcagcaaagcccacaaaatatcaaaaatttgctccatgctggtcagctctgagtataagagcagagctaaggattccagcaacaaccagttggacaaccaaactcactaaagatggacaaacgccgggactacatgacatgctcgtaggtaaacaacagaaattttgacttgaacaatgtgtggagaaaatactctaccctattaaaaagtcgaagactataatactcaagagaaaaagaaactattctattgacagatacctactaaagagaagtaaaatatttatcactcatctgcttgtaccctcaacaaaatagagggaagtgcagagcatattaaataagagatcaaagatgagaaaagatgataagggagttttttaaagcttgcaaaaatagaaacttagaaagtcaagtgtatttgctttctcttgctgctataacaaattgccaccaacttagtggcttaaacaacacaaatgtactcttactgttctggaggtcagaagtccagaatgaatgttaagggactaaaatcaagctgtcagccaggctggttccttctgggggctctggtgcaaatccatcccttgccactttcagcttctagaggctgccagcattctttggctcatggctacattgctccaatctctgcttctctcatcacattgccttctcctcattttgctcttcctgcctccatctgacaaggactctgtgattacgttgcactcacctggacagtccaggataaatctctctactgcaagatccttaacttaatcactctgcagagtcccttttaccatgtaaggtaacatattcataggctccaaggattaggatgtgaacatctttgtgaggtcattattctgtctaccgcagtcaagaagagatttaaaataaactctaaaaagtacaatcacagaattaaaagccttcaaaagcagtacaggtcacactcaccactacagaaagggaatcagtgatatgacagattgacttgagagtctctcccggaaggcatcaatgaagggcaaagtccaaaaaggacgagggaaaaaaagatgaatggcacatacagagccaacacataatcagtgtttttgatgaagaaatcagaacaaactgaacagaaacagtaatagaagaaaacttccttgagctgaagataattttgagtatttaaattaaagaagaccatcaggtgctcagagaaagaaatgtatatgaagagaccaacacctagacaaatctcatttaaaaaggtttttttttttttttttttcccccaaatatagccacagtagacatctgggctgaaaatgcatgatacgtacaaaagaacaatcctcatgctaatctcagacttgtcttctgagatgccaaaataatgaagcaaagcctaccaagtgatacggacaggagacagggaaatactgggtagaagagggcagttacccagcaaaggccccaccctcaatcctggaaacccatggccctaaatgggaacaggcgttcctgttttcgcacccaaatgttgcattttggcccaccatgcccctctatcttgtacccatataagccccatatcccaggctccacaagcagatgagcagaagagcagagcaacagaagagtggcacggcagagaaggagagaagagaaggagcatccgaatgttgagaggagttcagttggggaaggtcgaagaggagattggccgagggacagccaaactccaggggaagatcatcttcccactccatcctctttccagctcaccactcatcctgctgagagctacctccgccaatcactgaaacccctgcattcaccatccttcaggtcggtgtgtgatctgattcttcctggacgccagacaaggatccagataccaagaaggcaatgaattggttaacacttaagccagccgcagatggcagagctaaaggagcactgtaactcacccactggggctccaggagtcacagacaccctcccctagatgctaccgcggggccggagcccaaaagcactcactccggttcctgcacctgcccgtctgcatgctccctctcccataagaggtttgagcatacgagccacacccctgttgcatgtcctgtgaggggggtcagggaactctcctatttcacaagttctaaggggagaattgttttacccaagatttccatgtccaccagattttcatatatgtgggaaggcaagaggaacaccctcaggtttataagggctcaaacactaccacacttacacctcactttaaaataatatgtaagcatgtactccagcatacagagataaaatccaagaaaactcgagaattggggacattgcaatataaaaagactgattttctttttagggtttaaaaggggaaataagcagaaagtagataatggaattgccttcttagaaagctccaacagtacaatgaacatatcaaagcaagattgctcatgcaaatgctttacttgtcaagtctatttatacttcctgtttttaccactgcctggaggtaatacattttctagataaatattatcactttaattttcaatgaagtgcacttttagcattctaactgaaaaaatcagaaatgcaaacaaagatttatttacaaatatattggagacaacttaaacattcaaaattagggcttggttaaataaattaccgtagagccaaattattaaatgctatatactcttaagaattgggtattcaaaatgttctaaaaggcatgggaacatccttatgatgttgttggcgtgggaaataatttttcctctggttttcataagttcttggctgaggaccccctgtaacagaagatagattaacaagagaaaaacaaacagaagttattaacatgtatatctcatgtatacataggagatacccagggaaaatgagtaaatctcaaagaagtggcttagaatttcagcttacataatgtcttcaacaaagaacagtacaatttgtagtgaagtgacagggcaaaggaaaaggactttgagtcttcaggggcagcaagttctgggaaggctatggtatggtagatagatgctgtttagtacagtttattatgcagattcgtctggtgctgtctcctggttggtactggtctgaagtcatctctggtgatcaacctttgatccccctggtagagagcggaagagggacacctttgtaaatttatgccctgcttttgggaaaatagcgagagggcaaagagcttttcttttatctacttcttctcagttgtcttcagctcaaaataatccttatgccaaagtcacagattttgggatattgtttcccaggctctcacatataatggggtgatatattcttgtctcttacacatatgatgcaagtcaaaagaaaaatcttggatgcagtaatgaatatgcagtatgttctcaactacgcaaagaaaaatactaggaggaataaggtttggcaaaggttgccactggtggggagggggtacttaacttgaaataaataattatttcaattagttatttgaaataactttaaaattctattttttcattctatatttttaagtattataataaatgtacatatgtctatcaccagaaccaaaaaatacaggcaaaaatgagaagaaattaactattctcctttaacgtagcatttacttttggaaaattctagaactctatgtgctcttatggacatttctcccaacagtctcataggggaaaacattaagacctgaaagagttaaattggtttactcaaagttacaaatttcaacaatgagtgttctcaaatgactaccagtccagtgccttttaaattatacctcttattgcaacagttttcaagtacttttattccatgaaacgtatatctcagtgagtatttagactgaaattaaatatgtaagtctttataaagaaaagtgtaaacatttgctgaaggacaggaaagaagacctgtacaaatgaagaaacatgtgctcttgagtagaagtctccgttttctaaagctactaattctcccaaagctaagatataaattcaatgcagttctaatcaaaatccaagtgttttgaaaggagttgttaaaatttaataaggctcatctggaacaataaatggctgagtgataaagaaaggtgttatctttttaaaaaaataagaacaataagagtgacttaatttagcagctatcaaacatttgatgaagacatgttggtgcagatgtggacaagttgtttgatagaacagaacaaagtgtatcgaaaaagactcatttatatttgagaatttaacctatgccaaagttgacatttttataaaaagacaatataacagattggttaaaagcacagactttgggccgggcacagtggctcacacctgtaatcccagcactttgggaggccgaggtagatcaccctacgtcaagagtttaagaccagctggccaacctaatgaaaccctatccctactaaaaatacaaaaaattagccaggggtggtggtgagtacctgtaatcccagctactcggtaggttgaggcaggagaattgcttgaacccgggaggcggaggttgcagtgagccaagattacaccattgcactccagcctgggcaacaagagtgaaactccatgtcaaaaaaatcaaacaaaaaaacaaaagcacagactttgaaatcaaagaggcgggttcaaatctcatctctgatgtcaaccagccctgacaatctgtaagccttcattttctctttcttgtattaaggatataatctctaccttgcggagtttgtgttcaggattaaatcagaaaatgtattttaagtgcttagaatggttcccagaatttagtagataacaaataaatagtaggtggtggtggaggcaatggtagtcactattttatgatgaatgttttatatatatatgtctttcacactctaataagtcaggatctccaagatcacccctaggttcaacaatttgctaggaggactcacaagactcagcatctagatatactcgtggtatgacttattacagtgaaaggacacttagcaaaattagctaagggaaaaggtgcttagggcaaagtctggaggaagccaggagcaagcttccaatgggcctctcccggtggagttacacagacatgcttcattcccccagcgtgaactgtgacagcacgtggaaatgctgtctaccagggaagcttcttagagacttgagactgggtttctactagatggctggttgggggacagtgggggtggtgctggtcatgtgtgcatcttctgcttagcccacatcaaacttccggcctcccagaaggaaagcagtgttcaccataagccacatcatttacacaaacactttaggcacagtgagccactcgtacccgttctgggaaggtaggagccctcctgaaatccaggtttctagacattagccaagagccaaccttataagcagttgagtagtctcaggctgctatgttaacttctgtctacacacattcctgcagatgtggcctgggttttgcaaatttctgtgatgcttgtacttcctgccttttttctttcattggcaattgtgggggcaaaagtgactccattgtggatgtgaatctgctgtgttgacttctgatcaccccccagtcttgcgcatgcctcctcttcctactttatccactgtctctagtgtaagaacatgtcaaccttgatgttatgacagaaacaataggctgtgatgcatgcagcattcctgcctgttctggagggctgcctttcattgtcttgcacagagcaagggcttatataccccttccctatggtacataagccctgggtctagggagtaacagtgcagagatctaccagtctcctacagcccaagaccatgcttatctgtgagttccctaataaaactccttttaccgacaaactggatttgtctgcctccttctttggtttctcaactcctttggcatttggtggtcattttgaatatacagccctttcacagagcagtaatacattatcatgccagagagtaggaataattttattaaggggataaccttggatcaactcaaaataacttttaaataagtgcatatgaaaacaactgtgctttttcgtcagtaacaaattattgaaacccctcacaacttaaaccatgactgggaatccctgatcctgtgtatctttacctccatttgtttcacttgtgtataaatgtaaataattttgtttgaaaaatacttcaataatagaaaagctttaaaaattatattccttggctgggcacagtggctcacacctgtaatcccaacactttgggaggccgaggcgggcggatcacctgaggtcaggagttcaaaaccagcctagccaacacagcgaaaatctgtctctactaaaaatacaaaaattctccaggcatggtgataggcacttgtaatcccagctactcgagaggctgaggcaggaagaaatgcttgaacccaggaggcagagtttgcagtgagccaagatcccaccactgcacttcagcctgggtgactccatctcaaaaaaaattatattccttgacatcatcaatatatttctaataaatataatgtgatttcacattatccaactataaactgttgccttaaatgaccttgtgcacacacactctttctgtctctctctccttgtgcagcatgaaattgtacatggtcagatatcttcaattaaacagaacagctcgattttcaaagccctgccctccctggcagcagggtttctcagaactctcctcattgactgcactcagccccgtggaggccaggtcttgtttgttctttcctccattgtccacgctctgtgctcttttaatcctctcctttctctttatttctgccaattctctcaccttactcagtgaggcccacatatatcgtgagactacaacccctatttttttaatgtctccaccttgcagaggaattttacacccggacccatcaaatttccaaagttggactttctctccctgtgctacccacgtttcctggggtgaccctcactccttcaccccagcctgtttacctgcctgagtaacactagagatctagttcataagggccaatggtcctctcatgaaaggtgtggttaccaaatgccagtcgttaacctccctaaaacatatttaaattaaagtatcctttattttatagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgaggtgagtgctgtgggccctgaaaaaaagcccaagtaaaagtgaaagggctgactgtgaaccagccctcctccttccctccattcatggagccctggactctgctgctcaatctatggctgtcatggtcttagaagggagccatgttctccaggggttgcaactcagggatcttgatcaagtccatccggacagtactaacacacttttcattgcactgcatgcagtagcctcttctgattcagaacccatgccgcgagcaggacggcctttccctctgcccttcatgtgggagaaggaagacaagagttgtgatcagagccttccagtttctccacagctcttcccatgcatgtgatccttgagcaagggtgtcaaatcttaaatatagccttctagaccagtttcagagattctaaaactgggaggttcctgggataggtgaatcagtaagccctaaaatatccctggttgggttaaatattgtttgatttaaatagataatgaagcctaatggtttatcctatcttcatgatttgcaaagggctgggcagcttgctacagtattgaatagtctatgttgtctacaaaggcccttctccactcctgaaagtgttgcctttgccaggggttaggagggtcctccaagttctctcctaaaggacatgtagaaagtcggcaccacttatttggccaggcaaggtagctcttagggaggctagggcaggtgaatcgcttgactccagaagttcaagaccagcctgggcaatatggcaaaaccccatctccaccaaaaaaaaaaaaaaaattagctgagcctggcggtgtgtgcctgtggtcccagctactggagaggctgatgtgggaggacttcttgagcctgacaggcagaggttgtagtgagctgggatcatgccactgcactccaacctgggtgacagagcgagaccctgtctctaaaaaagaaagaaaaaagaaagtcatcaccacccatttggctgcctccctgccagacctgagcttgaagctataacctccaaaccatgtgactgaggggaggggaggcctaggtcatgagagtggatggggtataatgtaggttaaaagtacagttttacagtcatagaaacctggattctaatcccagtgtggccagttaatagtttataaatttgagagatcagttatcctccacctgagccttagattaccctcatcagcctattattgatggaaacgtgctcccaccaaaggaacttgctttggagaggatttcttcctttatttttcagagtagatcatctctgatttagagctttcaagcatccttgacaagaaaacataattagacatatgagagcaaagattttttattatctattaaatcataccacccccttcctgggcttaattagcgctctcccaggcttcccagaagagcttcgttagagctttgaagtggacgtgagggaaatagacttgtacttaaacttcctcctagcgttggttatcaacagattctaaaacactgatagcaccgctagaatggaataatgaatcttaatttgtttcttcagtcctgcctgtgttcatcaattatttctgaactcttccctgcattcctagagataataaaagatgtcaaaagaatttattttgtatggggggaaaggcttctctcttctgaaggactttagaggaacctgttctaagacatttagtcataaaggtgttttaagtgtcagggaatgtttggaaaatccagcactatcagaatgttttttggctaaaaacgtcaactagaattcactttaagttctgaaatgatttctgaagctttggttaacactgattttgttctggcagaatactggcaaactctccccagccctctgctctgggccacctcccttccatcccacgtgctgcagttggagttattgatctaaaatatgcctcatctcatgtccccctggtaaggctcaggctgaggataactgatgtcccaagttaaacagtgtgtaactggctaaaggagatttgaaccaaggtttgtgttgctgcaaaactgtccattcaacccctaaattgtactacagttcccagggtccaagtgtcaatgtcatagctcctctgcagagcattcaaagccttctttgatcaggcattgcttaccattatgtcagttaaggatgtatttggctccatgcaagggaaagtctggctggctctgatatttctcacaaacaagacatccagagggaggtgatccaggcggtgccgctgctgagtgagcccccagggatcccagctctccgggcctgccactgcaccatccttagcagatggcctcatcctcctctgttaaagcctcaagtccaaattccaggcaggaagaaagcaacaggccaaaaaagccttctccttgcaagactttgcattttcttcctgggagaaaatgactgggtggcttaaacaacagatatgtatttctcaaagttccgaagctgggaagtccgagcccaggatgctggcacggttgggttctggtgagggcctctttggggatgcagatggctgccttcttgctccatccacacgttagaaagagagaaaaggaaagagagcacactcttataaggacactaatcccatcgtgaggaccctatcctcatgactcctctaaacgtaatgacctccaaaggcccggcctcttaataccatcactttgggtgttagagtttcacatatgaacttgggggttggtggtggaaggagacacacacacacacacattcagtctataacaggtttcagtccacaacaggaagttttcctcctcatattttctggaaatgtctgtgtataattattatttcttccttaaatgtttgatataatttaccagtgaaaacatcttaggctggagtttctctgtgagaagactttaaattatgaatttagtcttttaaataaaaagagtcatttagattacctatttcttctaagagaaagcatttgtctttcaagaaatattgccatctttttgtgttgtttggcataaagttgttcaaagtattgttttattgtcttttaatgtttgtaggcttattaaggacaatacctctttcatttatatattggtgaattgctttttttctctttgtttgttaaccaatctaaatatgggtttattaaatttgtttattttgtgaaagaactagctcttgacatcattttctctatgtttaactgttttctatttatttttatatatgcccttattttcatttatttatctcctttattgccttctatttttttttttttagctccttagggtaaaagtctaggtcttgcttttagacttacatttattctctaatacaattatttaagcaataagttttcttctaatctctgttttaactgcattttataaatttgtatataatttatacttttattatcattccgtcaaaaatatttcttcatattccttctttgacccatggattattttgaaataagttgtttaatttccaaacctggggattttcctaaatatcttcttgttactgacttttaattttattttattgtggttagagaacatactctatatgattgcaatctatttaaatttatcaagccatgttttacagtccagcatatgatgcattttggtaggcttaccatatcaacttgaaaagaatgtatattctcctattgtggcatatcaagtcctataaatatcagttgagtcaaggtggttgactgagttgtagagattctctgtgtctttattgctttctatgtctagctgttctatcagttgccacaagaagcatgtttaaatcctttactatgttcatggaattgtctgtttctctaattctgtcaacttttgtttcatgtattttgaagctctggtattaggtacttgcatagttatgtctatgcatcatgtttataattctaaaatatttttctttatttttggtagtgctccttgtcttgaaggctgttttatcacactaatatagccactccagcctcccttatgtttagtgtttgttccatttactttcaaaatgtttgtgtttttacttataaagtgcattgcctatggacagcatattcttcggacttaatttcatttattacaataatctctgccttttaataggaatgaatggcccattaccatttaacatatttattcatgtaattgtatttaggcctactattttattatttgttttctgtttgtcctctggattgttttcttatttccccttcttgacttgtttttggattatttgaatatattttagaatttcatttcaatttatctactgaatttttaggtacacggctttgcgttacttcctttgtagttgctttagggaccataaaataccttcctatattttcatgatctacattgagttaattttgtaccactttacataaaatgcagtaactcttcaacaatattacctgcatttatccacactcgtgatctttcttgttatagttattatatatatcacattgtatatacattataaaccctacatgacgatgttaaaaatttttgctttaagtggatgtgtattttaaagaaactaggaaaaaaatatagtccttaatgcctccccatacatttcctatttctaatgcttttcatttcttttatttatttatttatttatttatttatttattttaattattatactttaagttttagggtacatgtgcaccttgtgcaggttagttacatatgtatacatgtgccatgctggtgcgctgcacccactaactcgtcatctagcattaggtatatctcccaatgctatccctcccccctccccccaccccaccacagtccccagagtatgatattccccttcctgtgtccatgtgatctcaatgttcaattcccacctatgagtgagaatatgcggtgtttggtttttagttcttgcgatagtttactgagaatgatgatttccaatttcatccatgtccctacaaaggacatgaactcatcattttttatggctgcatagtattccatggtgtataagtgccacattttcttaatccagtctatcattgttggacatttgggttggttccaagtctttgctattgtgaataatgccgcaataaacatacgtgtgcatgtgtctttatagcagcatgatttatactcatttgggtatatacccagtaatgggatggctgggtcaaatggtatttctaaatctagatccctgaggaatcgccacactgacttccacaatggttgaaccagtttacagtcccaccaacagtgtaaaagtgttcctatttctccgcatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggtgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcgggctcttttttggttccatatgaactttaaagtagttttttccaattctgtgaagaaagtcattggtagcttgatggggatggcattgaatctgtaaattaccctgggcagtatggccattttcacgatattgattcttcctacccatgagcatggaatgttcttccatttgtttgtatcctcttttatttcattgagcagtggtttctagttctccttgaagaggtccttcacatcccttgtaagttggattcctaggtattttattctctttgaagcaattgtgaatgggagttcactcatgatttggctctctgtttatctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaatactatgttgaataggagtggtgagagagggcatccctgtcttgtgccagttttcaaagggaatgcttccagtttttgcccattcagtatgatattggctgtgggtttgtcatagacagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatctgctgctggattcggtttaccagtattttattgaggatttttgcatcaatgttcatcaaggatattggtctaaaattctcttttttggttgtgtctctgcccggctttggtatcagaatgatgctggcctcataaaatgaggccaatttgccagtctgtgtcttttaattggagcatttagcccatttacatttaaagttaatattgttatgtgtgaatttgatcctgtcattatgatgttagctggttattttgctcgttagttgatgcagtttcttcctagtctcgatggtctttacattttgtcatgattttgcagcggctggtaccggttgttcctttccatgtttagcacttccttcaggagctcttttagggcaggcctggtggtgacaaaatctctcagcatttgcttgtctgtaaattattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatatgtcttagagttgctcttctcgaagagtatctttgtggcgttctctgtatttcctgaatctgaacattggcctgccttgctagattggggaagttctcctggataatatcctgcagagcgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaagaactgcgttcctttggaggaggagagatgctctgcgttttagagtttccagtttttctgttctgttttttcccgatctttgtggttttatctacttttggtctttgatgatggtgatgtacagatgggttttcggtgtggatgtcctttctgtttgttagttttccttctaacagacagcaccctcagctgcaggtctgttggagtaccctgctgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgacctgcccccagaggtggggcctacagtggcaggcaggcctccttgagctgtggtgggctccacccagttcgagcttccaggctgctttgtttacctaagcaagcctgggcaatggcgggcacccctcccccagcctcgctgccgccttgcagtttgatctcagactgctgtgctagcaatcagcgagattccgtgggcgtaggaccctccgagacaggtgtgggatatagtctcgtggtgcgccgttttttaagccggtctgaaaagcgtaatattcgggtgggagtgacccgattttccaggtgcgtccgtcacccctttctttgactcggaaagggaactccctggccccttgcgcttcccaggtgaggcaatgctcgccctgcttcggctcgagcacggtgtgcgcacccactggcctgcacccactgcctggcactccctagtgagatgcacccagtacctcagatggaaatgcagaaatcacccgtcttctgcgtcgctcacgctgggagctgtagaccggagctgttcctattcggccatcttggctcctctcatttatttattttttgaggcggagtttcactctggtcgcccaggctggagtgcaatggcgcaatctcggctcactgcaacctccacctcctgggttcaagtgattatcctgcctcaacctcccgagtagctgggattacaggcacccaccaccacgcccagctaatttttgtgtttttagtagagatgggtttcaccatgttggccaggcttgtctcaaactcctgacctcaggtgatccacccgccttgatttcccaaagtgctgagattacaggcatgagccaccacacctggcctcttcatttatttctgaagacctgggttttcctctgatatcatttcccttcatcatgagctccttcccctggcctttctagagtgggcctggtgagtctaatcctcttattgtttatttgaatgtctttatttaatgtcctgcagatattttctctgtggatattttcactggatatagaattctgggttaactggtatgtttcccctcagcacttgaaaaaatatggttccgcccagtgaggtggcacacacctacaatcccagctactcgggaggctgcggtgggagtatcacttgagcccagagttcaaggccagccagggcaacatagcaagaccccatctcaaaaaaaaggtttaaaatgcagttccactgtgttatggtctccatagtttccaataataaatctataatgatttaaatcattgttgctttcctatctgtcaggtgtcagttttctctgtcagattcagggttttctctttgtctttggttttcaagttggatttcggcattcccaggcatggtttttgtattagtttcctagagctgtcataacaaagtcccacaaattgagtggcttaaaactacaaaaatatattgtttcatagttctggtggccagaagtccaaaatgaaggtgtgggcagagttgtttccttctgaaggctctaaagctgttccatgcctctctcctagctccagtgatgtaggcaattcttggcattcttggcttgcagactccatctctgcctccatcttcacgtggtgttctccctgtgtgtctctggttccaaattttcttcttcttagagggacatcagtcatacgggattagggcccaccctaatggcttcatcttaacttgattacatctgtaaagaccctatttccaaataagtttgcattcaaaagcaccagggtcttagacttcagcatacctgttgagggacacaattcaactcataacagttttcctctaatttaatctattgttggttcactgaacttcttgaagctataagtttgttttcaccaaatcaaggaagtttggccattatttatgtttttcaaatattcttctgtttaattctctcccctttttcttgagctccaaatgatccatatgctagatcttcagagtcccacaggtccctgaggctgttttctctctccttgtaattgcatgatttctattgatctatcttcaattttactgtatgttttctctataaactccattctactattgcttctatgcaatgaatattttcagatatcagaattttttattttaagattgccatttggttttttttaatgtgctttattttgctgatgatatttcttacctatctatattcatcataagttaatattttcctttaccacactggatatagttataatagctgctttaaagtattttcctgataatttcaacatctggagaatattgaaaatgggtcatgttttgtgttttttaataaattaagtcattctggatgatgtctcgagcattgttaatgttatactgaagagactctggattttgctccagggggtattgatgttttgttacagcagacaattgatttggcgcagctcctactgtcatccatatggtgggaggcacctcagatctcagttcagttctttaagccctaactgcaaactgatttcatttgccctgtgcgtgtatgattctgggatcagccataaacttgggctgagcttctatacatcgtttggggctctcctttggctctcttctttccggaattcctcctttactctctggtggtgctggttgccccaggcttctttgcctggttcatccagccaaaaagatagtgagatttgtattggcattttagctgctctgtaccactattgcagtgactgtggcggcattcagggcaaagatcccactgtgaagaattcattccatgcccgtctcttgttgcagtgaacaagttttagcaattaactgtgtagcaattagaaacaattattttacatttttctggacattaccaacatttggatttttaaaaacaagcaacaaatgtattttgtagcatttttatcatccagtagattccatctcttcactgtactttataagttatcctataagctaatataggttttaaatgttgtcttctgtgctattctttgtaagtgtactagtaaaataatttaacataaaaataaattaatgtaagccaccacattgacaatataaagaagaaaaatcatgtttatctccatagatccataaaaagactttgataaaatttaatattcatttatgattttcaacaactcctacaaaactaggaatagaagggaacttttttgttagaaatgcttgtttcccaatgccgtaaagaaatagcatttgaatataaatttaatttccccagcaaggctgtttttactttctgcagaaagggtacactcaccagcagttttgccacgagagtacgccgaacaaaggagacaaggtcatttataacctgacacgtccactctattgctgtgtccagtttccaatggctggcacaggacctcacattctgtatttgtcccgattggctagcaacttagaactttttaaaaggggcaaaggcagaggagaacaaagcaaggaggaagtaacttgtggaatgctgagaaaggtaaaaacaccttcaaataaggaagaggaacaggctatgacctaatgcttacttggaccaatataagcatgccagggcaaatatttaggctaaattgtgggagctaagaacataaagtacattgatttctttattacggctagcagatatttaggaatgttagcacaggtctttgaataaattttgcttctaagggaagttactatttattcctaattagaaggtgaggaaagtctttgaagaggaacctctactttacttttgacattttcaatccaatagaggacttaatatattaataataataacaataaaatccacagcaaacactatacttactggtaaaatattaaaatatatttccttagaaccaagaacaagacaaggatgcacactttagccacttctgtttaatattgtgctagagattctagccagtgcaacaaggtaaaaaaataaacaaataaagtatgtcagctttggaaaggaggacacaaaactgtctgtattttcagataacattgttgtgtcagtaaacagtacaaaacattacccaaactacccaaattagtgaatttagcaaagtaactgaataaataaaaggtagatacgtaaaataaatcatatttctatatgcaaatagaaaataaaaattgttaaaagatattatttacagtagcatcaaaaaccaaggaataaatctaactgcagaggaggaatatggttacaccgtgcactaccactttgctgagagaaatttaaaacagcctagatgaaaggagatattgttcaaggcttagaaaagtcaatattctttaggtgtcaattcttccccaaattgatctgtggtttcagcgatatcctaatcaaaatcctgggagatatgttaatgtaacttgacaagctaattctaacatttgtattgaaatacaaaatgccaagtagaggtaagagagtcttgaaaaagaaaagaaaaaaaaagcaggacttttatactgccggatgtccagataaaatatgaagctctaagaattaaatagtgtggcattggcacagaacagacaaatagctaattaaatagatgagaatccagaaatagatgcaccacatagcatcatcgttttacgacaatagtgctgctgctgtatgttatggaaaggatagcctgttcaatatttgatgttgggtcaatttgctgtccatacagaaaagaaagaaaccttgaatgcagtctcacaacatacacagtctattccaaatcaattgtacatttagatatgaaattataacaataaagcttctaattcataagaaaacaagtaagaatactttcatgtccttgtggaagccaaaaaaatcttaaatagaaaatagaaagcattaatcataaaataaaagaataattaattgaatggcaataaaattaagaaccaccgttcatcaaaactttacattaagagcaagccacagagtgggtaaagatgttgagctatgtctaggtgacagctaatatctagactataaatactacctcctaaaatcaaaaagaaaaggacagaaaccaacagaaaaatggaacaaagacttcaacagccaccacacaaagcggggatgtccaaatgccactaaacctatgagaaggtgtttaacttattttgacatccaggaatgaaaattaaaagtatggtgtgataccactgcacactcaccagtgtgcaatggtatggccaaactgaagaagatcaacaatgatggctgctggtgaggtgtggaacatagactctccaactctgctgataggaggcagggagcaaggacatcagttaggagacattacagaagccaggtgggaaacgaggaagcctggaccagcctgaggcatgaacacagagaagtgtggaggtaaatatacttagccatgatcccttgcttttgtcttctggtctctttaatatccctttgcttatctccctacagtatgtttaaactagggctctggtgtgtgagaagaacatcaaacaaacagtacagcgagctcagggtgttttctaatgctggtgctggttgtgagatgttgttaaatatcagattggaggaaacgtaattgcggttttgccattaaaagtaatggccaaaattgcaattacctttgcaccaacctaaccaaaacattaccaaacaatttaaacataaccaaaccattaccctacaattacccaaaccactgccagacaacttaaagagtcaaatatgggcataaacaccaggggtcagggttgggcctgaacttttagagtatacttctctttttttaattgttttttggttgttgttgtttttttttttttttgaggagtctcgctctgtcacccaggctggagtgcagtggtacgatctcagctcactgcaacctccgtctcttgggttccagcagttctcctacctcagcctcccgagtagctgagattacagacacacatcactacgcctggttaatttttttgtatttttagtagagatggggtttcactatgttcattagccaggctggtcttgaacgcctgatgtcagatgatctacctgcctcagcctcccaaagtgctgggattacaagcatgagccacagcacccggcctttagaggatacttcttgatgccgagtgctttaccagaattatatatactggtagattgtttaccagagttaccacatttaatcatttcaacaacaccatgagtaaatgagaatgagacttattagaaagggaaattgccaaaacctttttgatggagcagaacaatcagccaggttaagctaaaagccctgtcacctggagataaatcgcagtgcctggccgagagtcgtcacctggagataaatcgcagtgcctggccgagagtcgtggtctccaggatttaagcacaattgctaagtgattactgtcatcagacagccccaaggcgttgtaaacaatctctgattggtttaagatagatcattcacttcagtcctgactgattagaaattacaagataatttaatcagacattaaagtgtgcttttgacctggacaaagtaaacatagtgtcattagcacaaaaaaatcacatttatggaagaaaatcattctctgaaacgcagagctggtactggtggtgagtgtgtgagcagccctaaagacggcattatttccccaggacagcagtttcacaaatgattttttaagttccctgacatagacaaccatcatctaagtacaaaaaccagttcttttgttagtaaaatcagctgctgaaccattttatgaaaggaactcatgaatgaatcaccaacatgaaaacataggggacactcttctgtttacgtggggtgggagactggaggtactgcctcttgttctacagtgatgcctgaggctcattcacagaacctgagactcagagacacactgtttgatattcacttgccaaagtgttccttgtacttgtctgttagcatcatttttcaacttctgaggacataagatggagtttttgagtgcagcagtgaaactccttgaaaaccattgccaatgtcttatggaggaatagagtgagctgggcaaggggttagcttggcacatccatccatggtggtgggtggtgagctggagccagctcatgtgagctgacagctcatgtgcaactcttcccaactccacatttagtgaaatcagccatcgagggagtatttacaccaagaaaattggcaaacactacagactggagctggaactggtgcctcgttcattgattgaaaaagttgaagactaacactaaaagtgacatcctgtaagactgataccaaaaatcaaaggtggggctagagtctgaggagagcagatctaagcagatttctaagcacgaaggcttcagaaaaacagaaaccaggtacagacagagccaaaggagtatctagaaatgaggaaatacaagaatcaggaatgatggagcaggcaggtgggagagaacaaaagaaatttcagagatggtagcagttgtctttggcatatctacataaaacggccacagcagaaattccacttcagccaggctcatctctgactgtgattccatccttttgggggccctcttagcaggtccccatctttgtctccatcaggcttgtcttgctggaagaaaattactatgctccagtgacaaatctcaagtcctgacaggctttgctccgtgtagctttctcagcatttttcagggcaatgggttattagcctggaaaaaaagttactaaaaaaatacgaacaggccaggtgcagtggctcacgcctctaatcccaacactttgggaagccaaggtggtaggatcgcttgagcccaggagttcaagaccagcctaggcaacatagcagaaccccatctccacacacacaaaatttaaaattagctgagcctggtgttgtgtgcctgtagttccaggtactcgggaagctgaggtgggaaaatggcttgagcccggggggtcaaggctgcagtgagccatgatcacaccactgcactccagccagggtggcagagcaagaccttgtctcaaaaataaataaaaaaataaataaataaataaaataaaacagcagtcttttcaaagttaaaaatatcaggaaatatcaatagagttcttgtgatattgtaaattactttaaattgcaattttgtcacaacggaattactgtggttatgctattgatttcatgtattatgtaattatcactatactgataccatgattaattagctaatcccacattttctgggatttttttaaaattttaagcccagaatgggagcagagaaggtattatgtatcttgtaaaagcttatgacaaacatttaaattattaacgcatccatccttgactaagagaacattatatattagggagggaataatgggtatgggtataacttagtgtgtttttgagagaaacatacaaacagaattaatacagcacaagtccagtgattgatagagtaatcagaagggggatattatgcagcctgccggtaatgtggaacagtggaatggcaaagccataaagccatagcaatggagttgcaacaagctttcaagcccagctaatacaatcaaggacatttgaacagaagtggatattttatatatttaccaagacactcacacacacacacacacacacacgtgtacatatatgcagatgtacacatgtggatagctaggtagatagatagatagatgatagatagatagatagatagatagatagatagatagatgctttattgagcagtctcaattcggtagggtatcttaataatgtcttgggcatattccataaccttctggtcacttgtatttataagtaatccaatcaagtctaattttatattcagcttacctctcttgtttcttgccccagcctcctgcgctatccactacagattggaattgtggtttgagggtcttggaaattgtcttggttcattttctgttgctataatggaatacgacagactgggtaatttataaataaaagaagtttattcagctcacagttctggaagctgggaagtccagtagcatggcactggcatctggtgagaacatagtagaaagacagaagcagaagcaagagacaagagaaaggagaaccaggccaaagtcatcctttttatcatgaacccattgataattaatgccttcaataatagcattaatccatttatgagggcagagccttcatgacctaatcacctctcaaaggccccacctctaatactgctaaaatggcagttaaatttcaacatgagttttcgtagggatattcaagccaccgcagagaagaggacatatattattttgtcccttttttctactccagcacctttgagagaaaacagagtcatgggaagggatttagagatccccctcaacttttctctgcaaggattatggctgcattgttgggactgggatgaggagagacagagtcaaaattttcttgctaacaagctgtctgatgggatgaggagggtatctggccccaattattgaccaatcatggggcacttaatgacctgagttttcctatgagcacaaaagtgccaaatctgaggtcacagaacatccttttacatctgtttatatatagatacactttcaaatatttgcatcccttctagtactgaaaacatacaaaatacatagaatacggcaagataaaatatatttaaatatagttgagaaacaggaaaccagggaaatgtcttagtaaaaagtaagatgaaataaagttagtataaaaggtgaatgtcaaaagtcttgcacaccctcctgaataacattagaaatgaccaaggagaaagggtctcttgatttcacaggagggatcatatggatagcacttggcctggaagacatattttagtatttttcatacaaatactgtttttgatttgcagctaattttatttgggatttctgtaattatctatgttaataaaatgtctttcatttcctttcttatgcttattcagtttgtatcaaagatgtcttatccttagaaaatgatttgggtagctgtccctttttaaaaattttctttgattggcttgtaaaagaccaggattatctgatccaagaaattttggtaaaatgtacttataacgtgttctggttacatgatgtttgattatcaattcaattatttgttatttattcaggttttctatttcctcttgaattaattttaaaatttttattttctggaaaatattcattatatatgctttctatttattttcagaatgttttcatagtaatatacccaaaatatatgcaaaacgtggaagctgtatctccaaaatatatagagagaacaaccatagtttttttatatctctactatctctttttattaatctgatgccttgatgtattattataatctataaattataagtttgaaaaaaaggccctgaaagtttatggttgctaagctctctaagtctttgtatatttgaaaatgtttttatttttacttcactctcaaatgagagttttgtggacatagaactctaggttgacagttatttttccctcagtactttgatgtataactagacacaaaataacagtttccccaactatgatcaatataatgtcagtcaaccatatactacacacacaacacacagagggaggtgccacagtcaaatatggaagcactgcatactatcttgcaaattcacaatgtgtgaattttgtataattaaagcctttgagacatctaacagtaaaatttcttcacccttttaacctagtacttctcttcagagctctttttcttagaattgtcaacatcacatagaaacaagtgtcagagatcctacagcacacttatttaaacatcaactgtcaacaaataactgcatatttgttcaaagtatatctctattatgctgttacttgccctaatttagactactgcgttaggtttctatcagtacataacaaattgccacaaatttagcaacttacaagagcagccatttattatctcacaattctgtaggtcagaagtctgggcacaacctgcgttctcggctcaggatctcagacgctgaaaccacttgtgttctcatctagggccttgtctggtgaaaacattgtttccaagatcattcaggttgttggcagaattgagatccttgctagttattggccagagcagtccatgacacctgaccctctccatcatcaaagccattgatggagaatgtcccttgcattgaatccttctcacattttgtccctctgacttcagacagggcccagtgtttttgtttttaagggctgatctaattaggtcaggctcacccaaataatctccccttcgactgattaattcaaggtccgttgtttggtaatctaatcatggcttggcatccaacacattcacaggccccacctgcacctagtggaaggggattatacagagtgtgtacacagggggcaggaatcttgaggaccatctcagaattctctctaccacatttattatccttcagtgccaaccccacaccagatgaaaagtttcactttgcttcctcttcagagaagtccatcactataacgtaatccgtagattttctgccagaacaataactggtgtgagttgggctttgagtgtgcagtctagcatgcataaaggagtatatttaagctgacccacaaccctggattgtattccatttttgcagtatcattatccagttaccacaggaagttgccattcattcattttctcatttatcaatgtgctcagttcacatcacgtgtggtttctgtgtaccaagcttttctgtgttttagagacattactggcaattgtaagagagaagctgaagacagggagaccagttaggaagtaattacaaggacaaggaatgacaagagccatacctagaccagtggaagtaaagaggaaagaatggactctagagtgaggaagaaaatttagacttactgactgattggatatgggctcctgaagtttgaccaaggttgaccaagatatacagatgaggagcatcactgaagatgacagtttatcaacaaagcacgtgcagaaggcaaagttagaataatagctcttttcttccttctgtgttctgggcactctaaagtaggcacaagaaggtcagttacattgcttatgatcacacagcagattttgttcttagcttccagtctgttcatccaatcctatgctttctttataggtgtttaagtgaatcatctccagaagtaaaagatgggagatatacatatggatataaatatagatatggatacagacatagacagaatacatatatgtgtaatatatgtatgtgtatatgtatgtatacaaatacgtacagatatataatatacaaatatataatatacaaattttacatataatatacaattatatgcatattacatatttaaatacatacacagagaccttgcttcccattctaccaaaccacaactaaatattgatattggcctaatttgccatagcagtatgtgtaaataaaatcaatattattctgttttgtggctgaggattctcatatggagagagatggtgaaggcttgatcaaaatccagtttatttgctcttatgcaaatatttcaagaagaaatataaactttccatatattatatgcatatatatatatatatatatatatatatatatatatatatatatatacatatatgcagattccctgcagttacaaggcttacgtctcagcagcatggtctccggcacttcctccctaggatagagtcaaaccacacactactgggaggggcagatcttctcccatgaccagactccaagggcaccacttcttaatgtaaaacgctgttacattgctagcgagaagggggaagaatgctcctgattcaattcctactctactaatggagttgtctatcattgtccttgactttaggcagcactgtttttgaatgtcatttttaaacctaatgactagtgccacctgaactgaaagtcacatacattgcaaggttctaaggaaaagtagctatagttcacatgctccatttgcttcttgcctgctctttctcctccaggtagaacttttacacagaaagcaccatgtccagtccatttaatttccattagtaataaataatggcattggctgaatggtaccaggcagcctcttgtgaatgaaacctgtttttcatttcccccctttatatctcgctgcaagagaggagaggcaaagctagatgccagtctaactgatgtcatgacctatgtcacacagttaagactaaccttcctccacatcatgaggtatctaatctccacttctaattggtattcctgccttactcttgaatatcctctaccccttcaaacttaacacaacccaaatcaaattaactttccttaccagttttccatccttaaccttttctgaatttcataaatttgtgagtgtgcataaatgaatcactatacctctgttctcacagactggagtcattttttctcatacctctccctaaatgaaaatagtaagtgaaaatactttctcactcaggtctgaaatttcccacaaagttttctcctttttgattgtagcatcaccctcacatccatatcctcatcatcttagctacattgaggcaataatggatccccttatttactctgccacagccagtaaaactctttctacccacggcacaattttccttttataatatcaacaataaaagcagatcaagttagtaaaaattgcaaagtttattgtcacacaaaaagtatagattacaatctgggagacttcaaaccaagtggtaaaaagctccactaagcagttacaacacagtttataaagcataaaggaggaagtattttgacttttcccatgattggctgttatacattatcgtttttcttttcaagcaaaacagagctgtttaagccgatttgtctatagctgactggtttaattttgctgagtcatgtggacaaggatggtaaagcttacattttatgtttataattagaaagagcctttcagggaaattaggatgacaagttttgattacatggttatgggcagttggctttggggtatatctagactgtggcctccatttttatttttctttattattattattattattgagatggagtctcgctctgtcccccaggctggagtgcagtggggtgatctcggctcaccacaacctctgcctcctgggttcaagcaattctcctgcctcagcctcccaagtagctgggattacaggcgcatgccactatgcctggctaatttttgtatttttagtagagagggggttttcccatgttggccaggctggtctccaacttctgagcattcctcctgcctcagcctcccgaagtgctgggattacaggcatgagccaccacatccagccccatttttatttttctttaacaatgtctttaacatttctccagatgatcaaggtctacatgaatgactcatagtttccttgaccactccaatctctttgaccttcaattacattcaccatgagccatctattcctgcacttataccgtagaacttgttgaaatatcacaagctctccagccctgtacagtcttctatccttccatgcccaggcctctatttccatcattctgttccttcattgctttgggacactcagtcattcagcccctctctgcattcctagctatgtcactcctcccacatgccctcaatcttgggaatccaggctcgggaatttgtgacctcttcctctcccacattccatagctctcactgacatttaaccagtccacactctgccacccttttctccttgcctgctagtctccccaccactttgcacttatcttacctgatctgcctcctccaggcctgacccatctatgggccacccctcagcactgcctcagtggcttctctacactgcagatctgagtgtgtcatttgcatggtgcagatcctttagttgctcccagatgccttcaggataagtccaagctgtggccaggaggctgttcatgatctggattctgcatatctattcagtttcatccacaacaagattctccagtatgacccagaggtagtaagccacttgcagttccccaagggactcatgtactctgtgaacttcagcccctgcccatggcacccctctacctggaatgttcctcccaccccttcttcatcccaccgacacttgcttttttttttttttgagatggagtctcactctgtcacccaatgttcaagcaattttcctgcctcagcctcccaagtaggtgggattacaggcacctgccaccatgcctggctaatttttgtagtttttagtagagatgggggtttcaccatcttggccaggcttgtcttgaactcttaaccttgtgatctacccacctcggccttccaaagtgctgggattacaggcatgagccactgcacccggccagttgtttattttatttcttttttttttttgagacggagtctcgctctgtcgcccgggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggtgtgagccaccgcgcccggcccagttgtttattttttaagactcagttaaagcattatgttctctaggaaatcgtctctacctgtccatcaggctgagcctttgggaagccttactatagcatcttctgctttgtcattttctgcctgcagtgtaagactctgaggtctaaagttggaggctgtggccccagcactccagcacagaagggtggtagctgtgtcccagcacccagctcacagccagtgcccaaaaagtgtttatgaatgaatggatacaactttcccctcctttatttaccaacactctcctaatctctgcctaaattgctcattatgcaactgctaccagtttacataattgccaattaaatatttcctttagttagttaccctgttttaatttcattaagttcaatttataaaagttctgtttagaggcgatctacctcagatcttttctgaagcaagatggaatataataagcatcttagttctataaatggcctattgagtaaacaacacaaacaaaataaataacatcctcctatattgcagcaccagtgctaatatctctctggacgattgaagatgataggagcacatcagtggttttcaacaagggtgattttgtctccccaaaggacatgaggcaatgtctggagacatttttggctaccatatctaggggagtgtcactggcatctaatgggtagagattcacttccatctgcttccattaataagaatgccaacaaaaaataagctattaaactcaggtttgaagaatgctttacagatcattggactaaatatttaggccacagaggaagatttagatttggtgtaagaaatactttcctaactgtaacattatttgatattaaaatagattattactgagagaacagtggttctccacccagttgcacagtggagtcacctgataagctttaaacactaccagtgccctgctctctcaagggagtctaatatagtcaagaatgggacccagtaatgggtactattgtggaagcttccagatttttctgagaaccaaggctaagacccactggtcaaagcaaaagtaagcatcccaacatctgcgcttaaacaaaagaaagtttacttttaggcagaagggtgcgtgaccctgtaggaataccatatgcatcattcttgctcatagtggccccagcggtgggccttgtacagctgtcttcctgctgttgctgctcagttgaaaaggcctgacagttcagtcctaaagtgaagccaagaaagagaattcagactctgatgctctgatgaagaaatgacctatggaactttcttttctgacccgagtgccagtagacttttgtttaggacagtttcacagcttgtgagaagatgaggagccatttattcattggttggcccaagcatgtgttacagttgctctgaaaagctcagatcaaaaggtaaaggacaaagatggaaaatagccagacatcagacccccaaggatgcccaggattggctttgtcatttccacactggttttctttcactggtgaagtaagatgcaaagagataaaattcccaaaccagcagagggcttaggcaacaatacatccttttttttaaaaaaaaacaaaaaaccttttgcagatatagttcacaaatttatcttttaaccaagtggccgtttctctggaaacaaagagtgtgccttagtaataggacaatcatagattttgtctgcatactaagcatttgaaataggcctacagattactacaaacagctgtataggattagtggccattaagggccagctgaaatgagttagtaaacttaagaaagttcaataaccagagagtcaaaaggagaaggtgatagtaaatcatgaggcaggtggggtctggatagaataggaatggagagggaagaaatttggtctaacatggcgtgggccttcttttcccattctacaggtgaagatgctgaggtttggagaggttgtgaataacagagtccagaacttggatgtgcagagctaggaataaagccaagtttatctcactccaaaggttctttagaggcttgaagtaaaggccaagtcagggtagccaggtgaaatccatgtactggcttgaggctcatgggtgcaagtagctggtccacaaacagacagacttttacattttcaggactactcactagttcttaacagagcctgacctagctgggggtctacatggactccagtaaccatggcatggagaaaagggcctggtggggagagaggttgatgtctgggatgaagggatgggtgtgtgaagagagtttaagaagaaagttcttgtggagggaggaaagaacccagaagctcccactaagtttcataatatattttgataagctagcttcagtgtcccatgtaggctactgtaggtagaaatagtctcattttaataaaggtgattacgtttttccttgtgaaaataataagtgttcattatagaaagtgtggaaaatacagaaaaaggaaatgggggaaaatatattcttacttggtaaaacaactgttataaaatctgttgtaattttttccagtctttttctattcatataattcatattattgtgatcatgaattgtatttgtcctgtttgtgttacttaacactgcaaaacaagcatttcccatcttattagcatttagtgttacatgtaattatatatatttatatataaattattataatttagaaaagttaaactattatatgtgcatatcacctatacctaacctattgttgggtatttagattagaagatatattataatacactccagaatggaataactggaccaaagatatagaagttttaaggacctgagacaatcagcagggctggattctcacttaggaaggcctttttagagtagtacctattcctgggttggattctcaaacttgacatgtccataactcagttttctcagtactgggaatgattagttcttaggagttatataggagttaactaaaactgatttataatagcaatcagacgtaccacatggtcactgtggaactcgttagttctgtttgtcaaatatttctgtggtccatctcccaggcaccttataggattatacttcctgctccctgagggtggctggggcctgtgtctagttctgaggagctatgtttggaagtgaacacttatttacagggggagctctttttgcctctgtcactgtaactggcaatgcttgagagggtggctgctccatcagcccacagtgagaatgtgagcaagaaatacaacttgaagcccctgagacttggaagttggctgttagtgcagcatgccctagctcatcctgactgccacaaagaagatactcacattagcatgcccaacatatttaatctctgtaaatagaaatcaactaaagttaaaagattgctaggccgggcgtggtggctcacgcctgtaatcccagcactttgggaggccgaggcaggcggatcacgaggtcaggagatggagaccatcctggctaacacagtgaaacgctgtctgtactaaaaatacaaaaaattagctggacgtggtggcagatgcctatagtcccagctactcgggaggttgaggcaggagaatggcgtgaacctgggaggcagagcttgcagtgagccaagattgtgccactgcactccagcctgggcaagagaactagactttgtctcaaaaaaaaaaaaaaaaaaaaaaggattgctgttaggattcatcagaataaaagaaaaatatgtatttatttcaggtgtttcacagcccttgattaaggggactgtaacattcaatgttaattaagacttcctcttcccaggtagtttgggctgggcaatgccaacatttaccttcccgagtctcctttttacacttttaattttcacgtgtgttcatgtgaagagaccaccaaacaggctttgtctgagcaataaagctttttaatcacctgggcgcaggcaggctgagtccgaaaagggagtcagcgaagggagatatgggtggggctgttttacaggatttgggtagacagtggaaaattatagtcaaaggaggttgttctctggcaggcaggggtgggggtcacaaggtgctcagtgggggagcttctgagccaggagaaggaatttcacaaggtaatgtcatcagttaaggcaggaacaggccattttcacttcttttgtgatttttcagttacttcaggccatctggatgtatacgtgcagatcacaggggatatgatggcttagcttgggctctgaggcctgacattcatgttgaccaagccaacttctgatggtcacggtcttcctttaattggtattgttttattttaaaagtcacaccatacactatttaacaaacaagtactttttaaaatttttgtgtatattgttttgagatggagtctcactctgtcacccaggctggagtccagtagtgcaatctcagctcactgcaacctccacctcccaggttcaagcaattctcctgcctcagtctcccagagcaggtgggattacagatgcccgccaccataaccggctaacaaatgaatactttagaatcaaatgaagtaaaatataaaagacctgctttctccctcccctaccagcccacttcctggacttcagtttggagcatccccctctagacattttctctgcagttcaaagtacaaatgaaatcctactcttcgtattcttctgtgctttgctttttcacctagtttctcgggtgtcttttcatgtctgtgtatgttgattcacccctttctttttaacgaaggcagagttctcagtttcaaagatttatcagccttcacttaaccagtttcctctttgtaaacagttttgggtttttctccagtcttttactattgttagtaatgctccaataaacatccctgttaaatgtatcttttgcacatttgcgcaaattaatccagaaggaaaatctctaaaaatataattctaggttgaaggaatttgcagtttaaatgccagtaaatattgccagttcctttcccaaaggtcaaatcaatttgcattcccaccaaaacagtgtgagaattcttgtctcttccccctctcaaggatccagggtattaccaaacttctagaaatctcttccatcataatcatgaaaaaccatattgcattgtttatttaaagtacattttcttaattacaggtgagtttgtgcttgttctttcttaaagtatgataataccttcaatcaagtatgatgaggctttggtggcattctttctctttaaagcatgctgattttactgcttgaatctcaaagaataagcctatttttaagccctgcagaagcatcttgtcgctgcccctcatttactgaataaacaggttcacaacatttctgagaccctttatatataggtatattatagctaggatgttttacagtgacagcatcaaggcagatggactgggaattgaccagccctccaacctctcagttaattgatgtgacatattctttcattgcagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccatagggtaaacctgtgactgagatcttactatcactaggttcccaccaacaggtcgtgcccaaaggtggcctgtaggctgcaatagtatagtctcacagagagtcaaaatggtatcattatatttcctttgtttttcctactaattatgttgcctgagccaacataagtgtttgttatattaaacaaacccatcccttttcacttgatgtgtaacactggttacttacccaagagagtaaaaaatcctattaaaaatattaaacagtattaaaagaagccctcaatggggcatttttctgtacaggtagaaactaaagtttgttttactatgaagaatattatttcattcatatgccagtctggtatgtaagatttaatcatatgtgacatttccataacaagatggaatactgggtaactactgtagagtttcttacttagaagacactagtatctgcagatgctagataacatggataagaatttgaaagcatgattctcatggaatgacagcaattaagatgctcacagaattcaattgtatatgagaatgggtttctgttttgtctcttttacattcatgtccactcatggttctcattaaagtggactatgaccagataacagccctatgtataatatgtatttctttaggtaacagggactacatttgaaaacactaaataaagctttctattgataaacatatacttatatacaatgtaacccttacaaagatagcaaaagaatgagaaaaaaatatgcagaatttccaagtgtcttaatttaaagttctttggattatcagaaggactttggaatcacggataattatcataaagacatttattattaattggaaccttatggtgtgtaggcagcagggtgcacagagacctgccactaactctccagccaaagggagctgagtttatggagctgcagtcacgtgtcacatgcagtgtttgcacttgccattcatggttgtgaggattaaacagacaaaaagtgtacataaagaacctagcacggccactggcacgtagtaggaacacaaaagaaaatggtattccttgtgatcttttttatttcatttagtcctcataatgcttctgtgacagcattatcaccattcctgcacgaggaaacaaggcttcaaaaggatcaataattatgtaaacccaaggcttgtgggtggcagagatccggccggaattcagactcacacctgtgtctctccaaagtccgagggccatccccacacaacaggcttctctcagggttcctaggactgattctgtagtttattgtgggccatgcttttcatttctctccttctctgccctactggctgctctcacagctgttagcacctctgccagggggtgggctggagaacaaaaacaggggctgtgtgggattctttctaccccagcacccagtgcactgccgcccagcatgcattagatagataccagttcgtacgtaaggaacagaacttctctctccagctcgctgcagccgcagagcccctctgccctcccatgctgagttctctcctaagtccaagctgccggctcctatcttcttagcactgtcccgccctccaagcctcccactgtggaaaggcacatccccagctgaaagcaagtacctgaggtggaaaagggtgtccccgaccaaaagaaggttagctatgattttcccagtgttcttgccacccagggaaatggagagcacagatcgagtgtgattgagcttacacctctccaagaggcaacaacagcaagccatggaggcgtttttcctcccaccctctttgatgggatgatagactgccccctggtggcggcgcagagcagctcctcctccaaagccttctgcttccacagcccctgggggccacttctgcagtgctgcctcctccggaggtgtcccaccgtggttaggagcagagtgttggggtgatggccatggaagcagtggccatgcagcctgagccatggcagaaccccagagtgcacccacaacaaaagtgaatccactttgcaccgcagcttccctctgccctcagcacatgctctccccataaagccccctgcatccgtggtttctgaaacgtttggctccacctgtactggctgcctccctgccctgagatatttgcacctttcccccctgggcacacatgcactctcatttccaatcctccttcgattccttggcctgtaaaatcccaggcttctgttggctgtctgcctgtaactctaaccatctcaccttcgcattgaagtgtcactggctgtcttgaaccattatttagtggtcctaccttatgcccccagctggacataagctatttaaaggcaggggcgatgtatgacatgctttgtatcaactgcagcacctttcacatggcaggggctcaaaaaatatttgttaagtgggtgaaaagcaaaaaaaagaaaagccctgaaagtaaatgcaaagcataataaatgtaatttttgtgccactgtctgattgtctttaggcctcccctgatttcaattaagttttgggttcgggatgtctttgttatggtcataatagacctacttcataatattgaccaaaggctctttctaaacagacaaaatactgaagctcatcctatttttttctgcacataatgctttacttaatggacttctgaggaactccaaacactaaatcatggcttatcaaagaacaatttttaagtcggggcttgttgggatataggttgtctcataatgccagtgttttctagaaagaaacattaaaacactatcagccagtgatttatctttttattttcatgtcacaaactaataaatggaataaatacagagtcatctgagtaacaactggtttggggctatgtgtttgttattactgggtaccctgggtttgttaactcctgaatatccaaaggtggtcactcttcctatttaggcccaggtaaggggcaatttactctgctgaagctgcattgttaatgaaaatataatagcaaagtttcaggttgattgcctctagaaagttttctttttataattaagaaattgctttgagggggtggaggggatggcatgaaaatccagggtggagacttggggtccctacatgtggagccctgcaattggtgttaagtggaactcacaagccaaagaattcagcccacgagtcttgctctgctccatcctggagcaggtgccattctgtagcgcccacagactctccagtaaccatgacagcatcctttcttagacattacatatataccacaagatatgcatctgctggcactgtccatcgttgaggacatatttggaaaatggcaatctgcacaggaaaagcaggccaaggacatccgtgtctttttttattctctctctctctctgttttagaacacaggttggcaaacttttttgtacagggccaggtagtaaatattttaggctttgcaaggcccacagtccctgtctaaattactcaactctaccaatatagcatgaaagttgccacagataatacgtaagctaacaagcatggccgtgctccaataaaactttatttatggacactgaaatttgaatttcatataattttcacatgctacaaaatgttactcttcttttatttctttttccaacaatttaaaatgtaaaaagctcacaaccacacaaaaacaggtggtgggccacatttagcccacaggctgtaatttgcctaccctacccctgctttagaatacagacagtccgttcaacttaaccattttttgctttacaatgaattcagcagaaaccatacatcgaattttgaattttgaattttgatcttttccttggctagcgatacacaacacgatactttcgtgaagctggcagcagcagcaagccatagctcccagtcagccatgtgatcacagggtaaacaagtgatactgtactctacagtagactgtattcaataaattacatgagatatccaatactttattataaaatagttttgtttttgtgttacatgattttgcatacttgtaggctaatgtaagtgttccaagcacttttaaggtagtctaggctaagctatgatgtttggcaggctaaatgtattaaatgcatttttgaattgccagtattttcaacttttgatgagtttattgggtcataatccatggtagttcaaggggcatctgtattcgataaggacttccttacagttttgtattgctgttgagcacatcaggacttccctgggcttgcctgcctcacccactggtatagaaagcacactgcatggtcattaggaagagaggtattgaccagaactgtgatggtgcttatttccttctagggatagggtggtcagctacacacttggccgcaggcttccaacagatcatgtgagtggacagctgcaattccgatttgagatcacttcctccatccacccaggtattttcagcatgaacttcatgtcttgtcctaggctagtgtcataagtgtggttcctttttctaaaatacaataactatggttctctccagatgtatcctaggttttgtggttatcttctccatttgaggtccagaagccagtgatctattctggaagccaggttgctgtccccctgatagagaagctcctcttcattctagtgacccaaaggtacagagtagacagtggactgaaggttaacaatgaggccaacatggatagggagttctgtcttatttatcatcctacccccagcacccacataggtgtttaatcatcacatacatgaatgaatgaatgaacgtgaaacatctttctacctagtaactagatatagactagccagttgctgaagaatgtcatgttgaagaactataattgtacaatgaatttttataatatcacagaaaaacaagaaaagtataaataggacagaaaactccagaatcatccagtgttccatttaatgctaaaacagatttcaaaatacgaatgataagatgcctcataattttatttttgctcttcttctgcagcccccatacatctcaatatagatcatactgagaactgttaggacctcctggaccatttacaagttgctgttaagtctaatgaagctcttgagaacttagagcctggagtttttcactacccactcattaaactccaggtctactttcctgtgccaatatacaacttagattgtaagaaaacaccttgactattttgtcttttcaaattcagtctatttctatattctgagaatacaactgactcttcctttggtgtagccataaggacagctttacagctcaccagagggactgattttctttagtgacttgcactaatgcatttgaaatggggaatttcacatctggcaggaatccagtagaacagctgcaggaaggtagagttaaacactggctggatgctacctcgtgaatggctgcttgaggtgaagaccttgttttttttaaattggaataaactctaaatgttgggaaccttccagcctgagatattgaatgactgtgattgttcctattcttcatccagcctttgaagaatctggttgcctgagaatcctgcttaccccttatgccaccctgcaggacctaagcataggaaacattctgagcaaatgcaattaactaaatataatcatcaaggagctataaataacaccactactaccctcatccctggaagtcattccatgtggcaaacactgttgagcacctactatgtgcccagaactgggttagtgctaggctttgggcattttaaccaaaagatgaattccctttttgaatcgtatttcggaaatatatccatgactgcaagttgttgttaacatagcaagaactcattcttacagaatttttcactagagctctggccagtgagaaaccctcatcaacctacattcaatatcctaatgtagaaatcccttagtgatggcttacatgtcccacagggtatcctaacaccacaatgctctcttctgggagaaatgacatatttttcttcttaccagcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggttagacctcaaacctgatcagagtgagaataggaccatcagggggacaaaggtgtcaccaacagtttaaaaacaagaagggcgggggatcggtgtcaaacggggttgctggggcaatgtatgcctgtcttgtatatacatgtgtgcatgtgtatctgtgtatgagcatagatgactgtgagtagctgacaccccacaatgtctcagatacacaccaggaattacgactggttggatgtgagcgtgcacttgtatgtgtgcttctatgtttgttttaactaatcaccagaactggttagtgtacatgttatcctagtcttaacagcagccagagccccaagactagtatcaaatgatatacatgggaaaaatctatctacattaaatggataatgtgtaaatatctgctgactttcaaagcacatggaagattagcaatagatgttaatattagttgaagaacagattttacctctgttttagaattcaactagcccatgtacgtacatatagatatgtctagcctacatatatttgtcattatttatgtccactcaattcttgttattactgttggttttgttttgttgttgttgttgttgttgttggctattttggctaatggaagggaaaaataacatgattgtgtataaatgactttgtttccaataagaatcaaatccaaaagctgccaccattagttttaaaacgtattctgtgttttaaccaaagatgttctttcttagtcatgcctgtggaattatatgtgaaattaatttgcatttccttatccaggagtggaaactgtcttccagtcaagtgacagtggtatgactgggaaaaaaaattgaaaagtcacataataatatgaaataattcagttgttttaaaagagaaaaacatagcctctgctattttgctgttctgctgttgaaattagcctccaacaaaaggcggggatattttctctagattgtaagctcatcaagggccagagttgtgtttctttatgtttgaattcttagcacctaaacaaacccctggtgcctacaaattttttttttaacaggagctaaagtgagcattaaaaaaaataattttaagtattcaataatgcccgcttctacatttcagaaaaagagtgagagaaggtggcacatgcaataatgagaaacgcaaggaaattggtagagaaaaagaaacacaggcagaaaggtaaaacagacagcatggaaaggtacccacaaggagcgggatggaaaatccctcctgtgagtagaagggaatgggaaatgcctttctttcacaaggatgtttcgaggacttcctttattctaggccagatgtaatgcactgggcgcaggaagatggagtggcatcaggtgatgtatggacattactcgataattacagcataattaaaataatacaacaaaaggagattgggggattcccacataaaaggcacacataggagctggcagggatgttgggttacagaggtctgtagatttttcctgtgaagagccagatagtaaatactttaggctttgtgggtcaagaggtaaaaagctaaataactgttctcactaaaaagctttttttttttgtattaaaaagtgtactgacacttttcttagctcagagccatacaaccctgttttagtgcacagttttttggcccccatgttgggagataatctacacatggtcaattgaaacttggctcaatgtaaatttatataagatcatgttttacaaacaaaaaagtcacatccttgccctttagaggccaacagtctagcaggtggaagagcaggaagtgtttcagggtcacagtggacatctctgaattggcactggcagtttctaaagaaatatctaagttcctgaactctgcagagtgtaaactcagaaaaggttaagaagcacctacatgcttcactatggcgatcacaaggggaaataaaaagattcccgaggggtctcttgatctgctgaaggccatgcacacgctggcatgtgacttcttcccagccatccttccccgcctcagcagtgagtccccaggctaaccgtgtctgcattgtgggactgtccttcacttgccaccaggcttcacaacagcagatgcttcaagaaagcagggctttaacatgacctgcctgatacgtgattgtgtgggtgacctctgcttccataaaaatccctattgctccttcgccttgacttctaagattgcaaattcctttactgtagaaactgcattagacggctgggtgtgtgggctcacgcctgtaatcccagcactttgggaggccgaggtgggtggattgcctgaggtcaggagttcaagaccagcctggccaacagggtgaaaccctgtctctactaaaaaaaaaaaaatacaaaatattagctgggcacggtggcgggcacctgtaatctcagctacttgggaggctgaggcaggagaatcacttgaacccaggaggcagaggttgcagtgagctgagatcgtgccattgcactcccaactgggcaacaagagcagaactctgtctcaaaaaaaaagagagagagaaaaaaaaactgcattagattaacccaggtggatttgttgtccacgtgcccacatagataaggctgcaacaatttatagaggaacactgttctaagtctgaactgacaactatacaggctagtattcttttcatactttttgctttatttccctctataaatacctcctttttaaaagtttaatttaaaatagttcttgaaagaccttctgcagataaatgaaaagagtaacataatgtcattgttatgagctcaggccctggagtcaggcctcctggatttatattcactcctcccacttcctcaccaagttacctagctgttctgtgcctcagtttcctcatgtgcaaaatgggtataattacagaatctccctcaaagtgttgttgggaaaatttaatgagatgatactacaaaagcactctgcttcccaccaagtgagggttcttccaggcagacaagcagtgagggtaactgtttatattatgttgtataaagcatctaaaacaatcctttgaatttgcatttcctgtactttataattcaagggaaattttcacattattaggtataaatcactttgcttcaaataatatgcaaggcaacctatctttctctacaattaggttatattatttataaatagaagggaatttaaaacgacgttgcttgcttttagctgaggaatagatctctttctgggaggttctggcgggtttcaacacttgctttgtgtttgaggcaagggtgatgatgtggaaccctgtccttgtgcagaatagaactgcttgcttcttcagtgcctccatccattcagtcggctgagacatgttggtcacatcattgcatttgcttggggttcacaagcaggtgggatcagctgcattaaccccaggcagtcaacaatgttgtatttccactagcttggaggagtaattaacctgattggttgcattaatttcaagaggtaagtctattgttgattttaaagaaactaagttaaaaatgcagcagctgatgacataacaactataccatggttttgtttaatttctgacactaaacatgtatacaaacaaacatgagtgtggtatccacttaaacacagagcccatctttggaacagcagtctgtccacaatgaactgggtgccggcatgaggggaaccttccttgttttccattagcatctccaaggacccagaggatttgagtaacatagcagaatttgctcaacaaataatgttctatatttaacatttaaaaggaccctttgttcctgaatatatctctccttctgtttgccagtgagctctaggaattaaatcacaaaattaaacccacctttcttcctaattaatttatttttatttttgatcagttccgtagaactagagtgagaagaaataaccatcctttccatgtgtggatattctaggaaatattcagcatttgagatcctacaaccatttgaccaccatttttcagtctctctcctttttgacccaagggataatggaacacttgctatttgcatcagcagaggacagaagaaggaaaaggcctgacctttgccctctggcccttaaaggcttttgcaagaaaaccagcatggtgtgaggcaggaggaaccatctgaaaaaagggccatcctttgtcccgggcccttctcactctgcaaagatcaagagcactggcctctgattatgtgacccaagcagctggtgctgcaggcctgccttctgcatggctgctctacatgcctgaggacaccacttcagaacatcgttcagttcattataagtccgaactgagaacagtataagctatgtctgttgtaggttttcttttaataatctgaggcatgcatcctgtggatataatgtttatttctaaactttctccatgtttgtctttcttcctccttctttcccatttctgtgttttgagctttcctgtcgccgtctttctgctttttatctacttcctttgtctcttgtcctttcctctttccggagcaccctggcttgtctgatttctcctcaaaataatctggacagtcctgagatccctcagccccttggctcccctccccaaccccccaacctccagctttcctactacaggaatttactttcttggctcgccagctccttgacctgtcttggtaccatctaagagttcattcccctcaaaaatctgaaaaacagcctttcggcagccctgtgatgaaacctatccaagtgaggaggtgtcattttgcataagcccaaggaacttttgtggaaccttataaaacgctgcatttccctcaaacaggcctatttcctccactgggctaaaatcaggctctgctaattttctcttgtgttcctttctggtgccactttctgattcaggaaattcgggtcattacagaatcagactcaaatcctacatattggactgtgtggcgcagatcattagttatgaagtgttttgattttcttcttttttaaaaaaatatttcccccctcacgaatgactgtgaatgtagcaaactgacacacacacacaaatggatttcccactctttggggttgtttcttgtagtgcttagttttacagtcatgcttttttgatgatgttgccacggcagtgaatgaatctgaatgtattgactatcttgtccgtaggtgaatgtcctatactccataattcccagccagtaagccagcttccttccctgaggcctgaacatcatcactacccaacaatcgatgagcctcttccaccaagtaagctttagtttttaaaatctgtgtcttaactcttcctatcaagtctaagcaggtcagtatgaatttgtgtgtaaacatctaaagtctttcccgactccgtgccttacagtgttaacaaagaccaatatgacacctgctctaaaaactggtggttttttgggggtttttagtttgtttttttgactaatagtttcaccatgtgatcttgaagagataacacagtgttttcagtgcctctcaacttctgaaatggagagcatttctctgttagacttgactagtctttgcaaactgttcatgacctttaagtcccaaattttacattttatatttaaaatttgcagttcaagatagaataatcctattgttctccattggatctgttacgtcacaagcatctccatatgttaaaacaacttcaacccatctgggcacatgaacttgtactttccttactataacttccatccatagggaatagcttcaaatttcttctgcagttcttaggggttgccaggcaaaatatcatctttaagatagaattcaatgtcagtttctcctggtaactgtagtgggtaattaataattatctaactagtcatctgaacttgggaaattcatttaatctctcagggacttagttttctcatttgtaaaatttaaaaaataaagtttaaatgtctccatctgctcaatgaaagatttgacctagatagtctctagataccattctagctttaacttcataatactccatttaataaatttataggaagaaattgataccccagacattatatattcacttggcatcacatatgttcatgaattctagaacatctctgttttggttttgcttatttttcaagcaaagatagtatttaagatttgatagattttacaactacgaaatctttccagaatgcaaggacccagtgtttctttacattcttttgcctgtgcttacatgaagcagttacagttttcaaaaggagaagtgcttatttcttagttcatctgttcttggtaatgtgctgtactttacaggaacaccactcctctccctattcaactgtaatttattggtgagaaatcaaagaacatcttttatatgtggactaatttaaagaaacacaatatttgtttttcaagggcaaagccaaacatcatgtccttgaacttttgatgcctgatttctttctttctttatacactgatttatggacattctataaatgaagagtaacattttagcatcactacaaatacttcctaggtaacatttatttgaaaaatatgtataacatgttatctccaggaaagggatgctttccccacaacaaataacctttcaatgcatgaatctacttcgaatctgtgcagtacagatgactagttatacatgcaaatattataaatgattgtacataaatccgttgtaaaataattgctttatataagccactttcaataatgagaacaaatttctccagacagctttcagttttctatccatataacagtgaaagaccttagaaaaattggtaatgaatcctaccaactgaatattgttaaataatctcaaatagtacaagaattaccttattgctgatattcattcattcaacaaatatttattgaatgtttgccctgtgctaggtactattgtgggtaagcaaaacaaagattcctgccctcatggagcttacagtctagtctggaagacagattagcaaacaataaaataattaaacagggactggcctagcataggagatgctatggaaaagcaaaaatagaccagggtgagggatctctgagttcgtgtgggggtggctggtttgcagttttaaaacaagtggtgagaataggcttcattgagaagacaacacctgagggttaggagagttatccctgcaagtgttgggcaggaagagctttgcaggcacagggaatggccactgccagtcgggagttggaaacaccctgctgggtttaaggaacaggagaccagtgcatctggagcaaactgaggaagggagaaggcagcaggtgatgtggttagcgaactagcaaggcccagatcatgcagggccttgtaaaccatttaagggctttgtaaatcacttaagggcttttactctgaacgaaaggaggacattgtagagttttcagcagagaagtgacattgtctgcctcaggttttgaaaagtttgcccaagttgctgtgtagggaataaattgggaagaggaaggatagaagcatgagattcaacataagattatgtctttatgcaggaacccaggtgacaaacaatagtagcttgggccagggtgggagcagtggaggtggtgaggagtggtctgattctggacatatattttaaaggtagatttgatgacagattggatatggatgtgagagaaagataggtatcaaaaatgacctaagagtttcaacctacaaagatggagttgtcttcaactgagttgggtaggaaagactgcaggcagagcaggttttgatgggaaggatccaacacttggtttcgatcatcctgtgtttgagatgtcatccaggtagtaatgtcaagaaggaaattgaatgtgtgactctgaagttcaagagaaaggtctagactatgcaatagtattacatttgttaaaattgttcaaaatacacagttgtataggtttttgttaatataataactaaatatgatacattatcaggttctatattgttcttggactttgtggagaacatataatttagtgtgcaatagatcctttggtcacaaatgaattgacctgacctgcactgctataacttgccccagaatcgtgaaggtactgttttcaggtggctctttagacaaacccatggcatcacagtgctgagcccttcaagtcatgctgatgcctgaagttccatttcaaatttatttcctttggttataaaatatgtgaaagtaaattctttacaaagcaacccagaaaacatgttcataatttctgattacacttagctattattttctgaatacatatgagtatataattagcacaatacattccaggtatttaatgtattgacaaaagagcccagctgtttggcttactacacttttccatgaggaattgaaacatgtgatgataaattatcattattgcagcttcattttctagctttttcccttaatttataaaagccaacctttgtctgcgaaggacccctttctttactgtaggttcctggagggcagggtcatgtgtcactcatctctgtgtcctcaggacctggcacagtctctagttcagagtgagtgctacacagtttgttcagtcaaattaaattccacaatgctcttcaaagactaatgctcattttttgttggatgacagtcatgttggattcaagaaaaatagttgtcctactgcttttactaatattagtttgggatccattaaaatttttaagtttctagatcaagattaattacctagtaatcatatgtatatacaatttcatccatgagctaattaccatttacacttaacacttgacagctggattatcattagataatcattagatctattttaatcaaaatctcctaggacatatttatacaatctgcctacatttttccttcaatttgtctcataagttaagtttggtgtttggggatactttggtttttactgggcattatttgacaatccatcaggtcaagcataagccatcatgccacaaacagatatactatgtacatataaaaccataaatatgccaaatatattttttcccttaaaaaaatgagagttgctatgtcattacctgaatgataagttttcaatgaaactgttagtatctgacctactcccgaaagctatggcttttctcactgaaaaggctggatggttttcctccttttgcagtcacttttgcttttccttcttcttctttagtcttgtgcattttcagcataactttatcacactgctgctgtttccacaatgtgatatgtggactctaaaagctttgcccatctctgtacagcaggcattgctcttctatgtttcgctcagacgtgaacacattgcttccagctcttttccacccacctcaccccagctcagcccctgcctgtattatgtagtgaatcatccatgcttccacctttttgttttctttttttttgttttcttttgtttttaatttgggaagcaagggaacttttctttatctcgggctccctctacagtttgtgatggttatttatcaacaaaagggtacttcctagttactggtttcgtttggtggccagagatatttgacagctgcgtgttgaatatacactgttaattaacaacttatcaaaacgctgttttgaaaccctaacaatcatttccttccattcacccactcaaaaggaaaggcaatctattaagtttactaagtataagacagaggtcatctaaattcgcacatccaagattttagaacagtagttaaaactggctttaatctgagggccattcttctctccactgaacctaatcgccctctgttagacttagcaaagaaagcattctccagcatcacagtgtcagctcgcactggaggataccccaatcttccacagctgtcgtttgagtagccaacaagagtgacagtggtgatggacatttctaaagaaataaattcattaaacagtagattttctctttataaattattagaatttttgtattcgtcacaccatcacaccatcacgggtgtgatgacccgtgcctgtaatctcagcactttggaaggctgaggtgggaagatcacctgaggtcaggagtttgagaccagcctgccaaccatggccaacatggtgaaaccctgtctctactaaaaaataccaaaattagccggacctggtggcaggcacctgtaatcccagctacttggaaggctgagtcaggagaattgctcgaacccaggaggtggaggttgcagtgagccaagatcgcaccactgcactccagcctgggtgacagagcaagactctgtctcaaaaagaaaaaaaaaaagaaagtattagaattttaacataggtgttgatcaaggaaccacaattactgtttaatatggcccagcagagagtctaagttcattaaattgttttctgagctcccgagttcatgccagtgccccagaagtcgtggtggcaggtgctgtgggcagggtctggcctgcagccatgaaccaatggtgagttctacctgcagaagacttggaagttgtatgtgtttcacgtgggtcagtagtttgtccttgatttttctttttgcctttttattaaacactagactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggttggtgatcagtatgcaatgagctcccctaaaccacagtgaaaggagaatggcagctagagacgctccccttacacttttctgctcagactgtatgaggagactggaaagtaattaagtatcttaagaaacctgttcctagtaggtatttggaaagctagatttagaatttggaggcgagagacaagttaagcttgagtgtcatttaaggatgggaaatcgtctaaacttcttaatagcctaggcacaaaaataggagtttttaaccaagggccagtgtatgcccctctcctgcgatgttcaccaaggatgtcagtgttccttgaactttccaggcactgtacccaaattatacatagatacacatttttctggcagactggtccacacccatcatacagttctcaaaaggatagagacctcagttaaacacattccaaggataggttccataagaaaactaaaagctgcttggagaataaactgtctcataaatcactgtatgcattcctaccctgattccataattgatatatgcccatcaataataattcttgaaaagcctgcatcttagaaaaagaaatgtttacaagcattttttgagaattattttgttgaaaaactaggccctctctattgaaattgtaaagatgtcattttgtttttaacctgcaaacaaagccttaaacagtatcaggcttaaacagtggtccattcatgtcagagatgatgcagtaagctagtataaagcattgtctctgacatcttgctctttaagactggagtggcagcttcaggatacttttaattaccaggaatgcaaactgaggcttccttcagttgaaattgcacccacatgctgtcttgctttcatgtcaagtatgaaaagtatgaaggtgaaggaaaagttgagaaagacgaaaaagaatgaagaactgggtttgtggaacacacctactgatagcaaatgcctttgagacttaactgttatctgccagaaagaaaaggaggagaaacaatttagtcctattaaaaacacatggggccgggtgcagtggctcacgcctgtaatcccagcactttgggaggctgaggcgggtggatcatttgaagtcaggagttcgagaccagcctggccaacatggtaaaactctgtctctactaagaatgcaaaaaaattagccaagcgtggtggcaggcacctgtaatctcagctactcaggaggctgaggcaggagaatcgcttgaacccgggaggcagaggttgcagtgagctgacatcacaccactgcactccagcctgggagacagagtaagactccatctcaaaaaaaaaaaaacaaacaaaaaacatggaaacaaaaaaataaaaatgaacttctgtttactgttgtacacagaggagcatgctttaggtgaaaatcaccagaacattttttcattgcctgagcgtttggaagacatttgctttccacttttccccatcagcagccgagtgttttaagtcattaacaaaaaccataaaagacttgcattggcagcacactttacaatcattctcaccccaacaaagcgtgttacagagaggaagtcctgataacccagttttactagacatgaatggaccaaaaatccatgggagagtcctttcatggtgattgcaacaagattcgtgtaactaaaaatgtagaagacacagtaagctcatcttacatagagaccctgttgattccataggcagaagttagcccctaggtctgtcttgccaaaaatgataagctccaattgtttagcagagaaacaggggagggtatcgtcaggctgtattcataagaggtactgttttgaacactaaccaaagcaagacaatgaatctgaagcagaaggaagcaccttgacctatggcataaacccatgaaagtttatcggggtgatctgcttgcataatataaaaattaggccaaatccatcctgaaccaggtctccaaataagttttatagcctttgatatacaaactcctgtgccctccagtggagatgaacatgctgggagaggcagctggaccttgctgaataggaagttgcatttgctacatccatctggacagataaaaagaaaaggaatttagcactttgagaaggtacttatttcttgtgaaaaagcatacctagggaagatcagataaccttcagataagtatccagatttttccatacttaacctattgctttgaagcatttaaaattttttgtatttggcattataacaggcagcccaagaaagtacatttccagtcttctatccatctcacatgcgaccacacagaaagtcgtttttttgataacccacagttatccagagaaatttacaatgattactggctcacagccatgtggaagtattattcagtgttgcaaggagtttcccttgagctgaaccagatgattgtgaaaatcaaatgtgtttgtgcaaggagacataaaactaggaagtacagagtacacaatagcaatcaatgtgtaagcttgtgtggtaggtcgcagtgaccatgttccaactcagccattccccagacgcggcacactcttccaggcctttatggcttggccacatgctcccatggcaggaaaatgcctcccacctgcctcccacctgaaacatatctcatcctacagacctgactcaatgtcgtgccccaggaagccgtcccagaatccctcacacagagccagtgacttcctcccctatagcttctggaatgtgcctgcctctgtgcctgttcttacctttttgccttactcttctttctacccttttctgctcccagcacctagtgtggtaccagaagtttaatactactcagtacaagatcattttctgagttaattcccatgctttcagaatatccagaattaattaattctactttcacaaatatttactgaaaagcagaaaatataaatatgtattcttattttaaataatcaactgaagttttattttttaattatttgtataaaattatgataatttaagggaaatagaagttttaaatagaaaaaagtgatctacactctaccccaaggatgatttagttttttttttttgagatggagtctcactctgtcgcccaggctggagtgcagtggcattatctcagctcactgcaacctccgcctcccgggttcaagcgattctcctacctcagcctcccgagtagctgggactacaggcatgcaccactgcactcagctaatttttgcatttttagtagagagaaggtctcaccatgttggccaggcttgtctcgaacccctggcttcaggtcatccccccgtcttggcctcccaaagtgctggaattacagacatgagccactgtgcccagccaatttagctttttaaaaacatgtatccatcttcaatttccatatgcatgcacaattcttacatggttatgatggtgatatgtagttagtttcatattcttttttcacttactacactgtaagcatttaatattgccgcatagtcttcaggttaacatgtaattgcttgtatagtattccactgaatggctgaagtttagttaacctgatttcatattgttgaatgttttgcttattgcttttgtcactgttttttgtcacaagggcctgctaaatactaagattgccttatagtggagggtttccttagggttctattcccaaaagattaggccaagggagataaatgtggatttggcatttggtatcaatgcctaactgctttctacattagacattgcggttctaggggtttattctaccaacagctacagcttcacttccatcttatcttttgatttgtttttgttgatgtaagaggtgctcctcgtattttgatgccacttacatttcacttgttggagcaagggtcaacttgttttccataagcttttctttaataaggagtagtttctcccatgtgaattgtctgttcttgggcttttttaaaggggggaggttgtgtagttggctgattggtttggcttggttttggagggcttttttccttcttgtttggctttgtacgtgtgtgtgcgcgcgtgcgtgtgtgtgcgtgtgtgcgtgtgtgtgtgtgtgtccatttacaaattatgtatttcagctgactttctagctaattttcattagccctctatctattataaatatttaaccttttgctacaaaaaaatggaggaggatattgatggataattcctaatgaaatagaagagagctgcctccctctcctgtttaaagctcgggagcctctgaggctgcagtcctgccctgaaagactgagagaccctcctcaagtcactgcatgacctgcttccccaaactgcctctgtgcttcggcagaggtcagacgtagggtcaaatgcaggatttgaggctgttgactcagtaaggcctgcaataaccaaggtccagctgaggacatgtgaagtaggttgtgacactgctgacattatcctcatcaaataagatcatatttactcataatgctctgctgtgtttactgcatattgggaaggaaaggagaggctacaacttgacatttgtctaagccctattccaggcatctgttgctgagtaaaactacaccaaacgtagtggcataaaacaaccacaaacatttcttcttaccgttatttctcatggttctggtttgattgagcccagctaggcagttctctcccagaatatctcctagttgcagtcagagggtggccggggctggagactcacatattaggaggttgatgctggctgtgggctgggcctctcagccaggacacctgcacagagactttccacgaggcctgggccacctcagagcatggctgctaagttccatcacgaactgttacaaactctattagtcaaggtagttgaaggggacatggattctaccttttaaaaggagagatacagttctggaagagcatgtgggtctaaaaatatcgttgaaccattttgagaaatgcagtctgccataaagcatttagggaatcctcccagtagcagctgccttagtctttggcaggccccgttccctgccttggtcaaggtcacacacttgggcagcttcttgctggcaacccctgctttcctgccatggctacattccctgagtcctcagcagagagaagatcacagagtgccatccttcaccatccatcactcttcataacctcccaccacagatgtacggggtggtgaattacaacaaatgattctctctgtaattccaccaccactcagctcattgcccccttccacattttgttctaagaggccggctcaggaaatgccttgcagtaaccactacaggcaaaggtggcttctgaaaggtgtcagagtgagtgggagtctctccagataaaataaaactgaaagaaagcccttagaccaatagttctcaaacctagatataaataatacttcctaaagaactcgttagaaatgcagatttttcttttgcttcaatttctgtaactttaacaatcactcagatgatgctcttgcaaatggctggagactacagtaaaaaaagctttcctctgtaaggtcaaggaaagagcggggcactggtctgcagaaatcctgccatagtggagcctcatctgtgcagcgagcatccccgtgctttcccacctgggactgcacttggagacaggctattccctgctaccttgtctctcatcctcctcctcctcttcaccccctccctccaccccttcattgctttcctggagacaaaaagtctccaggaaagtctccagcctaggctgttgcaggagcccccagctgctctccacagctcccagctcctctcctccagtgcattctccactccgacactggatgatcaatctccatgtacatctggccctgcctggtttttttttagcagccacccatcaccaagagcaatggttcattctcaagattgatccctgggccagcagcatcaggatcacctgggaactcatcagaaatgcacattctggaaaaaaaaaagagaaaagaaaaaagaaatgcacattcttgggccctacaccaaacctactgaatcggagactcagggggtggggctggcagtctgtgttttaagtcctgcgggtgattctgcgtagctcaggttggggaacctgtggcctagagaataacacccatcctactgcagggcgccctctggggctccctcttccctctccactggtctcctggccctgccaggtgcccacacatcctgatgccgctgccaggcatctcagagctccccaagggtggcctgcttttgtacatgttgtttcttttctgaaatgccctttcccaacaagctccccaacaaattcatactccagcttcacaatttacaaaccttgggagtctcctcatctgtgtcccacatacctcttgcctgtctgtgacagcctttcacctggctggagttatggcttctgtcccatttcccttttgttacatctcgactgtgtgtgtttaaagggcaatgtcatattctaatcctctcttccatctgaaagtccagcacagagcctgcacacattggaagggttaggaaatatttagtacttggcaaggtggccagctggcaggccaaatgactaaatccccaacttgggaagaaaaacaaaatgagcctttgaataagcagaaaacatttatttatttgccagcatgctatcagatgtaatatttccatgacctctgcccaattatatcaattacccgacaaataaaactgagtagaactgctagcccagtttgtacacttattacaataatgttgaggtaatttgatatcttagttgtagcattttaatttacttcccacactcttattttagacttagcctgattttgtttaatgcagggcacaggctgttttgcatgattagttattatttgtgttgattttttaaaagtcgccatacttgaaactcatcatagcttgcaaaacaaaaagaacttgaatcgtcttagagatacttgtcttgctaattgttctggctatcttgtgggaattttaagcatttctttcctgacattcaagacaattctttacagatttctccaattatctgattcagagttttggcccccaaggagcaaaccaaagttaactcctgtctttccattttctaatgcaaaggtatcaaaacattcagcgaaccattgcaacagagaggtccgaagaagattctggcagccaaagctgcgagcaagccccagcaggaggaggcggaggtggagggagtgactcagaagccgaatcttcccagtccagcttaggtattggaggaggggtccccacaacctgtgatggctttcaggggctgtgtgacagagggctacaagcctcccaccctgcctcatggggagcaatgtgccccagggtgaagagagtggaagtccagggtggaggacagaggcatgcctggtgcccgcaagggaaagcagacagaatgagcttcccaccaggaaacttaggagaagtgatcacagtgaaggaaacaccaccaccctggcatggggatctggagacaggaaagcagatgaattctggggatggagctgagtttgctacagtgcttgtggagcaaggcaactttgtcagtggctcaatcatttattgttaagtaaatgttttatttatttataagttattgttaagtaaatttattgtatttgttggtgttctaaggattttttcacttataaataaaacatgcaataaaaattcacagtatattgcaaaggagccatgtgacaacactaggaataatcacttgtttgtagaataaaattcagttcccccaagagaggaacctgggagtgaagaggttttccagcatgccacaggagggaattttttcccactacagtaggcattcaccttggtctggttttcatggttttcatttctttgaatttgcccaagtgggactcagacaaggataatcaaaaggcatgagactggcttccacttttttttttttaacctgtaatgagataagattatcacagtgacatcctaataatccactttctttttaagttgggtaaatgatggcagatttatttgccaaaagaaggcttagagaacagtctgggcaggcagcactgggattccaatcctgccaggtcttagctgtctacagcaatgcagaatattggacattttcatgtgatttttcaaaatgcacatccacagttccaccaccaattttaatttccccctttctattcattttaccaggtatgctaactaaactgactagtttaggtttttctgttattattattattattgaagacagagtctctctttttcacccaggctggagtgcatggtgcgatcatagctcactgcagcctcaaactcctgggctcaaacagtcctcccaacacagcctcctgagtagctgggacctcaggcatgcaccaccatgcctggctaattttttcattttttgtagagacagagtcttgctatgttgcccaggctggtctcaaattcctggcctcaagtgatcctcccgcctcagcctcccgaagtgctaggattacaggcacgagacatcacacctggcctgttattaatttctttgttcaaacttctgagagagacatggtacaatagccaagtaactagaaacatgaggaaaaagcagcagaaagtttatttctgagtttgatattaaataagttggcatttactgtatagaaaaaaatcccacaattagtggctgaaactcacagccatgcatctaccccacagttctacaggttggcaatttgagctgagctcagctgggtggttcctcaggatgctgctgggctcacctgtccatcgtgggtcagctgcggagtcggccacaggctgacctgagatggctgccactagggtggcttgttcctgctcctgtggcctggtggcctctcatcttgcagcaggcttgcccaagctcattctcatggcagtggcagggttaccagagagtggagacacacaggtctcttgaaaccctgatgcagaactgacccgttgtcacttctgacatgttctattggttgaaacaaggcacaaggccagccccaattcagcaaggggaagagcagcgaagtcccaatacaactgggtgtggatacaaggaggagaggaattgtggtcctttctgcaaacaatctatcacagctgtggttagcaacttgtgaaggaaataagaaaaaaatagccaggcatggtgctgcatgcctgtagtcgcagctactcagcaggctgagtatctgggaggatggcttgaccccaggaattaaaggctgcggtgagctgcaattgcgcggctgcactccagcctggatgacagagcgagacgctgtctcaagaaagacaaagagagagagagaagaaagaaagaagaaaggaagaaaggaagaaaagaaagagaaagaaagaagaaagaagggagggagggaaggaaggaaggaaggggggaggagggagggacagagggaaggaaggaaggaaggaagggggaaggagggagggagggaaggaaggaaggaaggagagagaagaaagagaaagaaggaaagaaagatgaaagaaagaaaaagaaagaaagggaaagagagagagaaagaaggaaggaaggaaagaaggaaggaagggagggagggaaaagaaaagaaagaaaatcattgtgataaaagggaagagatgttggaggacttgagccttactgaagttatgcgaaacactactaaggaaatgatgattcttaactgacatacataaagtaatgacacttggcctaaatccaacagtctgctgtgtgggtgaaggcttgtgtgctgccactgtcaggagcgaagtacagaggttgaaatgcctttttcccaatgcattctgttgctttgcttcactttttttcagatctaaggagagaagggtcactttctccagtgaactcacaaaaaatcaccttgctgctgcagtccccagcggtcaagttcatcaccaaccccgagttcttcactgtgctacatgccaattatgtgagtgccctaaaatgcagagggggcggcctggctcggcaagacccaaaacacagctttgtaaagtcatctgatagatctaaaagggtagaattttaacataagcaagaaaaaacaaagaaaacagctcagtccactcttttgactatccgtgagtctcccaaaaaggaaaaaggctggatttggaaatgctgttgcctctttgggttttttttaaggctgaaatgtgttaatgtcagtgaaagtgctttggaaacaaacctgtttttattattattaaaattttaaaggagcaagattatgaattggccagattcccttcagcctaatcattttataaaatcattttcactgatacaatttcaaagcagagttcttctaggtaaataactaggtttccttttgatatggttttttcgaatatcgtgctgaagttaaatttcatatgattttacatatgtagttttttcattgcttttttggtattttcaagaaagcaatggcatgatatcactatattcattaatttttccattcaacaaacattttctgtggttcaggctcagatctaggtgctggagtcacaaagacagattaaggtgacacctaaagagtaggagttcccattttgaggagcaatgacgtgaaaaacatcagcccagtgtgacaggaccaggccgaactgagggaggacagagtgctctgggggcgccagggagcattcttggggaggcggctgaattgagtcctgaaggtcgaaagtggacaggaagaagtccaggcagagggacatctgtagaaaggatgcacccgtgaggaggcctgggggataagtccagggtggtgagtgtgggtggctggcaggagggagaggggaggaggggcttgagattgggcagcagatcacctggtaactcatgcaaaggagcctgggtctactgcagcaggccacaggaaccaagagtagcacttgggctgcctgaccagaggggttgatgatgcattttctctggcagagtgtcggggagagactgagctgagggggttaagacacaggctgattcaaccgctgagtgagagatgatctggctctgacctaaggaaggggtgggagcatggcaaggaatggctccattcagggacatttctcgtggactcagcagcacttaggtccaccgtgatcacgagtgggtgcaagatgagaactcaaaaaagacagtgtagtttctgctttgggcacctgagtgaggcagtgaccgcactaagctggaggtggagtttgactgggtgatggagggcgtggctgcaaagggggggatcagtttttagcaggttatttctgagaagcctgtgggatgccctgggctcaattccaagcagctccccagaggtgttgtggggaccacagggagaacgcgcatggcacatggccatgccccagccctgggtgcaggtggcactgggccagtaggtgccactggcccaaccccccgtctacacgtggtctgtcctttcaccaccagcccccaccacacacacacacaccaaccctgtgtaccgtcacattgtcatttctttcttcatctcttcccatcctccaacccccctacacatacacacacacaagtttttacatagggttcaaaggaatgacagacctctcatgtccagccttcaatccccagaggccctaaattaatgctccccattttagacaagtaggaggaccaaaggcagacctcaatagtcagagaagggaccatggaggagagagaggagtgaggctcaggcaggtagagggaggccaaggagagccaggcatggctgagacagcgagaaaaccatgtggagtcgcacagagaggtgggccgtgtcccaagctgcacagcactcaggtggaacggatatcacagatagtccatgtgggccaagggggcatgattcaatgcacattcactttttttttttttggagacaaggccttgctctgttgtccaggctggagtgcaacggcacaatcatagctcactgcagcctctattctcagactcaggtgatcctcccacctcagcctcccaagtagctgggatcacaagcacatgccaccatgcccagctaattttttaaattttttgtagagacagggtctcgctatgtagcccaggctggtctcgaattcctgggtgtttacttcttgagcaagagctcattttctgaggcctctacctcacactcacaataaactgctgtgtcacaatcacacttagcagtgttagggtgctcatagtgtgcttgctctatgtttttcctaattccccactccttaccccgtccgccctgacctgtctcagagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaaggtgagtgtgacccacgtgcggggctttcatcaaacaggctccttccccagggtgaagctagcaagggcgtgaggaggagagtgtggggaggagttatgtctgagagatgtgctatcggccgccagcagtaaaggggctgataaccacccacatctgggtttctcaacctcagcactactctgaggaataccctgtgccttacgggacattagcagcactcctagccctcacgctgctagatgccaactgttgtgacattgctatgtgttccctgtaattaagaaccactgtctacattttttttaaatttaggtttggaatgtggaactgaattctgtccaatgacctttcggttgtttgcctccttagacagctaactctcaggggatgaactcattggttaaatgcagtgacattgttagattatttgttgtgatttctctaatacaccttaagttttctgtaaaacagcctaacaagcagggtggggtgtgctaggcccatgtgatcttcctggcttacattttgcttctgtataaccttaacccaaactgggtcttcctggccatgctttagaagaccagctgagtctgaaaacaagaaggatttttcctaatcttcatcagccatctcgatgtattcaaaggacaggccaagtactagaactgaacctgtgtaaccttctatgaactttaccagagagaatccctccctctttatggtccaaggaaccagaagctttgcctgcagtcatgtctgtgacgtgtcctttcctctgtgaacatgggcctgcaaagccacgttccccaaagggagctgatggggcatcaatgtcccctcgaagccatgagtctctctcctataaaccccttagtatgcctcagaacctggactctctggagtgtatggggaaagaatgggggactcattacaagtccattcataaaatgaatctccaggaccagctcctctgtaaccagggatgaattaggggaggggaaaggacatgtgtagtagaaaagtcactgtagccaggatctgctccctgggaccttctcattgactggacgtggcctctgttgggagagtgacaatgatttgtatgtggggacttggtgatatgtattagggtgggaaaatgaagcctgagccagaacagaaagtgaaggagtggcttatcagagctcggtttcgggtagccacgtttacatttattgcttaaccaggatgccaagatgacaccaccatgttcatcatgcaaacagcacacaccaatgtgaacagtttgccgagccttggatttccatgactgcagcttttgcaccaagataaggatgacagggagcacagtggaatgacaaggaggcttcccaatgcaataagccctagttctccatggcacacatgcagatgatgtgacatctcctggtcatcacaccagcagggaagcacagagatgcactgtgagagttttgttccatttgggaatgcatatgagggaatttctgacaagacctcttccccctaattctctttagcaagaagatatcatacatgagaaagaaaaaatctgaatttcaaatgagaagactttcagttatgacacaaactagctgtgtgcctacacacacatgctcacacacacacacataaatggtctcagcaatttcttattaattgaacacacacacatacacacactcatagttacagaatgtctaagaggcataccatgtagtgaattgctggggaaagtagccttagacttgcaatgtattaccacagtccatagggtggtcagagaggaacaaaggaggatagtgggaaaaatacatggactagtccatctcagtctaaatacatgaccctgtgcaagtcactccacatttctgagccttaaaatagcaacagtaatgcctatgttgccttcatgattttacaaccagataaataagttaataagttaatgaaggaatgattattaatatcatgacagattagtagtatctaccactttctcttaatgtccccaaaaataatccaagatcaagattgtgaagtgggggaaataaaagaatatctcattgccaaagcccattgataaggggaatagattgagaaaagtatgtttggaccgtgtcttacaggtttcaccctctaacttggaaaggatatgctgcacaggaggctgagagttaggaatacaactcactaaacagtggggtggccatagctcactatgcaaaagccaccttcatagctggccagagcaggtccttgcccctcaccctggacaatctgcttcttgctttatctacacattcaaagatggcaacatttgcttttattatccaccatggtaggaagtagaagggatgggcagagctgtttggtgtctttgaatgcgtggtcatctctacaaaggggacagaggtaagcagctcagagctctgctgcttcaggaggaccggggcaaagaacacgctggcatctgactcatctgccatcttcagagtctgagaaaggaggacagagccttctgcccaattttatagagattgcatgtgtgcctcaaacctcattccaagtctaagctgagggaggcagtcaccatcagagaggtagggtgatgggccccatgggtcctatcttgtggcagacatgagaccaaggcagcctctgctaaggaatgaataaataaaatgagaaggggcctaggaagagacactactgcaagaagcaaacagaatcttggtctgacaaaaagcatgtctttttttcagaaagtatatttttttcccagaaagtataattttctttggaaaatagaactatttaaaagacatctattcatcatccatgaaatggtacaggagcacatgacttctgttattaactaagaggaaaaagccgcaaacagaaaacaagctgagaggaaacagacataagtagtctgaaaatagctgttttaagattgcagggaaaagcaaaaggtaataatagcatagggataaaacagagcagcactgatgctatgtgaaatctcatcactgatatggcgtatgaacacggaaacagcctctaaagcagaaggaaggaaccagatttcaatcagtggaggagacagtaaaaaaaaagaaatgcaaaaactgaaaaaagaaaaaacttatcttctctatgcctgtcctaaccatccaagttaataccacgaccttccctgacccctaggccatgtgctcccccatgtcacttacacatttattaggtttattgcttattgtctgtttcttgtggcaggattttaagctttttaagaacagaaatctttgttttgctcattgataaaacatcaagggccaagaatcgtgcctagtatatagttggcattcaataaatctctgttgcaccaatgacttatagagttacctgagggaagaaaccagaatactaggtatagcaggaataattaagtattaatgttaattatattaaataaatattaattaaatattaaaattaaaatgttgctgatttaaaacaaattattaaggtgagcagattaattgggctcactaaattacagtaaaggtaattaaaatacattatatatctacacatgttctggaatgtctttaaatagaaattctttaaaaatcttatcaatatgcagccatgataatataaaagttacctacaaaagattaaaaatcagacaagcttcaaatttcccatcctaaaaatgaaactagagaaatccacagacacaaaaacaacctcatgcaaaatcagagtttaccctactcttttacccatcctgattgttacagtttgatagtttggatatgatttgtttgaccccttcaaatctcacactggaatttaatccccactgtggcagtgttggaggtggggcctagtggaaggtgtttgggtcacagggacagatccctcaggaagaactggtgccatccttgcagcaatgagtgagttctcaccttattagttccctctagagctggttgttaaaaacagcctggcacccaccctctacccccactctgtctggcttcatctcttaccatgaaatctctgcacatgctccccttcaccctccaccgtgagtggaaggaagcagcctggggctttcaccagacacccagtcttccaatcagcaggatcatgagccaaataaaccttttttctttagaaatttcctggtttcaggtattcctgtgtagcaacacaaacacactaagacactgatgaaacaccaaaagccattctccagatggatcactaatgaatcaaagcacgacattaatagtgagaaaatgatagtataaaaaggactagtggtgagtatttaaatcaatcaaatacctaagtataaataaaagtaattgttgttaaaatgctttaaaacatattggaaaagtctaaataaaatatgggaaaagttgtataatacaaatggaatagttgtataataacagtctggatcaacatcaccagactggaataaaaaaaaaaaagtaaggaagtgagaatagggaagatgagcaggggaaggaaagttatgctagttgggctcaaggggagtaaaacgggatcatttaaaaaacaaaggttaaatatggtaatctgacaagcttaaaaggcaactgtttgtaccatttaaaatagaatttttctcttccaaaatccttcaaaagataaaatcaaacaaaatagagtttgtatgacaaagcacacaaaaaattgcaaagaagatggaaataataaaagtaagataacaagtaagtaagtaaagtaaaaaagtaaagccaagcataacagttatggcaataggtggaaacatgataaacttagataccaaaaggaaaacactctcagctttggtaacaaacagatccagtttacaaaaagacatacctaagaggtgatttagaaagtttagaaataaaagaataaatattaatatagtgtgaagacaataacagaaaaaccagtggtgatgtattaatataatacaaaggggagtttcaatcataatccttaaatgggccaggcgcggtggctcacgcctgtaatcccagctctttgggaggccaaggcgggtggatcacgaggtcagcagatcgagaccaccctagctaacatggtgaaaccccgtctctactaaaaatacaaaaaattagctgggcatggtggcgggtgcctgtagtcccagctactcgggaggctgaggcaggagaatggcgtgaacctgggaggcagagcttgcagtgagccgagatggcgccactgcactccagcctgagcgacagagcgagactctgtctcaaaaaataaataaataaataaataaaaatccttaaatggggatcaaagaaatattttatattaatcaatggcaaaataaagatataataatcatgtaccttatgagccaaataataacattatattaaataaagaaaaatcaaggagaaatgaaaggagatgaaagacatacagtcgtagtaggaaaatgtgttttatatccatcagtttgacagattaaatagacaaaataatttgagatttaaataatataactttatgtgaatgaaacatattaattcttttattagaaatagagtttacatgaatggataaacaaaatgtggtatatacctgcaatgaaatgtttgtccttacaaagaaatgaaattctgacacatgctacaacatgaatgaaccttgaagacattgtgctaagtgaaataagcaagacacagaaggacaagaattatgattccactcatatgaggaacctagaatagatttatagagatagaaagtagatcagaggttcccaggggcttcaaggagtagaaaatgaggagttattgttttgtggatacagtgtttcaatttgggaaggtgaaaaagtgctggggaaggagagtggtgatggttgcacaaccgtgagaatttattatacttaatgccactgaactgtacacttaaaaattgttattgttttacgtatattttgccacaacaacaaaaaaggaaaagggccccaaaaatgaagctgacaacttttcatgattatttttgtaagtggtgatagtctacaatgcaaagaaaacaaaaaagcagaatatagccaggtcacatcctgtggccatatagcaataaaactgaattgtaagtaaatttaagcacaattgtaagaacaaaatctttgccagctggaaagtaaaagcaatgttctagatgactcttgggcttaaaataaaataaagacttagaaaccattgagaaattgttgaaaatacatgtgaacaatacttaataaaatatagaaaggatatactcaaagacttagtagcattagggaatttcagttgattaagaagtgttttttaaaaattacttgataaaaattaaatatttatttatttatttatttagtgagactgggtctcgctctgtgtcctaggctgaaatgcagtggcatgatcacagctcactgcagcctcgacttcctgtgctccagcaatcttcccacctcagtctcctgagtagctgggaccacagatgcaaaaccactacgcctagcttttttggtatatttttgtatttttttggtagagacaggttttcgccatgttgcccaggctagtctcaaactcccaagctcaagagatccacctactttggcctcccaaagtgctgggattacaggtgtgatgaatacacatttatattttaaaaacaaatactcttggtaaactaagaatgtaaatatgttttcgtgacctaataaagcctcctttaaaacagtggacatcttattgtacaatcgggtctagtagttttcccttaaaaatcaagaataagaaaagatttcaaccaccacttcttatttaacgttgttctagaagtactcaccaatattacaaaaaaaggaggtaaaaatagaagagccctcctaaagaaggagacaaaattaacatgatttgcaattaaaaatccaagaggatatacttaagagtcatttatttgatggaagcatttaatatgatgagcagacaaaaagtaaatacacaaataataactttcctgagtaccagcaatgaagggttataaaacattataggaaaagatacactcagaagagcaacagataatattaaatacctataaattatcttaaccagaaatatgtgtctttcagtaaaacaactacaaaactgtactaagaaaaaaattctttaatagacatgttcagaaatgggaaatggttacaccaactatcatgaggaaagaattctctccgaaatcatttgcagtctcaaagtgattctaaacaaaatcccaatagaactatttttggaacttaataaaattaatattagttcctctggaaaaatgaaaacagacaagaatatgtaagaaaatattggaaaagaaagaggaaacttgccctacagatgttaataattggaatagtgcggtaccagtgaaaagcctcaggccactggagcaaataaaatatcctgaaacacagtagtatttataagaaatgtatttataataaaacaataggaaatgaatgatttggaaaagtgagctctctgagaaaactgtcaaactacaacttaatattataccaaaataagtttcagaaaggtaaagatttagtgttaacgattaactcacctaaactaaagctagaaaaatatagttaaacacttaactgacccctggagaggaatgattgagagatttgaatacataggaatattaaaaattcagtgtattagaaaataaagcaaacaaatatcaaaagcaaatttgaaagcagatgtataacttagcacttggataataaataagaaaactttaacatcccgacaacaatagcaaaaaagggaacagacatcgcaggcaacacactaaggaaggaatgactaattagcccatgagaaaatgtttttcttttgtagattccctgggaaattgtaattcatcattatttaccatttaacatttctaagagttctttcaaaattagtatttgtgagagcattataaagaggaagattcatgaactaatggtaacatgatagatctggacaactgttgtgaagatagtttattagtatggatcaataatcataaatatttttctaactttaaccaagtaattaattcaacttttagaaatgcatactaaacaattgccacagatacacaaatataaggaacctatttaatttaatttctaaacatctcagcatgtatttgaataatgaaaagtctatttttaatatttgttaggttagcttacacttgtgtgtttaaaaagcatgttgatgcattttgttttttcccattcccatttaagtctcattccatttccttgtatttttgacgtcactagtgtcattttttgagtcctctaccaatttttcaagggtatatcatcttcagttccaattgaacatacagccctttttgaatctgtgtggcatgctatcttggggaattttactgcaagtcacaaatattgattcacatgatattagtagtgttgttatttacctttttcctggggggtgtatttttatctcaattatgaaaccacttcctgtatgagtttttataaagctctttaaactgcttgtttacagtgacatcaaatacttgaaattataagctcataccttccaagaataatttctaaatctgtataaaatttcttttaactacttttgtcaggtaaacctaaaaatatctaaaactagcattgattgaggtcatttaaagctgatatgacttcaccaaatgttactgttggttgaaaagagagtaattaaaaagttgtcttatggtacaaagggttttgttgaaaaaaaaggtaataactttctcttttatgagagataattttaaatttaaagaacaatgttgccatatattggaatatatatggtactcagacatggcacaaggatttatattcgagagtgttcggccaggcttggtggctcacgcctgtaaccccagcactttgggagggcgaggtgggcagatcacctgaggtcaggagctcgagatcagcctgaccaacatggagaaaccccatctgtactaaaaatacaaaattagctgggtgtgggggtgtgcacctgtaatcccagctactcaggaggctgaggcaggagaatcacttgaacccaggaggcagaggttgcagtgagctgagatcgcgccactgcactccagcctgggtgacaggcaatgagagtgaaactccgtctcaaaaaaaaagtgttcattgaagcattattttaaaacagtaaaaaagtcaaatgtctaacaattaagggtactaaaattaattgttatacttccatcaaacaatatcatgtagtcattaaaattctccattaaaagaatatttaataatttagggaaatacttataaaataacaagtgaaaaacctcataaaattatagatcttgatgtgaagaaaatatgtatatatttgaatgtatagaaaagaaaaaactaaggaggaaaaaatcaaaattttttttgatttggggtgatttttattatcttctttctacttttttatctttttaaagttttttctcagtgaaaatatacacattctataataaaaaagagcatttatcttaaatataaataaaatactctacaaattattaattactagtattatcttaacccagtaaaggctctattgctcttactttctgtgttgaataaagtattatagtcactacttagaaactccatgttttatctatgactgatactgcttcattcagctactgagcaaacaggcacagtgtcctgttccccatttagatcagtggtctccaacctttctgacaccagggaccagttttatggaaggcaatttttccacggatgggagggtaggggatagttttaggaagacaagcacattacatttattatgcactttatttgtattattattacattgtattatataatgaaataatcctatagctcactgtgatgtataatcagtgggagccctgagctggttttctgtgattagatgctgccatctgggggtaacgagagacggtgacagatcatcaggcattagattctcataaggagtgtgcaacccagatcccacacatgcacggttcacaatggggtttgtgctcctatgagaatctaatggcaccactgatctgacaggaggtggagctcaagtggtaatgctcactcgcccgtggctcacctcctgctgtgcagccaagtttttaacctgaactagatagatgagttttgagtagattaaaaaaggaagtaggggtaggggaggctgggcagaaataaacctgaggcctgggccctgtagcactcctgtatattactgactccattttggcctattctcacaccacacggtgctttttttcactggtctgttcgcagtcttttttcgtggaccacaacagtcgagctaccactttcattgacccccgaatccctcttcagaacggtcgtcttcccaatcatctaactcaccgacagcacctccagaggctccgaagttacagcgctggagaggtaaccctccctacaccccgccctactgttcaccggtcacagtctctgcctcttccatgggagcagaacagttcttcagtggctaggatctagggttgcctgcgctggaagagattaagccatatgcaccctgctttgtagaagaatgatgaccgggacacccacttaacaccccagagctgtcttcagttaccttttctgccttgccttttgtcccacacaatcaccactactaaaaacctgtctagttgaaaggaaactgaaaatgcactgtcaggagatccctacacttatggctggagctgtgcctcctgaggcctgtcatgtgtgaatacatggaactgccatggtatgtctgactaactttaaacttctacctctccaaaacatcctagaaaatacttcaataatgtatccatggactagaaactagggggaattaaccaggccacaggaagtggtgctctattcccactctattcgcgctctacaatgtgctctttccttggcagcactttgtggctaccatgaaaggctaaggatcacttcattgcctttctgaattagtatctatatcccatactcttcctgcccttctttctcgagccaaaactcaaaacatagctctttttttgctcctgatcagttcctgacaatatcatgagcaaatttctttttatgtcctaattgacatttcccaagtatctgtgccttctttttgtggaaaccaccaggacctcaagagatgtggcttctgagaactacttcccataaaacagcttttagaattggattatcataaggttaaaaaatcaaaaatatggagtaggaaggaaaggaatatatgtgtatgtaggtgagtgagtttgtgtgtgtgtgcgtgtgtgtgtgtgtacatatgtgtgtgtgtgtgtatatatatacacacacatatatacgcatatatatatatacacacacacacacatatatacgcatatatatatatatatacacacacacacatatgccacagtgagtcattccagggagagccagggagtttctctccagagaaactgggaagataacaattcaccctgcagccacctcctccagatagcaaacataagtctcaagggaagagcctattgttgatgtatcggcaccagttatttaccactttttcagaaggagtcctgtgtatactctgagaaacataactatttccaaccagtggcactcatggcttaatgccagtgtgataaaatgaatgttttttcatggagtcgtcttaagtatcattgtttcaggagactgctgaaagcatgctaaatctttctttcttcatatatataaggtgtatgtgactaggcagagagggagtactacacatccctgagcattacatgggtgtcaggatttgctagatgcagacgtgttcacagactacagaaagcaatgccccagcttcccagttcaacatgcgtagtctccctccctggtggcattcctgtaacacttcacaaagtacaaggtgggttgtcttgagattatagggaataaattcaaaattcttcatgaagttgaatatgcctttaaaaagttcaagctctttaatctcattaagacaatttcagtatccacatagggtaactacatgtgataaagtagctgagtactgcagacagattcactgtcaataaaacaaaaacttcagttgtgcaagattaagtccctaaaatacagatctcttacaattacaagaaattagtctgaaatgtaaatatttaaaacctttctaactgaaagaacaagactgaaaccatggacaccacttgcattacctgttttaaaacatgtgtttcatgtgattgaatagcccaaatagagttaatttaatatcatttaaatcattaatatcatttgccataacatgtatggcaaagtgccatctgtatcagttaagaactagctggggccaggtgtgatggctcacacctgtaatcccagcactttaggaggtcgaggcaggcagatcacgaggtcaggagatcaagaccatcctggctaacatggtgaaaccccatctctactaaaataatacaaaaaattagtcaggcatggtggcgggtgcctgtagtcccagctactcgggaggctgaggcgtgaacccgggaggcagagcttgcagtgagccgagatggcaccactgcactccagcctgagcgacacagcgagactccatctcaaaaaaaaaaaaaaaaaaagaactagctggaagactctaacacatatgatgaaagggcgttgctgtgtaccagccatctgtctgcttcctaatgcatccaccctgactgttcgtcacatttccaaacctcacccatccctatgcccatcctctctcttctggtagcttttggctgacagaagaggacaccaagaaaagcaacggagagagaagccaagaggcagagagtatctgatccagaggcagtgcaccagagaaaacaaagactcggcctctaagaaaataaatatgtggttcctcccactgcaagagccctcagcctagggataaggagacagagggactctggtatcaaaatagaggggagtgggtggtaggaaatgttgactgcatttgctgtgatgtgattttgctcagcaaaaattgattccatgcatggcttgctatgagcactgtggaatgcaaaatatgagacaatccctgccttagagaagtttgtattccacttttgaagccaggccaaaaatacatacagagttaagtaacgagagaaatcagaatatggttgagtggcaagagagatgttaggataagtgccacaaaagttcaaaagaagccaaggaaaagtatcttttaaaataaggtgcctggccaggcacagtgactcatgcctgtaatgaaaacactttgggaagctgagatgggagcatcacttgagcctaggagtttgcaaccagtctgggcagcatggcaggaccttttctctacaaaaatttaaaaattagtcagatgtggtggcgtgcacctgtgctcccagcttctcgggaggctgaagtgggaggatggcttgagcctgggaggtagaggctgaagctaaatgtgttcacaccactgcactccagcctaggcaacagtgcaagactctgtctcaacaaaacaaaacaaataataaaataaaataaagtacctgactagaacttgaaaactggtagaataggtacaaaggatggggaagggaagccttacagagcacagcctaagcaaaggtgcagaggtcggattgagaaaggctcacagagagacagtgactagttcggtctgagccaagcaacaggttcccgcttgctgtgccttggttttcagaaaactttagtgctgcatggaagagttggaacttttttaagggaccactgaatgaatttgaggaaagtaattgattcatccattgtttcagggtgaagtcatctctaaaacacatttgagagatggggaaagactcttggcatttggggcaggacaattctctgatgtgtggaatcatcccattaccttgcaggactttttttcctgaccccatccattaaatgtcaggagtgcccccagttccccaagtcattatgacaaaacaaaacagaacagccccccagcatttccacacacccatagatggtagcattaccccagtgaagaaccattattttacagtccagtaaactgaaataccaagagctcacttcacatagggagttcaggaccacagctcaggtttcctaacagtcatccatgcaaactctttttttttttttttttttgagctagagtctcgctctgtcacccaggctggagtgcagtggtgcgatctcggctcactgcaacctctgcctcctgggttcaagcgattctcctgcctcagcctcccaagtagttgggattacaggcgtgcaccaccacacctgtttaatttttgtattttcagtagagacggggtttcaccatgctggccagactggtctcgaactcttgacctcaagtgatctgcctgcctcggcctcccaaagtgctgggattacagacgtgagccaccacgcccagccacaaacttatatttttaaaagaagacaatgaaagccaagaagaggaagggctgtggcaaagagctattcgagagaggcctgctagagaccactgccacaatcagatggaaggggatgaggccgagttgaggtgacaaagagaaaacaaagggcagcccatagggagaaggctcaaggaagtcaggggttgtggaggaaaaagtcactgggacttcagtctgcagacaggcgttccagctccggcatgtccacagaggagctgagtatcaatcattgttcattcctcccctgccagggaccccagcttcctctgcaaatgggtgaccactaacgtgtgttccagctgtgtgattctcagagtctgtggggcttgattccacgtcttcaggaccgcataactaagagacccattaactacatagagctaagaggagcaggaaaggcaggacggaaggatggcaggtttgtctttaggcaagttgataatgtgtgtgaaaatagcagggtatctgattagatatgacagttaaacagatggaaatatgagactcagcaatcatcgatgggttatttccataatccattatttttctgtgtcccgtatcacaggcaatagggaattaactatagatatttcttagactacaacttacaagtgtgggtattttctgttcacctacataagccattctcttgagtgttattcagcagttgatttttttataaattgcatgtaaggacagaattaaaatgggtttctatattaaggatcctaaatggtaaaatgtttttcttcaaaccccaatggcagattattaatagaaacattgttaaaaatattttggattgtcctttacctcacctggaaaattttcagacagattcctgaaagcagttattacgaatataggatttatacataaaaagatcgttatttgacactttcacttgcattttaaggcggaggcacatctgtctgcaatatattcaagcaccagcaaagcaggccttatctctcctcagaatgtgtgaccagaataggtcacagataagtggagtgctatgaatactggatcccatcttagcaaggaaatcacgaaagggtaacacatttgccttgtttacactgcaattcctaatataagttgacatcaataaggaaggataagcagagcacataattttcatttcttttgccatcttatcttggtcaggttagaaaatcgttagtcatagaaaatttctggaaggtacacaccgaaaaaaaagcttgacagtgactgcctcaggaaagggcaagagtctgacagggaagagaagcttgcttctcactttagaagcagaagtcactcttagtcattctttgcagtgagcttctttgatggcagaagtcatttcatgggctctggtgacatgaaggaatcttcattcaggaagcttgcttttggggagagtaattgctgcattgcttcttaaaattggtcattttcctcttggctcaatgtaacctgcacttgatcacaggtttggctggaagtttgtaaaattcagacacctttgaaaataaactgtttaattacagtcatacatcacttaacagcagggatacattctgaaaatgttgttgttaggcaatcttgtcactgtggacatcctagagtgcgcttacacaaacctagatggtatagcctaccacacacctaggctgtacggtatggctatggctcccaggctgcaaacctgtacagcatattaactgtacagaatcctgtaggcagttgtaacacaatggtatttgtgcctctaaacatatctaaacatagaaaaggtaaagtaaaaatacaatataaaagatttaaaaaatagtacacctgtataggatacttacagtgaatggagcttgaaggacggaagtggctctgggtgagtcagtgagtgagtgactgtgaggcctaggacattactgtacactaatgtagaatataaacactgcacacttaggctacactaaattttttttattattatactttaagttctggggtacatgtttacaatgcgcaggtttgttacatttgtatacatgtgccatgtgggtttgctgcacccattaactcatcatttacattaggtatttctcctaatgctcttcctcccccagcccccaaccccactacaggcccctgtgtgtcatgttcccctccctgtgtccatgtgttctcattgttcaactcccacttatgagtgagaacatgaggtgtttgattttctcttcttgtgttactttgctgagaatgatggtttccagtttcatccatttcatccatgtccctgccaaggacacgaactcatcctttattatggctgcatagtattccatggtgtatatgtgccacattttctttatccagtctatcattgatgggcatttgggttggttcgatttttttttttttgagatggagtctcaccctgtctcccaggctggagtgcaatggcacggagtgcaatggcacgatcttggctcgctgcaaactcctcctcctgggttcaagtgattcttctgcctcagcctcctgagtagctgaggctacaggcacgcacccctacacccggctaattttttgtatctttagtagagacggggtttcaccgtgttggccaggctggtctcaaactcctgacctcatgatccacctgcctcggcctcccaaagtgctgggattacaggcgtgagccaccgtgcctggcctaattttatttttttaaagcaattacacctgacattgtgacagctatgacatgaccagtgataggactttttcagctctattataagcttatgggaacaccattgcctatgcatccattgttgactgaaacatcgctatgtggcacatcactgtatgaacaatatgtaatgaatgcagaatacagacacagatggaaaagcataattccccatctggagacacaggtacacataaaaataaagacattagattgtgttgtctatggttctatatcctagtgcctcgtagacagtttccacaccattaacatttttctatatttaatcacatggatctaccatcatttaacacaagcctttcttgaacatgatgtttattgcccgcttcttattataaaaatattgaacaactcaaatatctctcttttgtttccttaagataattctgacaactttgttaatgatctattttcagaacacagaaggaatctagagaggaatgtaaattcgtcctttgagcccttcctgtgaacttgctacatttttttttatcaagtctccagtgtttgcagagagagggttagctgattattaacccaaattcagtctaaaacatgcaattttcaatcacagctttaaggaaacccacaagtgtacattcccaaattgcaacattgaagagcagcttgtttaccagttgctgaaaactattttctgaggatatctattttgttttgtctggagagctaaatgtttgaagttttcacatttacaattatgatgaaagcgatcgatatcaaaagaaaaagaaatcctaaaagtagtccctactacaaactgggttttacccaattatggaagagttgttgcagcatgtctggggaaaggcaggccaccaagggctctctctcccctcgctcaccccttaccacatgtgcccacacacgcacgtacacccctgagaaacttaataagaccaaaggggtcaaatgccaggaaattagagtcatgtcattttggttttaaatggaaaatcagtcctgtagtcattttctgaccttaggaaaacaaagcaggccgcggatggtggctcacacctgtaatcccagcactttgggaggcagggcaggaggatctcttgaagccaggagttcaagaccagcctaggcaacatagcaagaacccatctctacaaaaacatttttaaaattagctgggcacagtgatgtgtgcctatagtccctgctattcaggaggctgaggcaggaagattgcttgggcccaggagtttgagcttgtagtgagctataattgcaccactacactccagcctggataacagagactgtctcaaaaaaaaaggaagagagagagagagagagaaagaaaaaagaaagaaagaaagccagccagccagccagccaggcagacagtcacagtggctaaagcctgtaatcccagcactttgggagaccgaggcaggcagatcacctgaagtcaggagttcaaaaccagcctggccaacatggcaaaaccccatctctactaaaaatagaaaaattaaccaggcatggtggtgcatgcctgtaatcccaactactcgggaggctaaggcatgagaatctcttgaacccgggaggcagaggttgcagtgagccaagatcgcgccactgcactccagcctaggcaacagggtgagactccatctcaaaaaagaaagaaagaggaaggaaggaaggaaggaaggaaggaaggaaggaaggaaggaaggaaggaaggaaggaaggaaggaaggaaggaaatgaaagaaagagagagagagaaagaaagaaagagaaagaaagaaagaaagaaagaaagaaagaaagaaagaaagaaagaaagaaagagaaagaaagaaagaaaagaaaagaaagaaaaagaaagaaagccatgttggcatcatgtttgcagtgagattcaaatcagtcactcagttgctgtcagacgtccctcgggatggattgtttagtaccagtacagggcttcaaggatcctagcacatactaaatcctagttcaaacagaccctcggaatttcctccagccctgcctgaaactgtcttcatcgctgtccattcctgggccccttgttggagaagggcgtttccatccaatcctcctgttctccaggctctggtctttgagccatccagtaccaaccaaccgtttgcagacatttctgtggctcagggacgcagcaagccgtatctccccctgtgttatttcctctatcacactcatattaggcatgaagaatgtttgtcagtcagtcatctgcctttgggctaactggacttcagctggtttctgaagtttttcaatctggctcagctttacccgtgagtgggtgacctcagaagtaggcaccattaatgaatttcctgtgaaggccaggaatagaagtgagcctctttctgtttcaaagccttattcatttctgggtgatgccctgacagttagacactttcactcagggcgaaacaacaaatgtttcctgagtccagtgcacagccaagccttcccgagctcagccagcagatctggctgtttccccagtttccctctgtaatttatcacttagataaccttcagctggtgggtctctgagaatcctgtctttacaagatcaataatattttaaatacacgttaaggcaaactggcatgattccctccaagaaaaagagacttataatttcaatcccagaaagcctttacatatttatttatttatttattcatggagaaaaaagagaagtatgaggattcaatactgcatagtttattgatcagcaaacttttctttcatcttttgctttgtaaacatttgagactggaatgtgctgctgcagaaataccagcttctaaaccctggtgtctggctttgccagctgagcagagctgagatctaatgacatcaaagtgagaagtccaccaaagtggcacaaaatctactcccttgtccttcaagtaggccatgggcaataagaaggaccaggagagaaaacagatgcatctgcatctctacccaacttccagaaaagcagcaaagactaccacacacagagagtgaactggtggcccctgtctgcatacaaaggatgttatccttgggtgtggaatatggaagtgggaaccaaaggaaaatcagcaatgcctgtgtttgtcattagggatcgttaagtaatttgccctacattacgatctgcaatatcacacatggcctattcttaagtggccgtttggaactgacttgtctagactttgtagcactggtcctcatcaccttcctgaattctgtgtgagtgagttttatgctggtctcagagggagaaatgtctttccttttttttaaatctggatgtttgaactctttctaagtgtcttacaaaattatcatctgttacattaaattaaacttggcttgaggatgccttcatacttttgagtcattacgtaatggattgccacctcacttgggacatgaattaactgaaagcctaatttgggagtatactttggcaacaaagggttgagtctcagccaatcacaacagccaagcttcagtcagttgcaggtggctaactgatcagaccatgttcaaataaggcaaacactgagctgcttccgtaccatgctcccattccccaaccgtaaatgctgcctgcccatggttgcagaatggagctctctcctccctttctggttctggttctgagtgaggaccaccccattctcacaccattctttgatcaattaaactctgtaagtttactttgtctaaagtctttaacacttcaaaattcttaactattttaaagcctattttagcatactttgacaaatatcataggatgagttacactctacattaaatcccatatatctggtgaatgtactgcaatgtggaaaatctataatgcctctatagattttaacatcttactctgcaagggtcttaaaaaacaaaatgtatgtagaatcacagtgagaatgtccattatcatgctctagaactgcatagtttattgatcagcaaagttttctttcaccttttacaaaggtgattttttttaatttacaaaatttaaaattgagctaagttagtttttttgttttgttttgttttgtttttgagatagagtcttgctgtgtcgcccaggctggagtgcaatggtgcaatctcggttcactgcaacctatgcctcctgggttcaagggattctcgtgcctcagccttccgagtagctaggattacaggcatgcgccaccatgcctggcttatttttagatttttagtggaaatggggtttcaccctggtggccaatctcaaactcctatcctcaagtgatccacctgcctcagcctcccaaagtgctgggattacaggtgtgagccaccgcactggcaaaattgagctaatttagtttaaagttaatcatcacaagtatcaactttaggctaagcaagttatttatctctgaagttttgtcaaaatgcctaagctgaaccaagatattggaagcaggcaggcagtgtggaaggagtaaacaagtgctttgcagtcaagtattagaatcctggttatccccctgtcttacggttgtaaacctggggaaactttacttttcctggatcctcagattccctatttgtaaattttggttaataatgcttatcttgcagaatttgttaggatatataagatgctatgtgaacagaagccagcacagtgaatgcaataacaggcattcaagaaagaatgaatgtaatcaatactatttaaacaagaagtccattatacatttggtactaaagttcaatgctaccttggaaagttataggcgtaccttaccaatgatatttatctaggatttatctctctttaacaaatttatgatgagaaatgtttcttgggctattcagtgtattaatttgattaatattcatgactttgacatgatcacttctttttttttgaaacagagccttcctctgttgcccaggccagagtgatttcggctcacagcaacccctacctcccaggttcaagtgattcttctgcctcagcttcccaagtaggtgggatgacaggcatctgccaccacatctggctaagttttgtatttttagtagagatggggtttcactatgttggccaggctggtctcaaactcctgaccttgttatcaaggtctcagcctccccaagtgctaggattacaggcgtgagccagatggctttcttaaccatagtatagcacatcatcaactctacttagacacttttgtaagctttcttttccatcacttttttactttttcaacttaggtgacttcaaaatcttttaccccttaggttgaaaaactggtatcaagagacatctgaaattgatacaaatttctaatgcttatgcttttattctaaaattaggcctcagaagtttctagaaacagaggagcctctttactggccaggccaggacacagcttagtagctgctattcgaagccaacatcaacatgagtcattgccactgggtatgtatcatgcttgtttgagcccctggctcaaagaatagcaacacctagacttgattttttgtttgtttttctggtttttgtcatgaaccctttactattcaacattctgtctttcctttctcctcttttaggatatagtgcacaccccgacccctgctaccatccacccctctgtccttttcccctctcccttcctcctcacctatctgttcccctccctgtcttttctgttctttcccaaactctcaggtcctttcttccttattctattcagtgatttgttaatcccgtgcacaagagcaaggtttaaatgaggtgaattttactgtttttagacagtttttaatgtatacctctctttccatgtatgtatggcataaagtttgcagtgtccattcctaacttcagccacctctttccaaaacatatgccacttgtatcgaggaaaatgaaatgagagcatctaaatggtatttccattatcactactgggaaatcgacacatggattactttgcactcataaagaatcttttccataactacagcaaaatgaccaagaaaagttagaaggaagagaggagaactcctcttatgggagagctattttgttctcctttacctgttcatgcagagatgcattaatacccagtaaagatcctgaaacgttaaggacgattaacagagatctggttcacttttagtttgatcccttaaaaaattataatgttattatgtcatattttaaaaactctcaagagcttgcatttttttgatgagtatgctgcctgcccttcaaactccttcattaatcctggtatcaagcagccattttccaatcatcagagtgattatctctgggctgcagactcaaccacaactgtgcttttgtctgtttcagcatataatgacaagattgtggcatttcttcgccagccaaacatttttgaaatgctgcaagagcgtcagccaagcttagcaagaaaccacacactcaggtaagcctcgcccctcactccctggaactctaggtctttccagccatttttcccggtgggaaaacacctctgtggagacagagcggaagcttattatacattgtatttgtgcatttaaatgagaacttgaatcctcaagatgaagggttcggggttcctgtattctgggaaatggcataatcagagatggtcatattatcagattacatatcatttatatggtactgaaatgatttccattgatgtaggggggggaaggacagaaaggaaacaaaatagcttccattaaaaaattatttatgtacagcactgtataaattacttttagttttgaaatataattgttgaacggtaaaccaaatattgagcagccgtgttcgaaaataaaaaagcaaacaaaaagtttcttgtgtgttctaactacttacatcttatgcttcattagggtcatttttgaacaagtgccctgaaactctgaatcacatgtggaagggatagcgatctgaaatgataaaaagagaaaatattccctgaacttaaatcctgctttctcaccaaaatattcaaacatctttttccttcggtttactctccaacgttccaaaatctggagaggcatgggggttaagagtacatctctttgacgtttgaattttcactccaacaggtagggactattgatggaggcgtgttattcaactctctgcccttagtctcccaaatgggggtcacaaagtgggcatggttgcaatacttacttgaggatgtgtaaaggttaaggcagggcaggctagaatcccatcaacggctgcatttcattattccctgcccatgtggtgcagtcttgtgaatggggctgatacctgcaataccatactccgacttcctcggggaatcactgacagcttcaagtagtctctgcttttcaacccttgccactcccgccagaatggatcattcactattctttcccctccaacaccccctcattgacacctcttttccctgtattttcactctgtaaattagagccactaccctcccagctgtccctgatctcctctcctccctcttcttccacctccacacctaaacattcacctcctcatactctctcctccatcctcattttctcttctccctgccatggttcaagtttaggtgctcatcatctctcttctggaccatacaggggtttctcctaaaatattccctatcaccctatcataaccagagttacctacgtaaagcatagattaaatcatgacctccctacccttcaaaaaagctttcatggtttccatcacatatgaaataaagtcaagatttttttttttttttgagacagagtcttgctctgttgcctgggctgaagtgagatggtacaatctcagctcactgcaacatctgcctcccaggttcaagcaattcctgagcctcaacctgacaagtaactgggactacaggcatgtgccaccacacccagcaaaattttgctaatttttgtgcatttattagaggtggagtttcaccatgttggtcaggctggtctcaaactcctgacctcaagggatccacccatctcagcctcccaaagtactgggcttacaggtgttagccacctcacccagcctaaagtcaagatttctaagcataatgtccatggtctcaaagtctggccctaacctaactctccatcctgcactaagcttttccttccagggtattccacctccaccacacaggctgcgtactctcctgcctttgtctttccgggaatgacttccctattaaggacatctcatcccgttttaaaggctcagatcaaaagcaaaacttcagtgatctaggcaagctttagtatttctttttctttgagggggtgggaacttcctgatgttaccatggcatttgtttttttgtttgtttgtttttaattttttttattatacttctaagttctgggataaatgtgcagaaagtgcaggattgttacacaggtatacatgcaccatggtggtttgctgcacccatcaacccgtcatctacattaggtatttctcctaatgctatccctcccctagcccccattccccaacaggccccggtgtgtgatgttccgctccctgtgtccatgtgttctcgttgttcagttcccacttatgagtgagaacatgtagtgtttggttttctgttcttatgttagtttgctgagaatgatggtttcctagtatttcttttgtcttgctttgatagtatgctttttgtgcctcgaagatatttttagatctcttgtattctgtcatttacttgtgtctccctacagcactctaagctctttagagcaaggcctttctcttccttgtctttgtgcccactctgccccttacaacctggtcctctactttgaaaataggaaacaccaattacttttagagtgaatgaaagatctttagcatgaacaagtgatctttagcgtgatgaatggccactttcatttatgttcaactcttaagaattctctcccctggtttcattactgcactgctgcagaaggcagagtcatattcagccacctgggtcattcattcatgggctgctctttgactcacctaacaacccaagggaattttcaagggatttccagggatgttgtattatcttaagggtttttgacgcgtggttgttcttgaacattctttacgttactgattctaccattaagtagtgagttcactgcttgctttgtggaagaatttcaactcaccaaagacacaaaagtctcattttaatcattagaaaaggtttttttttaagtaattccctacataagtgagtggaatgtatttccaaaaggcagtagactgttttcatccctattatatatcacattacaacaatccaagaaactttaaatgttttgttgcaatatgggattgtacaattatgattttgcagagctgggggaacttgaaatcaggccacgttggaattggaaaaaaaacttggaaattatctagtatggaaactaataacctattttaaggttatggactcctttgagatgctgatggaagcacttatggactctcctccacatataaatataaacctctgaatataatttcaaatagttaatggaccctaaggaaactgtggacccaggttgagaacccaaatatttcatcaaaaacagaaggctcacgatgactatcagaaactggactatgtgatgatagaactaaaacagcagaaagcaaagagcaagaacttgttcttcaggaggtcaagcttaagagatgcaggaagccaggccctgctttccatgaggaggcatccacctgcccctgagtgccatgtcagggtgagtcagatccactttgaaggttcaggagttgaagagaataccactctcctcaggaccccacccagaagaactcatggcttcctctgtggtccccaagagcagatggtgacccctgttcagccattgctattctcagggagtcatggagtctctgtcttgggtctgcaaagccagttgctgggtttgagtatgtagaaaactgtccagttgacagcagtgacttgcggtgaaaagcaggaagccacatgtagagaaggggatggagccagaaaacccagaggttaatggcatctgttatcttcaaggggcatggaggtggtccttcaactagtgctttgattgtgtcactcatctgaatcaggattgtcccagggctatgtatgcagtagcaagcgaaacagacctgtaaattctcaatgaatttacaatctactgagggagacagataatagacaagcttggggtttgtttttttaagccatatacagctgcataatatgttaagtgccatgaagaacatgattagaattcagcaatagtggataatatgctggtgcagaggaagaggacttacatcctaaacagaacacagggaaggcttttccaggtaggtgatgcttaagctgaaacctgaaggatgagaaggcattgtcccttgagatgcaaagtggagatcagggagagagtatgcaatggccctgaggcaggaaaagcttagatgtaggtgaaaaatgaaagaaagctagtgtggcccaggagtagattgggagggtaggtgagacctaccatggtgaagttggagagggaggccctatcaccaaccggaaacattttatttgaattgcgattctatttgagaagtgattgagaagttttcagctggaaagaaatatgattgcatctgtgtttttagtgaccacagatgcaatcatatttcatctgtttttcatgaccaccaatgaaatatgattgcagctgtggtcgttaaaaacacagatgcaatgtttaggcagctctgtggggaaaagataggctggggaggggcataagatggaacaggggctatgcaggagactattatattcatccatgatgatggtcgtgtggataatgggaaaatatggatgaagagaagggagcagtttggggtgatactgtggatgcaaaaacaacaggagctgatgacagcttgaacatggtgggtgaggagaagagagtaattaagaatgacagccaagtgtggggcttgtgcaggtgaatggataatggcatcatttactgagatgggaaagagtggaggaggaactggcttgaggagaggaagaatgtcaaggattttattttggatattgagttttgaggtctttgaagccacaagcggcttcaaatgtcaagatgtcaaggaggcagtcgcctgtcctgtcctgaactctagggaaagtgtgctctggagttctcccgatggtcaagggatatatgtaggagagacagctggcattcttgcccttagatggcttcctcagttctcagtgcactttgggatggagtcccaggggcatctggaggtcccttacaccactggctatgcatgacatgttgccagacatgacagaggatataatgtctggtggagagccaccaaaactctcagaaaatcgggcttagcattcagacacctggatgtggtccatatggtggtgccacgatagaaccactgtgctgggtggcactttctaaactggggactgcactttgctgccctagtggagatggccctctctgggcttctttttcccgcagggagggaggccagtggcttaaccagatgttgatcccttggggcaggaggataacctgcccaagggtacattatcattgggagagcatatagatttgaggtcattcataaggccaaaatcattaaattagagaagattcaagagcatcttccaaataacggggctgtgaggtggtgtcaggatttggaggagaaagcccagggctggggttgaggacataggcagagggagaagaaggtgatgagagagatggggatgttctgttctctttgctgggctttcacatgttccctgctaaatgacatgtggacactgctgctccctttttcaacccagtcaaagaagccactgtgaacaccccccaggttctggtgatgccatttcctgcaacggtgcttcacccgcactgaagttggatcagagtgcatttccctgtttaatcccattctgtctatctttgtagaggctcaaaatcttcccttgccttaaaaaaaaagatctccataccaaaaggtcaaattgactatattttttgcctgaaaatctctaagttatgatgaagatttggatttatattaatataatcaaagagaggaaaaagttgtacctgcagtattttggaaaatagattttttttttcattcatcttttgggccaggctcagtggctaaagcctgtaatcccagcactttgggaggctgaggcaggcgaatctcttgagcccaggagttcaagaccagcctgcgcaacatggtgaaaccctgtctctactaaaaatacaaaaattagccaagcctggtggtgtgcgtttgtagtcccagctacatggggggactgaggcaggaggatcactggagccttgggaggttggggcttcagtgagctgtgatcaggtcactgcactgcagagtgagcaacagagtgagaccctgtctcaaaaaaataaaaaattttttaaagaaaatacaaaaacctagctgagtgtggcggtgcatgcctataatcccagctactcaggaggctgaggcacaagaatcgtttgaacgcaggaggcagaggttgcagtgagctgagattttaccactgccctccagcctgggcaacagagcaagactctgtctcaaaaaaaaaagaaagaaagaaagaaagaaaacaaaagaaaagaaaatcatccatcttttaccactgggagaaactgagtgaggggtatacaggatctgtctgtttatttcttataattacacatgactctaaaattacctcaaagtgtaaaaattaaacaagaaaagaaaaaagttaaagattaaaaaaaaacatccttaattttccctatttctgctgcatctcttcaaaaaaggcaaaaaatattaactcctttgaagcatgcatacgatagaaagattcttggatatggtgtttgtaatatttgagtaacatcagggaagcaaattaaaaagttaatttgatccaaaaaaatcctacttatccatagacttacttgaaataatttgccgagttggagttggaggttgtctaaaaggatcagaatacacgagttgtagctgacagagacaaaattgatgcctgtgccttgactgacctgggagactgttcttggttcttggggccgggccccctctgtgcccaatgtggcatcataaattttccatcaggcacaagatttctcaagagacactcaccccgcaactcactctttcctcccatggcttccaacacgacatgagccaagaacagtctttttttttttttttgagatgaagtcttcctctgtcgcccaggctggagtgcagtggcacgatctcagttcactgcaacttccgcctcccggttcaagcgattctcctacctcagcatcctgaatagctgggattacaggcaggcaacaccacacctggctaatttttgtattgttagtagagacaaggtttcaccatattcctcaggctggtcttgaactcctgatctcgtgatctgcctgcctcagcctcccaaagtgctgggattacaagtgtgagccactgtgccccgccccagaacagtctttcaggagcaatctcttacccagctccactcctgactgtcttagctacctgaggacctaactttgctgtgttcctcagcttctgtacctgtgcaagtctgtagaaaagccatccctcatagagcatcctgagagcctgtgatacaaacttagaattctgcaaaatacataggacgttaggacattgctattcagcagtattggaagaggaaataagagatcagaagaaaatgtatttctgagtttatgtgttggcatctaattttcctcttctttctcacatgattcagggagaaaatccattacattcggactgagggtaatcacgggcttgagaagttgtcctgtgatgcggatctggtcattttgctgaggtagggggctaggcctgaaatccttctggaaaagcttccctgggcagctctcctccatcacggccaccctgaaaatggcctagactgaaaaactcaccgcttgttctagaggattctagtaactgcaacgcaagtgggaccccacccttgtacctgtgtccatcacagtccttagatttgcaattgagctagcaagagctgcgtaaagtacttgatggagactttgttgtaggattaatcaaggtttaaaacaacactgagaatttgcaagcagcatgtacctatctttctgtactacatttaaatctaattgcttttgttgctttgtgagaagtgtaagtgctgctaccccaattcgtgaacactttctcagggatgtaaaactgactttcttttctttcttttttttttttttttttttcatatgcagtctctttgaagaagagattatgtcctacgtccccctgcaggctgccttccaccctgggtatagcttctctccccgatgttcaccctgttcttcacctcagaactccccaggtaacaggaatctggcctaatagctcctgttaagtggccacgtgtgtttcctccagtgaaggtgaatgaaaggcaactgtatgtgtgtgttctttctctcggccttcccaattccctaattgaaaatgcactctatcaggttttgacaaatggctgcctgttttttgtaatgccccccaagctagaatggggtttacagtttgaaatggttgggaaaaaaatgttttgctgggcaggtggctcatgcttataatcccagggctttgggaggccaagccagaaggatcacttgagtccaggagttcaagaccagcctgggcaacatagcgagctccccttctctacaaaaaaattaaaactaagccaagtgaggtagcatgtgcctgtagtcccagctactagggaggctgaagcaggagggttccttgagcccagcaggttgaggctgcagtgagctatgatttcaccactgccctcctgcccatacaacaaagagagtccctatctaaaaaaaaataaaaaagaaagaaagaaagaaaagaaaaaaattaagacagtattttatgacatgtgaaaactgtatgaaatttaaattgcagtgtccataaataaagtgtaattggacctcagccatgcctgttctatgctagctttcacaccagacttgagtaatagcaacagaaaccacatggtctgcaaagcctcaaatatttactctctggtcctttgcagaaaaaggttactgtccctgctctaaattgttgcattccaaagtcactctccgagcatttcaaacggaagagccctttctgaaacattctgccttgtgactctgaatcgattgcacaccacttttggtgatacagctactaggaaccattgttatatctccacaaagattccaaagaatttccttacacatttcaaaattattcctcctgttttctttatgtatgagaatgaacttgtggtacaaaaattctttgcaggtattttccattccaagtgagagaatacatatgttgaactgtttagtgaataaaagatattttcgccagacacaatggctaacccgcgtaatcccagcactttgggaagctgaggtgggcggatcacttgagcccaagagttcgagaccagcctgggccatatagtgagacctcatctctaccaaaaaaaattttttttaattagccaggtgtggtggtgcacgcctttagtatcagctattcaggaggctaaggcgggatctcttgaacccaggagacagaggttgcagtgaaccgagattgtgccactgcactccaagcactaggcaacagagcaagaccctgtctcaaaaaacaaacaaacgaaaaaaaagatattttctggattcatcaagataaagagcttaggtcaaatccatacctccagactggatccagatattggagaatttttccattcgtatttgacttgcattatcacattgttgtaggtttcatttaaagtaaaagagatcagtttgaaacatgtaggaacatcctatctcagaagctctagggccagggttggagcatggtttttgaagccagtggtaaaattcccaagagaaacagaacttggtaataagctttgtctctgagaagggatgtcgcactcagagttagtatcattcagtactgccgtaggtctccagactagagtatcttttagtctggttcctccaagttgtagcattcagaagtccctcttagaggtagttgtgctcgtcgttaaaatatgttttcaagatagtatctccctgttgtcacttcctccaaacaagtgtaccaacagcattgttaaggaaatgtgcaatgcttgctacctctgacgcacaacataattaaatcccattgcctaaaaagaccaggagctttgctggagccgacatcaatacagtcacacacttttagcactcataggatgacctacttttggggagcgaagacaaaagtaaggggtttggggggaaaagtttggagaagctgtaggactgcatgatggtctgccatgttgtagagattgtcccagcctgataatgtgcctatgctttggtctacagactttgatactagactatgatgttaacatcattatatgggagagatatcatattgcaaatagaaaaataagagtaaatgaagagttatttcctatatgagaattatttggatattctaaaaggaataaactttcctgatagagatatgactgatgccgtgaatctaagtaatcatccaattcattttgtcaaagtacttctttattctctagcattgaccacagggtcctagaatatgtaatccaaatacgttgattttaaactttacaatccccattctcttagactggtatgaaatctacccaggtgctacagagatggtgaatcatgaagtttatgccaaagtactctgtaaagcagaaattatttgaaaaatgcacagcagtcatcatggggacaggtgatagtaccagcggtagtgaaaatcataattaataaaatatactgaaatgtgctggacagaaaattatacttgcacttacagacctgtattctagttctgtgtacatcccaaaacctggtattccaccaagaccacttcttttcaagtggtggccattggttccctcaggcccaggtgtttggggcccaggtaggcggggccccaacgcttccttgcttttatcactcagccatatccctcccctccctttctcccagttactgtcatctaccaacctttttctcattctcaaggcctgtggcccctgccttgtagtcttcctctccttcccaagcaggtccttccgtcctcctggatgacttcaacatcgacagggaccctcattccgttccctggcttcccagtctctagactttgtctgcaatgactttctcctcccctgcctcaaccacttactcccaaaatcacattcctgaccttgtgatcatctccacaatcgctaattcaaacctcctcttctcttccaatgtgcttgatccactacccttcctactaccaccctttggcctcatcaaggcctctggttcacggacttttctcctttcctttctaacgtctttccctgatgcagcgtagattctgcggttcatcatttcaatagcacccttgccaatgccctgaactcccctggccctctccgttttgtttctaccctctggcagagcttcacccctagatgaaccttcctgtctgcttcccccacttctgcaatcaggcactcttgggtaaattcacctcacaaggcagattattaattctaaattagtcatctctcatctcacatgaaccttgaacacccaaaggaaaattctagcacattttttcgatctcctctactattatttcaaacatttcccctaaagcctccaaccctcagcacccttcctctctcctagcaaatgacgtcctgttttacctcactgagaagttgaagccatccagcagaaacttcttcaaaggcctgcccacaaggctagcaaacctgtacacatcttctctgtcatctctggaggtcacgaaaggaggtgtcctcactaaggtcgccatgaactctggccacccaatccagcgggcagttctcagccttcctaatctccggcagcgtgtaacatgaccaactgctgtcccccaacatcccctcttcagtttccttctgggacaccactccagacatctcatctacttccctggccattcccgcagcctcatcctccccttctatcatccttaagtctcaaacccaggcttttttctccactcaaactgtgtatctctccagacaaagggactatcatcaaagaccaagttcatgctcttcccccacaaatgtgttctttttctactcctccccgtctcagtgaatgtcaccgcagggtgttcagttacaaaatctgaaacccacctctcctccactacctgtatccaattcattgcctcttaaatacatctcctctctgcccacttcacttcatctccactgacgccagcctagtcccatttgagctctttgaatcccccttggtcctctggggttttgttcttttctgcaggaagatgaatgtttttatgattcaagtgacatcatgccagccactatgcaagggcttcctactacacttagcataaaacaaaattgcttaacaatgtaccttgtcctgtttcatgcagctcctgcccacctctcaggccttgtttttgtaccactttggtccttggactctgtgctccagacaaactggagtaccgctttccattccgccacaggacctttgcacatgctgatcttccacctggaatgctcttcttctcccagctcatctcctctcttagttaaagcatagcttttcttgacccatgcaatctaatttgtgcctatttattctttagattgtccccagagaagccttcccagacttagccagcagattctgtgatctcaaagaactggttttctttccttcatggatagcaatcattgtaacttgtattatatactcatttctgagagtttaccagcatcagtcttctctaaattgtaagcttagtacctggaatatagtaagtaactaataaatggttattgaatgggcaagccttgattctgaccacctttaaaacttgggtaagaatgttaattttccatccttttttaaattaaaaggtatatatagtaaagtatttacaaagcactctaaatgagacaaaagttctcctctatgtagagttagtgaattattattattgtaaactttactcttatgatgcaaggtcatctaatataaactctaatctaatataaactcctaaatgctctgagcctttgtgtacaggtatgtttatttgagcatcaatatcaatacaggaacatgatggacacatgtactaaagtcctacttacctcattatagtttcaatcacttcttgtagcaacttacaagaaaagtttagtctagttcagcttatgttaattattttagattatgcaagtacaattaaagctgagaaaaatgctcatccatgtccttttaagagaaatacaacttgaaagaattagagaggaagacataaatatttattctcattagaactcataaatgaatgtagtatattatttttatactttagtatattatttctatttattataaaagtcactgagagagtgatggaaatgaagggcttgtgggagaagaaaaatatggagatgccagaatgtgcctctgttgagctcttgctccactgtcactttgtgtatttgttcttccacagaaattgatgacctcatgcctgtactcccagcactttgggaggcctaggtgggcggatcacttgaggtcaggagttccagaccagcctggccaatgtagtgaaagctcatctctactaaaaatacaaaaattaacaaaaattatctgggtgtggtagtgcatgcctgtaatcccagcactttgggaggccaaggcgggtgaatcacctgaagtcaggagtttgagaccagcctggtcaacatggtgaaaccccgtctgtactaaaaatacaaaaaaaatcagccaggtatggtggcacacacctatgatcccagctactcgggaggctgaagtagcagaatcgcttgaacccaggaggtggaagttgcggtaagccgagagcacaccactgcactccagcctgggcaacagagcgagactccttctcaaaaaagaaaaaaagaagaagaagaagaagaaagaaagtgatgacctctgtgtgcttctctctgcaggtttacagagagccagtgcaagagccccttccccctaccgaagagactttgaggccaagctccgcaatttctacagaaaactggaagccaaaggatttggtcagggtccggggaaaattaagtgagtgctccagtgcttggcactgaattcagacagtagatttttcaatccctttctcccctacacccttgtaatattgtttttgagactggctactctggtgtggtagtggttatggtctgaagcgggggaagaaggaagttgggaagctggaaggaaagaggaaaggacattaagaaattggaagggaagcaggaagagaaggtaagagagggaaagagaatgagaaagaacagaagattttagacaaaggcatgtcgaaaatcacagggtagacctttccagaaaacaagaaatcttgaactaaataaaaaatctcatatttcccttcacttattcttgggaaaaaaatttaactcattggtcaaatttaaattcttggtaactttgtaattgaagtctaagtaaaatgttgtttatattttcccttctgggtttattattttcatctcaaaaagctgaacccaaactcaggaatcttaagcaatatcctatgagttgatcaaaatgaattatcttaaaagtagttccatatgatggaatgcacgagaagtgtacacattttccttgtgctcctgatgttttgaaaagtgtgttcagataatccctcgatgaactgacggaacctgggtcctgctctttcctctctctttggagaggctggggagtgagaacctaaacctggactcacaactcacttagaaccctgtccagcatcctgacttcagggccactgctcaccaccccttctccttctcaggctcattattcgccgggatcatttgttggagggaaccttcaatcaggtgatggcctattcgcggaaagagctccagcgaaacaagctctacgtcacctttgttggagaggaggggtgaggcaccaggagttttatgcagacacctaagcaagggtgggccagagcctcagggtcaggggtgatttttctcaagaaggagcacagtagctgtcagtcttcaccccaatgcgattctgatcacattctcccaggaggtccttcttttcaggtattgccaagctttaaaaaatgccatgatcttcaaaaacctaagattattgacatgcacaagaggatatgccaacaatacagtcccagggcactgaatctttcctttttaggtggtgtacccctctgagtatctaatttaaaaaactctttctcttaaagtgcatgtatacaacttcatgccaaacttttcatatcatttcagtgatttcatgggaaaccacctcaaccatgaagggcaagcccatgtaggaaggcgtatcaaaatgaacttggaagccttttcagtccacccacatacacatacacacacacacatgcatgcacacattcactgttgcaggaaattcttttatgtgtcccacaacaaaggccttgtattcaatgggccagctgtgtgttttagctcagaggtgttagatgatcaaaagaaaacactaaggaaagctgccataagagtttattcatggacatctggttaagaaacatctccaaaccaattactgcatcctcattttctacagcaaattgatgctgccattggcattcactccaaagagcagaggctgctctctgctttccccagcacccaactctgaaagggcacactagaatctgggtgcaaacaggtccccccacctccgggcacagaatgagcttcctggacctctgctttctttgcagcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggtaagctctataatgttcactttcttgtatttgaaagttctcctctttcttagtcagaattcagcagcatttctcaaaggccactgtgtttagagcagtggccagatgttatgagggatgagagtgaatgacagagtccaagaaggaagaatctgttagtcttcacccagaacacaagatggatttaccaaggatgctgataatatagcaactgcaaattgatgtgagaaagaataattgcctactgagaagacgctaagatcagtagacataggtcatgaatgttgataattttactaaaatcatagggtcccagtggaagcttcttggaggtatttatgggtttgaaattctttcaccttggaccagtggctttagcactgtggacactggcttctgcatcttactgtaaaatatggctattgggtcagatgatctctaagcattcttctgacttgaaaatccagtatgtctttggttcctgggtggtctgctgttgaggcattctattaccacttacctatatgtataagaagattggtatcactcaatgctgtgcagttttgtggtgcagatgtgggtattagaggtctccagaaagctgctgggacacctgggatgcaggcactttcctgctgcatcaccacatgcctgatttgaaaattaccgctgttctgactgcaggagctcctgctgttgagagggaaatgagtcctggagatggctaatgtgagttcttctgacatgacttatttatgctgctgttgaagggagccattggggtgacacctgggcctgctggccttagaacccaagttcctatagtttggctatagagcatcagtataacccacctgtgctaaggcttccagatattgcacatgccttctctccaaatgcactcccagccctgaagttcttgagatgaggtagagtgagtgagtacacatcgagggtttggcacaagatgaaacaaaacgtgccctttgttgccccagaacttgtgaataagtggatgatggagcagagcagacaagtcaccgtggacgggcccaagaatggaatctgcctctcactgagctcacattcaggcaggctccattctgatggtagagagtgctatgacctgtaacacaggaatatacacatacacagattatacctaatacaatccctcaactagctcttagtttgtgagcatgaaatttaagatggtgtcttagagatcatgaattggaatcagcaatcaacagagaaatattttcatcaaatatcttaccatataagactatgctggatagcatcaggaataccttcgctaatttaacaattataaattaagcacatagtatgttctgggaggatacaaacataaaatgagcaaggtctcatgcctcaaagagactagtgtgaggaacacatgagccaaccaacaattacaatacaatagcttaaatgctcacttatacgcacatatacatatgtgggcatatgtttgcctgagatacatagataagcctgagaattgtattcaatcacaagggaaaaatatcgcactctgtccaagttagggggtcagggagtggggagtggagtctgtgaatctttcaaaaagaggagacggtggcataggacaacagggacaagtaccacggtgggatgaatggaagctgacgtttgaagaaaaccttggtgtcaagcatgtttcagtgcagccacaaaataaggccacaggtgaaggcctgatgggaagcacagaagatactgtggcccacacttggctggactacctgttaaaagtggcctccgtcactttccacagtgaccatgccttgcctgctgccccgtccctgcaaccaacctggctttgtggccttctgctcatctatgcattgcaggactgaagaagctttatagatgtgtccgttacacttcatcacattaaggaaggaaattgtgtgatacagggattttgcaagaattaccaaagttctctggatggatccctgatgagggcttgacagtgcctgtcctcgaaatgcaggttaaccgctgtgtcctttgttagaggacttggccccgcactaagcatgctgagtttcatccactgatgttctccctcatgtggagagtatttgtggtgcatcctggaaacgcaattgcaggtagctttctgagccgactagcaatctaaactgagcccacggtgatgagattttcttcaacgccactctttggatgctgctgacttgtgatgaaatgggcagggaacccttatgatttaaagctgcgactctgaatgcctcagtcccgagagtcctcagcctggcatgcagaacaagccccttcacctccacggggtcagagatcagattgtatcatgaccctccatgtggaatcacacttttcttctcttatcagtggctccaaatttctgagcaagggaaactggttttctttgcacagagccacagctgactgaatgtaagccacctaggaagagtctcatttagatttcaacaggaagccctgatcagctttgggacatcttaacaaaaccatgatgctgcagttattccttttgtttattttttgttattttcttgtgccatgtggcaaatagtttaacaaacaaaacatgcaggtttcacctatcttgtgcccctgagtggctcgttaagctctttggccagcattttagcaaagggaagctaggagagcccagatctggtgatgtggctttgggtattttgcacaaaatgctggcagtgtgtgggtgctgtggcacctgcctgaagacctgtcgctgtcatttctgcagcccgcaggtccatgacactcaggaaaccagaatcctgagtcctcaaatctgatcgctcacgactggtaccactggctgcctcttaactgcccacagcgtgggcgtagctgctgctgatctcgggtcggtgtcaggtgctccttccaccttctgagggagttcatcaggagattcatggaggctgtgaagaggatgacaatcatcagagcctgtgcatcactcataaggaaacggagaaaccaaaagattacaaggctttctatgggcacagccttgactttgtaaagcaggacattgtcccttgacacaggacaagccagggcaggatttggcctgcaggaaggacagaggtgccttaatggacacccacgccctgcccacctcccttcactctggaatcagagataagcataaccacagacccgaaataaacatggcaaaccaggtcagcttcaaaagttgttgttggttttttccaaaaatagaaattttattctctagtgaggcattatcagaaaatgctgtgaaattggtattcatattttataaaatttataaatgtgtaaaacgctgatgagctaaatggatctattttgtactgctgagcataattttatatgttatcataatcattaataaaaattagatgaatttaaaagtcagttgcttgtaggctagtgaaatagtgaaaggactagagttttcctttaactggaagaattattactgcttaacatacacacatttaataccgattggtttgctatggaggaataactgagaaaccaaatgcactgagtagagtttatatgaatgtttcaacacagctgctcttacatgattatatttttttaatgcctagcaaaaatccattataaggcttcaaaggattaaacatcactcaggattgacacggtactcagctgtggctggaggcagcaactttgcagtggtcaattttatctttttttgttgttgttattctgcttctttatccttcgctgaccttcttctgcgtcccatcctcttacacattttctgagttccctctaaaaaataagctctattggagcagagacacttttgtcttatttcactctagcacaacacctggcactttcaggtgttcagaacatctccccgaccactgggtgcataaatgagtattattccacaagtcctaccagtctcttccttctaccagggttaagattaataaagtgctccctcctgccatgtgcaattaattgctcaaatttcacacttttctgtattatctgtggttttaaagcccttgcaaagtcagtgataaatgcacatgtcccttaagatctttacactctgggactctgctctccacgacgcgtgaatgctgcttgttactgaaggaaggcctcctccttcttctcacactgcacgtggtcctgcagcggccacttccaggcaaggcactgcccaaagacatcaatggagaaacccctgacagtgtgtccttcctctgaaagctcccctttgagagtgggtacttgacattctgggcttcctgctccctgtgtgtgggctttgtatccattggaatagagccagcttaatcaaaagccctagcagggcatcatgattccacccacttcctttctttctcgtgcagtgttgagacatacgaatatgaataaatatagtgaaaattctgtgttacacacgttaagtaagctggaaaaaaaaactgtttgtgggttttggtttttttttgttttttgcttttggtcaggatttttgatttttgttttgttttgttgcctttgacctaaagagactttctgcaattgctgtttcattacttatttgtacgactgacttccaaactgaaaggaccatgtcaaagtcagcagtgataatattcaggccaaagagaaagaggagttagagtcagaagagctctttcaaagctggagcctataagggaccacccatggacactgtggtcactcaaggacacagcccctgcgagacctggccacagcagggcaaagcagggaaataacactctcaatcaacactcttcttccaccctccagtcccaatggccaaacccaaccatgaaccagaggacagaggctctccagatactgcaacccacagtggccagtccctaagtcacagagcaggacagaaaaagatgggaaattagtggaggacaggagagcagggaatggaaaattaccacaagagcctctacatttcaggacattcaacccatccaccagaaatcttataatttacagaacagtatgtgtctgttgtgtctttgatgacagaagtcttggaatactattccaaatttcttttttcttttcttttcttttttttttttttgagatggaatttcgctcttgtcccccaggctgagtgcaatctttgctcactgcaacctccacctcctggttcaagcaagtctcctgcctcagcctcccaagtagctgggattacaggcacatgccaccacgcccagctaatttttgtatttttagtagagacggggtttcaccatgttggacaggctggtctcaaactcctgacctcaggtgatccatcctccttggcctcccaaagtgctgggattacaggcgtgagccaacgtgcccagcctattccacatttcatatcttcattctttgattatgatgatgtcatttgcatattgatgaggcactcatatgctacttttttatccttttcatatttattgtatcctgattttctatctttagggatacataatttaataattaagctaaataatgaaggatccattgagaacatgctaaatataccaggcactgtctaacaacattataacccagatataatgttattattacaacattataacccacatactgagttatcctacttttacagatgaggaaaatgaggtgcagacataaacaaagccacagagatagtcgaggaccaggtaggaataggaacccaggtatcatggctctatcatcaggatctagcccccattcaaaggcaaagtcagatatataattggtcaaattaaaatacaatgtgaccaatgctgtgcatacctctattatagtgcttatcacattgtattgtaataatgaggtacaaggaactttggaaaaatgaatgagaataattggctggcagagaagaggagtggggaattctagatggagggcccagcattcacagcagatgtcagtttggtgtggcctcagaagagagaaagaggctggaaaggcatcctggtgtcgggtagggaaaagcatttgatggcattcccaggcgtttgggttttgtcatgaagatgacaatgacagggagccaggcatttcattagtaaaggaagagcctgatcagatctttattaaactcagaaagtcaactctggttacaagtggaagatgaactggagtgggcaataggggtgtcatttaagaggctagtgaaatagttgtaggaagagatattaaagaatcaaaatagggcagaagcagtagaaatggaaagatttttcagaaggagcatgaacaaatgaatgaacaaaacttggtgatagattataaatggtgggaagttaagtatatgacaggctaaatagcttgaaatgacactggtgagcacctaaaattctaccaaatacttatcagtgcaaagacacctttttaaaaatcaacctaccattccttctttatgtagtaccctctattttaaatgatacttctttataatctgaattagccagattatagtagcacactcccagatgctgtgagatatgttatttcaacatttttaatatttaccaaaactttgtgtcattggaaactcttcacttacttgctgcaaaattatatataagaaactaccaagttaaaatgctcgcatattttgaatggaggcataaaaaacaaaactataaatgaattgtgaaaggtccaaatttatttttatgtctaatacaatgcatgaatattgcaaatgcatatagtttcaaactattatgtttatataggaaagattcacatttaagttcaaacattcccttctctaagggtctttcctgagcactcaatttaaaatagtgcatccatttataattttccaacttaacatcttactttaatatattgactgaatttatcactataaaaagtattaatatgtttataattcgttgtcgtttcttcccgaaaatgtaagcccagtgagaccagagtcttggctgtagctttcctagtcacatacttggcgctcagtaaatatgtgtggaaggaaggaaggaaaaaaagaaaggagggagggaagaagacaggctggacagatagacggatggttgagtggaaggatggatggacggatggaatacttctcaggtaaaacttcttggttaatgagaatttttatctcatttcaatttttagttcagaatatttaaactaaaataaaataaataaaaacagtaaaaataaataagtaaatttggagcctctcactcattgttgagtgtcatttaagctcctaccaactattctctctgaaatcaccactggaaattctttttgtcccaatcattctgaatgtcacttttcctggagcaaatctgagatgccctaaaagtctgaacaactgaaataggtgagttccttctctattcctaggaagaataccagcgcctcagacacattttctttgtcttaagtacagtcatgtgtcagttaacgacagggatacctctgagaaatgcatcactaagcaattttatcattgcgtgaacatcatagagtggaattacacaaacctagatggcagagcctacctcacacctatgctctatgctatagcctattgctcctgggcaacaaacctgcacaacatgttactgtactgaataccttaggcaactgtaacacaatagcaagtatttgtgtatctcaacatagctaaacatagaaaaagtacagtaaaattattgtatagaagataagaaatggtacacctgtatagggcagctccgttataatcttttgagaccgccgttgtatatgtggtctgtcattaactgaaatgtggttatgtggcctatgcttgtgctaacatgtatcattttaagaaacgactacgttatgagtcactctttacataattgtcagtgtgagaaggattttcagggccagatttcagatttgatgctgttaatcagtttctctgcagccaccaaaatgtctgtgagctcatttatgtctgtggtggtgacgaatctaaccttacagttgtcacaatcagacattttaccacctctcaaaccaaaatttccaagaggatcccaaggccctttgctaactgcaaaataaacagactcccctgcccccttctgccccagccccgacctctctcccttcccaagcagatactacctgggtggtaaaaatcttctgttttcaggtctttagcaaggggaagtgggggaggagggaagctcttttgtgcatgtttagagtttggccaagtgggtaagtgggtattaagtgtaattgtagagttttatggaacttaagaagtcccggataacacattttaaatatcccttgctacatctgcagagtcttgaattagtaggtagaaaccacaacattatgagatcccactgggtgtctcatggcccttcaacctcccagggccctcctgacaaaagagctcagtgtggacttttgatctgagtttaagatcaggtaagccccagccccagccctacccctaacaacagcccctgggttctttcacgaacacctacaagagctttgctgaccccatctctggctgaatctcagtagcctccctatcaattctcaaagaagatgtggagcaaaagttagatgagaagtcaccatagaatgtacgggattggttgggattctgcctgtcctatttctgaacccagctttcttcagaatgtgtgagaaacttccagtaggaaaagaattaactatttagttaatgatgccagtactgtaactgggtatgcaaccaaaagaaaattatgttagattcctctctactttgaaaatacgtgaaaaaaaggaatgaaatttcttcaggaaaatctaggtgaatttatgcatatgctagaacataaaaattattgagaacataaaatgaactcaagaaaccttgagtggtagagacctttttagagacaatctttttaatcaacaactagaatctataaaagaaaagaaaggccgggcacagtggctcacacctctaattccaacactttaggaggccaaggcgggtggatcacttgaggtcaggagtttgagaccatcctggccaacatggtgaaaccccatctctactaaaaaatacaaaaattaaccaggcctagtggcacatgcctgtaatcccagctactcaggaggctgaggcaggagaattgcttgaacccaggtagcaaaggttgcagtgggcctggattgcgccactgcactccagcctgggcaacagagtgagacaccatctcaaaaaaaaaaaacgtatttgaatatataaaagttaaaatactttctgacaaaaataccataaacaaggtcaaaagacaagctttgatcttgaaaattaatctttgcaactcaagaaaatcagaggttgaaaatctgtaatacaaatttcaaagagctcttgcaacttgaaaaaaagaggagatacaaccctgggaaaactggtaaagaatatgaaaaagttggtcagagaagaacaaattcaaatgattgataaacccattaaaaaatgtcaacttttccagtggtgaaggaaatgaaaactaaggtaacaatgatatatcaccttataacgatcaaattgccaaaaattgaagagttatttatttttggaggggacataagtaaaaggatgctttcatgcattgttggtagaaacatgcatgaaagcaattttatagcctttcaggggggaatgcaatccacaatataaactaaaatttttaaaacccctataccctttagcccataaagttatctcatagaaacaaaagcactaatattcagtacttttgtaataacaggtaatatttattgagcccttattatgggccaggtatttttgcaaaggctcaacatgaattacataacctagtataatcctctattttacaaatgaggaaactcatacccatagaggtttaaacttgcccaatacaagagctagtaagtgacagaggtagggagcaatcacatgcagtctgactctagagtgcagactttttttttttttagacagagtcttgctctgtcaccaggctggagtgcaatggcacgatcttggctcactgcaacctccaccttcctggttcaagcgattctcctgcctcagcctcctgagtagctgggactacaggcgcccactatcacacccggctaatttttgtatttttagtagagacggggtttcactattttggccaggctggtctcaaactcctgacttcatgattggcccgtctcggcctcccaaagtgctgggattacaggcgtgagccaccgcgcctggcctagtgcagacttttaaaagctatgctggactgccgcacaaaacacccaggtgtgtttatttcagcattgtttgtaaagacacaaacctagaagcaatgcaaatgtccatcggcaggggaatggttaaatgtattacagcagatccacactgcacagtcatatgaggcataaaaaagactgaattagaaccttaccaggtgatagagaaagatttcctcaagatattgttgagagaagaaaagcagaaaagcatgaaaaacgcaattcaaaaactgaaaaatagtaaccccaagcctgtgtgtatgtagctagagatatgtaaatataaatatattagtatgtgattatatgattcagataaaaaatatggaagggcacattttagattatcaatatgtgtcacaggagatgagccgaggtaacaggagccagccatgccaggagaagccaaagtctatataaaaattacatctgtgggtaaaaaataaataaatctcttacagccaagatgccatttggtaaaaatgtcttagcttaattattagtggtaaacaaatgtcttagatatgcattcatcaatgcactattcttatcacctaaggacttgatgctgggttctacaaactgttctacacatgagctcctggcatattgtgaatgcctcatgtatatggtacaactatgctcaccctaccctgggtctcttcccttctttatctctttttccatttatcccccctttactcagcacagacctctttactaattccctactgtctacgaaatggagtctggactcctcggattctcaggacagccaaagcacgaggaccacctgccttgagacaccatctgcctctcccgggcagctcctcctctgccctccccacgcttccttaggctttgctctgctgcccatatgtgcgcgattgtttcttctgttcttcttctctcatttacatgggcgcaaatttcctaccctgaaaatccacttaaaatactgtgtagttcattcatgatttcttcatgatttcctgcaccttctcaagacaaatatgttcatcttctcttgaattatttttttattattattattctactttaaggttttttttaaaaaaaacacaaaggtttccaaacccttttagctggaaccttgttctccaatctagaacagacgaaagtgaagccttgcctctggcaaggaggggtgcctggttcactgagcccctcaggctcttcctcctccccatctctatgcttctgtgcaaaatagcttgagaaagcactgctctaatctactgtctgcgtctctccttccatccctccctggccactttgtgttagcttttaaactggatcagggcaacatcttattgttcaggtttgccctctgcagccagcgtggtttctggcatggaggcagcacccttcaggtcctgaggcaggtgccacacagcaaaaggcaaacccaggtttcatgcctgctccaactctcagtagaacctgggcagctttcttaacctatctgagtctcagcctcctagttcaccaaaaggacataagagtgcctgatgtggtttgacggatgcgtctctcagaattcatatgttgaaacttaatcaccaacgtgatgatattaagaggtggggcctttaagaagtgattaaacgatgagggcagagtcatgaatgggagtaaggcccttataaaaggccttgagagagtgagtttgcccactaggtacagtagcaccaccacgatcacccccagctgtcacaaccaaaaatgtttccagacattgccacaattctcctaggaggcaaaatcactctgttgagaatcactgttttcatgatggaagactggaaaaagaaaaggttaagcaaaatttttgcaggattaaaagtatttctgtaggcctagagttttaggaaaacattttcagccttggaatacgtcatggctgcgggttgaatatatgtgtttttccaaaattcataggttgaaacttaacccccaaggtgatggtattaagaagtcagaccttggctgggcaaggaaagtcatgcctgtaatcccagcactttgggaggccaaggcgggtggatcacctgaagtcaggagttcaagaccagtctgacaacatggtgaaaccccatctctactaaaaatacaaaaattagccaggcgtggtggcacatgtctgtaatcccagctactcaggaaggctaaggcaggagaatcgcttgaacctgggaggcagaggttgcagtgagcctaattgcattgcactccagcctgagcaacaaaagcaaaactccatctcaaaaataaacaacaacagaaaaagaagtgaggcgtttgggaaagtgattaagtcatgagggctccacctttgtgaatgggatcagtccccctataaaagaggttgaagggagtggcctagtcccttttgctcttcccattctgccatttgaggataccgcaaggtgtccatcttagaagcagagaacaaggccttaccagaccctgaatcttttggcaccttgatcttggatttctcagccttcagagctgtgagaaataaatttctattatttataaattactcaagccatggtattttgttatagccacaggaatgaactaagacactcacatattagacttctctgattattggaccagcataactgaaccacacactttagttttcaaatgttggcaactgaagaacttactttaagtaatgaccttcaagtaatgaccaggtgagtctcggtgcagttagtccactgagttcatgtcctgattccctgctagtccatccagaagagaatctcccagatgctgttatcatttgcttcccaagacagttgcctcctggactgagtcagagggaaaagcttagatagaagccacacctctgtctccagccataagcgggctgctggaaggattcccacagagttgccatgggctcttcatgaaggctggaggttagctatggccctggcgtgctctcacctgccccacaacagccacctcaccctccaagcaggcctgcagctgcgcaggagttctagacaccatgcctcagtcctcccacaggccaagagggaaaaattacaaagcaaaccactggtggggatgccagggcctacaccaaaccccctattagctgtggagacaggagactagcctgtggccaaaccctgaactcagcccacaagaatgtgcacggagcacagggaatgacagcaatgctggccttggtataaaagccaggagcagggaaatttgattgtgccaggaggacagggagctgcagagaatcaaaactctgcttccctaatatttattccaaaaacagctccgtggtggggatgttattgctggcacttccgcctactctttgtactgtgtgttctctttccaaaggtagttctgcttgtttgtttgtttgtttgttttgagatggaatttcgctcttgtcccccaggctagagtgcaatggtgcgatcttggctcactgcaacctcctcctcccaggttcaagcaattctcctgcctcagcctctcaagtagctgggattacaggtgtgtgccaccaggcccggctaatttttgtgtttttagtacataaggggtttctccatgttggccggggggggtctcgaactcctgacctcagttgattcacctgcctcggcctcccaaagtgctgggattatagtcatgagccgccatgcctggccttgctcgtatttttaaacaccagcatcaaacagccctgaaaactgctctttctaggagcttggctttgtggggccgctagaaggatgcaaggcctttgaggagacaatgtcagaagagagagaaatcttgaattataagagagagcaaaaagtggatggaagaagagcccagaggaggcagggaaagacaatagatagcccaagtgaagacattagctttgaaagagagtcagccccagcaggagaattgcttgaacccgggaggtggaggttgcagtgagcagagatctcgccattgcactccagcctgagcaacaagagggaaacgccatctcgaaaaaaagaaaagagtcagcccctttttccttgagatcgagggaaataaatggcaagtgtagattgcagatgtacttactaatgagagaggcgccgaaagcaagaaccagagggagggagaggctggtgatatgagggggattagataaaaagaagacccccccaattagtggggtgtaaggaggcaaggatgcatgtgcctgcaggcggtggtgtgagaggaggccaagtggagccattcatactctcagcttctagaaaagcctctgtcctccatcccttcttccagtatccatgaggaaatgcaatgagtgatgcctaaggcaaaaaacttcacttttgaccttcagactatgtttttcatcttaaaaaaaaagatgagggacttggaatgggtggttctcaaattttagtcggcaactgcagaatttattttaaatgcagatttccataacccaccccatagagtctgatctccaggtacctagatcttaacaaacaccccagggattcagataccaatggaagggtcaccaccacctttgagaaattttgccttagatgttagcagcgtcaagagtctttcaaagagtgtgagaaaaaaagctggctgttcatgcagttttcacactctgaaatgaaatctaccccaggcagacacaacaggttttcactagattttctaatatataagaagttagaaaatatgagaagaccaaacctgaaggcagtaacactgagtaaagcatggaaacatacattgtgtgggaacgtcatgaagtcttattacttaaataatgaggttgagaaaggataattatttttaattaaacaaagttagaaggataaggaaagaggggtatctttgagatgggtttttaaaaatgtaatagaacttagcaattatgaagtacttttcatcttcaaagaacctattaacattaaattactctttcttttcattctcctgtgaggtaagtaagcaaatactaacattattatcccttatttgtagatgggaagagaggagtggagaggctttgacatgcccatgcagagctaaaattgaaagaattcttttttcacaagttcctactagagactgtggagacccaggtttggggctattgtttcacctctagctctcccgtgtgcttgtaatatttggaaaagaagttactgcaaaattatgtaagcaagcattagtgggaggtggaaggagctcctgtgtcctgtagaggggcatgaaatgctatttacaagtctccaaatttccctggtatatcaggatttaaactgaggaggttttcacgagaatcagcgttaattaacttgagcagactctttacattatcttatttcagcatcctaatataaaatagggattaaaaattatgctttatttgttgattcaaaactcttttttatgaatgtattatggcatgattacacaaatgaacatcgatgctgcctaccttagaaatttgcttcaaggacaaaggaaagtaaagcactctagtaacaatatcaagcccaataatcggtcggaatatgtggtcagcatcatggctgagaaatttttaggcttgactctaagtatgaaaattaacaaaattggaactattatttaaattactgaaaatgtaatttccatgaaatcagttcatttcctgaatatttaaatgctaaatagaatggacagaatcaatatattgcattcaaaagtctttttgtctgttgggagaggtttaaaaagcaaattatatgaaagtataaagacgtctttctgttcagcccagtttcatgagaggagggatacattcagcggggtggagggtaaagagtttgacaacaacagaaactggaatgacaggaggggtgggcccattgtaaaccacctagcatcagttattctcaattaaaaatagcgcagctgaaaaaagtactgcaaatggcattagcagaggtggaccagggacagaggtacaatcctaatcaaattgagaacagaaccaaggtagctcagtgatctcaggatcggagaagggggatgttggtggagatgtataaaactaatgatcaggaatatcattgtgaacgataaatgggaatcactatagacctctagggaagtgtgtgatgtaatccaggaaatggatcctccagcctaggctgagagcagatcagccttgggacctttaggggtacagaggagaggggaggcttcctactttcagatgatgaatagaaaacaaaggctacactggctgtccctactatccagacttctagggactttctctttatagtctaattttaaagagtatcaataaattctattatctaaagaaaaatatcatcagtaggtaaatcttcaaaacaataaagcatcatagaacatagtcacaagcctcaatattatactgatttagtattttatttggcttatgcattccatattttccctctatctatgcaattaattcagaaccaattacttaaatagcttcaggtatttctggtatcctgattgtatcagtacatagatcttgtgtggcatggcaacttgatgttgtcagagccattattattttgccattcatgtgaaaattacagaatgctacatcagtttagacttaggtcatatttaaataattctaacatcttcctgaagcataatgtccctagattgtacactccatgggagcatgagggccttgtctattatgttcactaagtattccagcagttagcacagtgccttgcagatgatagataacttatgattcatagaaagattgaatgaatgaatggagtggaaattctaaacattgtttggtttagcccaagttgattttttttaacctgactcagatttatggaaatattgtgcattggttaatgcatcacaggtaagaaagagataataacatttaaagggtcaataaggcactctgggttctgcccggaacacaatggcattgccattcctgtattctctggtctgtgcagctcaaataattaaggcttctaaaccttcaccttcctgtattatccagttagatgaagatatagcagggccaggtgcagtggctcacgcctgtaatcccaacactttgggaggccaaggcaggaagattgcttgagtccaggagtttgagactaccctgggcaacatagcaagacctgtctctacaaaaaataaattagccaggcatggtggtgtgcaactgtggtccctgctactcgggagactaaggcgagaggatcacttaacccaggaggtcaaagctgcagtgagccgagatcgcatcactgcattcagcctgggcaacagagtgagactctgtctcaaaaaaagaaaaaatttttgaggctatagcaggtttcagagcactttagttatccaggcaagcagccttttatggtcaaattttctatataattctgggcttggaactagacactgtatctcattctaaaactagataaattcccttcttgcgtgaaattaaatatattactttagtggaacacttacaaattccaagatcctatgctgagtgaaaggtgttctggacaagcaaggaggagggctatgctgcgggtgggcactccctcactttcctaaggctgccatagcaaattaccacaaactggccattctcagttctggaagccagaaggccaaaatcaaggtgtcagcaaggccacactccctctgaaggctccaggggagaccctttttttacctctttcagcttctgggatttcaacggctccttggcttgtggctgcatcactccagtctctgcctctgtctcacatggccttctcatcggttcctgtgtcctctcctctctatctcttataagaacgcttgtcgatggattagggcccacctggataatccaagatcatcttatcttgaggtcctttacttaattatatcttcaaagactccttctccaaataacatcacgttcacaggttccagggtttaggatatgggcatatcttgtgggagccaatattcaacccattcagatacctcccatcatggaaaccaccaagtttaataatgcagtattatgtttcactctgaacctttggagtgtctgtttctaaagaatacaccagattttgatagaaaattcaccaatctttccaaaagcccccaaaggcctctgagaagaaattggtagtattctcccaaggtaaacagagaaaccagtgaaaaaaatttcaactgtttgcctgagctcataaagcaaattcacaaaaaagtcaacctggagaactaatgactgaggctcagacaacggtaaaatagctagaaagttaaataactaaaaactgagctattagctaacgttaatagctaaactgagagctaagctattttggtccattaattaactactttgattaattttgtagagtgaattgttcagtcgtttgaccatgaaaggctgcttgcctggataactaaatgcacatcgtttttgcgacttgtagacataatctcagtcatgagcatccatgatatcgcaaaacaaaatatttcaactctcccagtaaagaatatttggaagctaaggagaaatcatgctttagaggtcaatgaaagcatctttgagggccagagtggtaacatacctggacacatctagatacgggaggaaatcaaaggtggggtaatgttctctatatttatgggaaggtttattttcctggatctttgttccttaactcctttccacattaacctaatttaatccttataatctgggaaaatgtgattgatacattcagtattaacacaagctaaccagaatgatgggtcaaaaaatatcacactttcgaatgatcagttttaccacaactggtttttcattgaattgaagagcaatactaagtatgttatttgccatctctatatggtcagagggtttgttaagagtctgcataaggtacttttagaagtgctttctctaaaagagaggcacaccgcacacttggcccaccacgttgaggggaagcagctctggtctcactcctctgcccccctgcagggcagatattaatggaggggacttggcggcaccagggctagacattcatttcagttgctaattagcaatccgaagataatatcctgtcattatcctgtgttggcagagtctctttcatggcagatgaagaaaacttcaagttttctcagctaatttgtaaaatcatttccacataaagggaagctatgaaaaccaaatataaatcatgacttgcatctgcaatatttaaacaatttttatggggcattggggaggagattctttacacattccccaaaacagtatctgaataaaggtgggtgtagagaatagaccaaacctacctaacccccgtggcagtgacctacattccactccagccacctgctcccacagtggccctctcaacctcattatcacccagaactgtgccatgtcagaaactgaaaactctaaaatcctactgtcaatcattctacagccggcgttcccacctcctccccctaccatcgctccttgccaagctcgttctcaccttggattctctgtctcctcatagtctggcatggcctccttcatcccaggcctcctgagcgccttcattccctgcacacccaattccctccctgctccatgcttgcaccccatctgaaggacaaaacgccactgtggattagtattgtaactcactcttccccattccatgccagggtagttttctatagctctagccctggagaaaatgaaataattccaagaaagggtacaattctaaatcacactccctgacctcagaaagtgccacagcaaagctcaccagtcctgttacaggggcatcttccatttgactgtcccaaaagcctccatcaaccaaaatcacgtccactgtgagatgacttcagaccctactgaaatggaaacactgaggtgaccacttcaatttctcaccccaaataaaaatgctacccaaccttaacaccctcgctggagtccattcctccactcaagttggacctgcccactcaggctctaggcccaccagtccccatctccatgcctctccagcagtcatccctttctcatggatctttacacttcatgctctccccctgctctgctcctctccctcactcacttcctcacctactgaagtctgatttcagtaatcgtcaccagcactgccctttccatgagcagcagagaccatctaatcaacagagccagtgaactcttaccactttttactttttttatttttatttattttttttttgagacagagtttcgctctgtcacccatgctggagtgcagtggtgcaatctcggctcactgcaacctccgcctcccaggttcaagcgattctcccacctcagcctctcaagtagctgggattacaggcctgtgccaccatgcttggctaatttttttttttttttttttttagtagagatggggtttcaccacattggccaggctggtttcaaactcctgacctcaggtgatccacccacctcagccttccaaagcgctgggattacaggcatgagccaccatgcctggctcatgctttactgtaatcgacactttactgcagtagatacaaactcctatttgaaactctaccatcttagattctgacatgccattgtcacctagtttttattatatctttattataagtaaataaacatagttttatcacatcagtaaggtatactcattatgaaaaaatttaatatacataagaaaatatctccatacagaaataaatgccattattcttctgacctaagtttttccatatcttttatggatggatggatggatggatggatggatggaaagacagatataattttatataaaatatagcaatgtaatcaaagtttactgctttataaacttctctccatactaacatatgaattctaaatttatattttcagctctgacctctctattgagcttcaaactttattatcaaaatacctactagacatctccactttgatcctcctccaagttaataattaatctctcccaccaagccacttcttcctgtcatccttctcttctgctgctgctcactgtcctgctgatttacctccaaattgttcggcatgatgcccttgacatattgtaataacctccaaatctgccccctcctaaaatctatatccttcatatgggtgcaaagtgatttctctaaaaatgccaaaacaagcatgtcactcccctgtttaaacctgtcaatgggttctcatcgtctacagtttaaagggtgaacttgttggcatggaaaataagaccttccaggacctcctgctatctctctccacaaccttatctcacatcttgtccttcctcattctgtatgctctagtaatcatgaattgcacgctgttctaaacacataccattatctttcctgactcttttccgatgtgattttattttcttggaaagcctttccctgtcctcttaagcaaactaatttctattcattcttccaggctaattcttaggcttacctcacttgtcacctccttcaggaggcctgcctggatttaaccccgccagagccaagctatgcttcctccccggagttttcacagcaccctgtgcacttctcttcaccacttgctctgtggtgatgagatactgcattgctgtgtctatctcccttcctagcttgtaaactcaaaatgaatgagtaccttaggatcttcctatgcacctggcacatagtaggcacttgataagtttgttgaaattggaaacgtatgaacacactgcaatttccctcacattgaaaaaacaacaacccaaacctccatgtcatgccctcctccactgaccactccactgctcccctttagaggtgcattcctagaaagagttatctgtgctggctttctccactgcctctcctcccattctctccagccagcttcctcccctgcacccctaatgaagattgccaaaaccatctggtgacctctcagactgcttactacctgatctcagaggcatttgacacagtcggcctctgcctccttcctgcaccatgcgctccacatccctgttcctccagcctcgccacctgttctttctcatgtactttattgttgcctctcatcttccagatccccgaatgctgcatcaattaacattcagccctgggtccgcctctccatctgcacaaacttcctccatgatcttgtccagatgcctggcttcaaatgccatctgcatcctgacggccccacagtgacatctgtagtgcggccctgtgcccggaggtactgactcctaagtacaactgcctgctccacagctccactcagatataaataggcagcacaaacgtaatatgtctgaaagagaactctccatttcctcctccaagccctgttctggtgtttcccatctcagtaaatggcacccggttgctctggcccaaggccgtggactgttcctggtgcctctctttttctcatctctccccttaaatgcatcagtaaattcccttggctgtatcttgagaatacatccagactctgacctcctcacctccactaccacccccagtataagccaccatcacctcccatctggatgcagaagcctccagacaggcctctgccttcactcttgccagactcacctctctccatgcatcatccagagtgatcattttaacacatcggttcattccaaagaccctacacgaaacttccaatggattcccatcatacttagaatgaaatctaaagtccttcccatggcctgccaagtccggcatgatctatcccctgggtgcctctccaaactcatgttctgccatttcccccttctctctctggagtccacccccactggcctctttgcattgctcaagcaaaccacacaccttcccaccttagatcccctaagctgtcccccagcttgtgatgctcattctccaggagctcactctttttctttactcaggtcctgcatcatcccctcagcaatgttgacactccctggcacattcagaaggaattattctcccccatcatcacttccccaaaagaaacctggagcccaaattattggtgggagtttaagatgatatttggtggggtaggaagtacacttacagattcagagaatgatgaaaagctgctcaaatgtgcagagtggagcacaaagccttaggggtaagacctgcattgcctcagagggcccagtcagccttcttcaagttttcaagaaaggcaagttagaaaggagtatatcatcacctgtttagatatattttcccacaccctgtgctctattccagtggttctcaagagaggttgattttgcaccatcactctccaccgccagtggacactggcaatgtcaggaggtagtttgggttgtcccagcttgggaggctggtactactgggcatctagtaggtaggagtcagagatgctgttaaacatcctataatacaccagaaagcaaacatcaacagtgctgaggctgaggaaccaactctattcttttgagaactgcaaaagactccttaaaggaacttaacccatgcaagtcctggtccattaccagggaagcagtgtctgggaaagatccaggaagtatcagagatagaaaacatgactgctacagaaagaatcttctagaactcagctgacacaaaccacctggctgtcaacctacaggtggtaggcaatgcataggtgaatgcagtccccagagtcatggcttgggaaacaggacattacaatggtgtcctggaggcatccaggcatggatgcagttatagcaaccctctggcctcattcactgacccaacaaaatgtgtgaacccccaaaatttgccagtacagtgcttgtttcgacagacgtttgtgctccagaagatgccatagtggttagaagaggcctttatagactaacgactgcgtgcagggtttttaacagacctcagtgtcctgccacatgttcctgcatctgcctcagcccccacctcctcaccaaaggcacaagagccaagcacattatcaccaaatgcccagcctctttacagtgcccagtacaccatgtgatcagctctccaggcaggaagacccagctttgggtctcccaagtctgaagcttatcagggagtatttttcatgctgagctgtgatgcatcaaaagatgcagaagccaagaattaagcagaaggagatgagtagcctgatctgttggggcaacagatcaagaagaagagactaagaaggtcacccaaagcaggagaccccttgaatcaatccttagcagcccaagtttaatgccgggaaatcaaactgccagaaatgccctacagagccttttcagacttggcatattgcctgggtgctgcactgagggtttcgctcaatttttatatcactttcgtataaaaggattaactagaaggcttttaaagtcttttctttcactatccaaaatgtccttccagagtatcattaggtcttttattttcttggcttggcaaactatcccgcttccccttccataaatcgtggcctgtaaataagagattcctcttgcagacttcccaactgcatttttttgtcattacaaaaactgctttcgtttaaataatctgttgaaaaatacactgaaatcattacatactaattcctgctaaaacatgttccccaacagtagttcactagagaaactgaagagggagagaaggaagggagagggagacctgctatttcagccccttgatgtaaaacatttgccacatctttccatacattgactcagcccctaaattctcctctgcagtttgtgctttctgtccatcttcctgggtagagacctactgcagctattggaaatttgagcaattaacctagtcaaacagggttcaaatggtataagacatttcagacattttctgtgggtttgtatagttgcgctccactgggataaaaccagatgataattttcagtttaattccattcaacaaatcttaattgagaccttaactgtgccaggtaccatgatacataaatgctgtttgtaagcagagcagaagtttgcagcaggaaatttcaggctagccactgtcagcccaatccacgttttcactcttcaattcagaatgggtttttaggcctagggttctgagtgtgatgtaagaaactagacatgccagtctatggataggaattcattagactctcaggtggactgacctccactagtccttgtacaaaggacttttagcatcttagcagctgtcctatacagtaggtgccaatatgattcccattttgcaggcaagttaactgatattaaacaggtgtcccaaagtcacacaggtcacaagatccaaaccaaggcagcctaacatcagaccttgtgatatcatcctccacagcacattgccttccttgaattgttggcaaatggcccgaagaagagtcaagtcaacaaacagcaatgcgctgaaggggagggttgagtctttttggggcctttaagccacttgggaagatgggctggaaatgtgtgaaactcaattaccttttgaactctcactaaaatgtgcaaaacccagatggaactatgagaaatccttgccaataacattagctcccttcagatctcctgccgtaagagccctccatgtgtttttgaaaggtcagagtggctgtagttttcttcagcgtaggtcaagttcatctcccagacatctggggaggtgctgatgtgcgcgcaccaagagtgacatttgctcattcccagttcacagtcccagtgcacactgggtccaggcttcccctcaggatctatgagcagaaggataaggatgaaaaacatatatgtttccatcagaggggaaacggctgaaccaagcatagagcattcctaaaaagaaatattttgcagtgtattaaaggataatgaaaaccactatttgcatgtatcgagggtgtccgtactgtaccgtggtgggaacatgatggcacagaggtcccatctacgtatgtatgcccctgctctcaccaactggtaatcaggggaagagtcatctcagggccataaatgtcaccttgggtgacagagttgactcacttttttaaaaatattttatatatcacttgtattttactttacactaaaaaataccaattctgttatttttctttggcaggagggaaggggttgatgataccaaaaacaaaaacttgcaacatactaaaaccaaggatatgaaaataacttatatcagagtccaggaatgttcccacaaaccacagagttgtggtttggattgaggaatctaaccatgaactgtctgtgctcttcatctgaaggaaaacagagcatgctttccacaccaaggagacttggacttcattgatcctcaatagaaaggatttggttgttgttgttaaatgtgggttcttggtattttgctatattgctaatctttctgtggtctcaggtctaaatgggtggaaacacatctctaattgataaataaatagaaaaatatgctttatgtgtttcttaaaagtcaggaatatgtcttacggtgatggcatgtcagaatctcctgggaggtttcaaattacaccgaaaacattgccagagagagagactcttccccctccactgcccaggggaggctccattcctgacccatctgggtgtggctagaatggggaaaaggctgggacccaccacccgctgctgggaggttacatgggctgacccgccttgcctcctctcctcagccacgtgtgcatgtgcacctgctgggtacctgggagctgaggtctctcttgtgaagaggagttgaagggcacccatcgttggaacttagacacacatgggaaacagcagaaagcagattctgagcagggacctgggggcccttcagatacaatggcccccatgagaagcagaagaatggcctagggagccagggtgcccaacacagcctgaggggtagaggtgaacatggtagctgttccctccacccaccaggccctggctgccctagggattaaaggacggtgagcaaacttcaaaagagtccctgtaaactcttagggcccaggcaactcctccgcgaggcccctctaagacagcaggacaacacggaggagccactccctcctggcaaagtaaaactgagcacaggccaggaaaaagcacagatgcggggctgcagcctgggcaggcagcggcggcaccagcacaggcagcgcatgaaccacacgtctgtgatgtgctgagttgcagaggctgagacggtagaagctgcgttcaagcatggccgccagaatgtcagcgcagaaaaagaggggagcagtgctacaccccaggagcaggggtggcctgcaacatcggtcgagactcctgagatccatggagagaaagaagtgagcaaagccctgcaagctcacacacacaggctctcgaacggggccctggggcccggtatttaagtaacagattcacacccacaggcagagggagcggctccgctactcctgtagggtcttattttactttatcctctgaactctatttatgccaagtaacttagctcgaaacctcagcatttaattttgcttaaattattgggatagtttcttcatacctagacacactatcttagatccagagactaaggaaaagtattttctttctgtctcatacttcctcctcgtttgtgacctgtgttaacagctaatgtaatcaacttccccacaggcaattgtttagtttaggggagataaatatacaagataaataaaggaggtgcaccattactagaaggtgttttctcattcatggaattgcacacacagcaattcatcagctattgttttattttccttcagctattgttttagatttgaattgtacagttgctgtattttgctttatacaaatatgccccagatcatagttcatggctctggaatatattttatggtatatatgggactggcttagagtcatcccgtctgtggttatgtaaagccaaaccacgttatcatagctttgttgcacagttattttttttaaaaaagctatggcttgtttgttgcccatgtcagtccgagaaaccagtgtaattctgactttggaaattccaccttatggtcttcccaattcaaagcaaatatacaattctctgttggcagtctgcgctgcagtcccctgggctaggaaaccccgtcgccacaccccctggttgagaggcatgcaacagtgatcccacccgctggttgagagtggtccttgctgcaaagtggtccttgctgcaaagtactcgagactcagatttcttccctggttgctcatgattgatccggtgggcatccaacctgagttagaacagtcagagaatcatgctgaaaatttagacctaggtcagagggagtcaagttggtctctcttgcgcttgaactctggtatgtaaaccacaggaggtgttggcagtgagagaggagaaatgagcttagaggagccaaagggagaaactggatgagggagggcgatatcactcatgtccctggagttcctgaggcccaactgcattcctgaccctggattccttgagataccactgtggccttagagggcttaagctggttgaagattacctgaaccaaaatatatctaattagcacaagagatgttggtagctaacataaaaaactaatagcaaaaataggtaacaattaaatagtgaagttttccagaagaagaaactgagaagagggaggttaaatgcttgcacaagatcacacaccaggcagcctggccccagaacccagagtagcaacctctccatcgctcacatctcaaaatagacacagaggaaaaggcctggtctggtgtcaggcagatgtgggtcagtttcctcgctgaaccacttgcctggggctaattattgaccctcggtttcttaatctgcaaaatggagatgaccaaaaccataaaatagaattgttgcaagggtcaatgagatattgtaaataacgtgccctttacccagtaggcatttgataaaagttacttctaatctgtttccaatttttcatttataattaaccgcggtgactagaactgacagaatattgtgaagagtggtagtaacaagcatcagtatttttactgttaaatatattgctgagatagatgtgctttattttgttaaggaagcattgttctattgctggtttactacaaagatttttttttctccagaaattggtgatggatattttcaagtaactttccagtttgtaaccaaaaaaaagtggtatgatttttgtcttttgaccttatacttgattttagtaatagaatttttaatactgaactatccttatctaattgaacatccttaatcattttgcattattctgggaatgaactagtaggttcaattctcttgtgttaatttaggatttatgtacaagtgcaatttctctagttttctttcttgttgtatcttttccaggttccactttgtgtttatggtagctcacaatgatgaattaagaagttttccacccttttctgatttctggaactgttgaaatagcagaaaggtttactgtccttgagtttttgaaagaacatgtctttaaaaatatgtatatccagtcccagtatcaattttggagatagtcctttctcctcaaagtttcctacttggcactgtggttatcggtctatttaagttttctacatcttcctgaataaatttgaataatttttattttgctagaaaatttgtaattcattgagatatttaattttttagcactaagctgaaaatagtaatctcatttaatgttatcatttatttcatatctgcatatatttactacctgctttgattcccagctctctttactggaccctcaggggccacctctaagtgcggaaccacgggcccatcacctctgtgctgacctttagtcttttcctggtttggatcatctcggtcatctcgacctagatggccacaaccctactatcatgttagaagcattggttacaatgccctagagtctatttagagtaggtgagccaatcttctattggagtagaagataactgtttttatacacaggttgtggttactgtcttggagactggtcagttatggggtggtcgggaaagggcacccaggaatgaagcactggtggggtacccaggcccaaggacccattgtcccagaagccccctatccacagtgccccatagcactttcactgaggttttgtttgactctagtctcttcagagtcaataacactagcatgttatttcatggaaaaagaatcaactacttcaaacataccaatttgaagtgtttttataaatatatttattctgtggaatcagataatctattcattttaacatctttatagcagctatagagtaggaaaccctctgagtctaaaaagagccacataaaaggcattggagatagattagttggaaattccaccagggaggatctgagaaaattcaccactaaatccccgataaggtgaaaacctacttagagtggacaccaggaagactccagttatgaaagtaggtgccagagataggcaaggcccacatggtggggaaagcataggatgctagaccaggcaggcaagaagctggtttaggagcaggcaacaatggaaccaagcccaggtagcctcagcattttgctaagcaggttacttgcaaaatgctcaggaagtcaatgctccgacaagcatttaaatcagtaaaggcacttacatctggaggtggccagatctgtatggccagttcttcttagcagtgacctcgttctgtcttttatgtggctggcaattttaaagagtgatgttcattcagcttatctcttaccatattgtgattctatgtaactcttccccactatctgcaagcacaactgccatatgggctccatactcaaaccctccacctgccagcatggaccttaggtaatgtagataaaatgcttgaatgggtaaggacgcacatccagaaagccctctgtgtcactggatctgggtcctcttccagttcagtgtgggctttttatctaagatttctgaattccccttcccagtgcttttctcttcttgggtcctcattctccacggtctgaaaaaggttctggaaaaatgactcgagtctgctacatggctggaagaggaggcttcctttagtccctaacaagcacacagggattgttcatggtaaagcaaaaggacaagaacaggtgcctcccttgtgtcatcaatgagaagattccttaagcagcttaagatgaatgctcaaacacatcaaataaaagtgcaaactaaaatatttaacaatgtaaatttccacttaccgatttctctgccttgtctgtgttccaggttcaggtttagcggtcgcatcctgggtctggctctgatccatcagtaccttcttgacgctttcttcacgaggcccttctacaaggcactcctgagactgtaagtgctttgcagaccatgcttccaacccagccctgtctgcagggcaaggacaccgacctctctggtgccactgacccttttgtcactattttgccctaaccattcctgttagggttatggtggcttcctgttctgagtgcttagatatcacttacattttttagcacaataaaaaggtatttggggattttgttgttgttgtaagggaagattctattatcaaaatctcatatcatggagatgaatcattttatataaaattataataatattacaaacattgcattaaactgttaagtagaactgatctgtttatagcataactgttttaaaatgatagttttctccaattttcatgcagagtccctgagtcaatagttatttcatgtttgttattgtaaacaatttcacatttccttttcaaaggaaaatcattgaatgaactaaaatgactgaataatctgattcatcagtggattcaaaagtatccaattgttaggataagtctgtgatgttttagccaggaatgatataaccacattttgaagtgaggtctgggcagccatttgtttggtaatttgcctttctcactgaattcacccaggccctgtgatttgagtgacctggaatatttggatgaggaattccaccagagtttgcagtggatgaaggacaacaacatcacagacatcttagacctcactttcactgttaatgaagaggtttttggacaggtttgtgtgacatggggtttggaaaagggattttgttttttactatggaaaatgcacataacataaagttatcatcttaatcatttttaagtgtagacttcagtgcttcagtatatccacattgttggccatccaatctccagaactttttcatcttgcaaaacagaaactgtacccattaaacaataactttccatttctcccacccacaactcctggcaactaccattctattttctgtttctatgaatttgactactctagatacttcatataagtggaattatacaatatttgtttttttgtggctgacttatttcacttagcataatgtcctcaaggctcatccatgttgtagcatgtgtctgaatttacttcccttttaagactaaataatatttcattatgtagatatatatgtatatgcacatatatatacaaatatatatagtattcttcctttatatgtatataaaatattccttcctttttaaagctgaaaaatatttcattatgtgtatattatatatatataaacaaatatatatacatatatgccatattttctttatccattcacccatttgtctgttgatgaacacctgggtttttccaccttttggctattgtgaatcatgctgctatgaacatgagtgtacacatatctgttcaagtccctgctgtatagatcaattcttttggatatatacacagaagtgagattgctagatcatgtggtaatgggattttgtttttaaattagcgaataagggatctcattcattcaaaccaattccttgggaactacttcctttaataaatctgcccgtgtcctctttcttctttttcttgttatgacctggatctactttatggagttttttgaaaatcagatatgataatggatcagaaagcatttttgtgaagtacgtcatacatacgtcagggatttctgctatctgtgccattacagaaatgattctttttatcacatccagatagctactcctccaaaatacatatatctcaacactaaataataagataaagtttcccatttgttttctactagcatttatataacatcaaatcttcggatcaaatgggttacaattttaacagaaaataaccatagcctgagtagatttaacaaacaaggtttggggaacctcattttctagacctaaagtctgtgacataaggtaattcgtaacagcggttgttgtgatagttaaatcagaatgctttagaggtgcctcacatcaatgtggacagtgcactgggtcgctgcatgagaatgaatgaatgctgcaggccaccaagcaccgcatcccagtcaagaatcttggttaggtcctggaaaatgtcaacattctgttgtatttcttctgtaaaaacatgcctctgaagaatgctgtcttacgtatttgagaaaaaaatatttcttcctacaactctggagagcacatttaaatatgttcaagaatatgctactcatggctgggcacggtggctcacgcctgtaatcccagcactttggaaggctgaggtgggcagatcacctgaggtcaggagttcgagaccagcctgaccaacatggtgaaaccccgtctctactaaaaatacaaaaattagctggggatgatggcagacacctgtaatcccagctactcaggaggctgagacaggagaattgcttgaacctaggaggcagcagttacagtgagccgagatcacgtcattgcactccagcctgggcaacaagagcaaaactccatctcacaaaaaaaaaaaaaaaaagaaaaaaaaagaaaactactcatttaacttccctgccatgtactcactgaacaggcaaaatacactgttctctgtgcatgactacttttagcccatctttcacatatgccctattgtagagggtaagtttgtaaaatatacacaattacttaacaaactgtattaagacaactgggtagccatctgtaaaagttttaagttagatccctaacctaactcatgacactaaataaattccagctggatcagaaacctgaatgtaaaaatttttaaaaaaggaaaaaagagataatttttatttttaatcttgcactaaagaatgctgatacagatatcgcacaaattctcaaagtcatagaagtcatctgacatagtcaaatattatttttaaatttctgcatgacaaactatactataaacaaattgaaagcaacataatgtttaatacataacataaagactatttctttcaatatcagaagagatcccacagatcaataagaaattatcagtcaacaacctaatagaaaagtcacaaagaatatagatagttcccagaaaaggaaagacaaggagataatctcatttacaattttttaaaataaattaacgctatagtgagataccattttccctcattagaatgtcaagaatcagaaaatttaccagtattttgggatggtgtagagaaacagaccttcttgtccattgtaggtggaagtgtgattcactctctatgaaaggcactttggtgatatcggttcatattttaaatcacatgcctttgactcagcacacgtctagaaatttgtcctaccgatacattaacacctaattaaaattactaatatattaggatcttcatcacagccttgttgatagttgaaaaatatctgtaacagtctaaatgtccagcagtagagcactggttaaataaatgatacatttactaaatgaagtagtgaaatcatgtggggttattaaaaagcatgaggacaccccaacccctcaattcacatataatcatgagcaataaacagggtacactaacaacaataaagaaagaaaaacacaggtctaaattggcatgaaaaatgtctaagatatagttttaagagaaaaaggatagtgaagaacagtgtgtaaaacacactactgtttacagggaaaaagagtttatgttgatcaggcacagtggctcatgcctgtaatcccagcactgtgggaggcagaggtggaaggatctcttgaagccaggagttcaagaccagcctgggcaacatagcaagaccccatctctaaaaatttttaaaggtgatatatatacattccccagcatatgcatagaatctccctggaagggaagtagagatgactgtctccagaaagggagattgcatggctgggaggttaggtgggagaaaaactgacttttcattttatggccttctacaccacttgaattttattccatggccatatactgtctattcaagaaaacgaagtcaactacaaataactgaatgcataaaattagaggaaaaaataaagttgaagatacagaagaacaatcctctagtgtaaagtgtaggaattcgacaacttagaaaaaaagcttaaatgttcccagtgctaaaaataagaatgtgttgtagatctataataatgtacagttgacccttcaaaatgcaaaggttagggcgctgagtcctgtacagttgaaaattcatgcataacttttgattttccaaaaacttaactactggtagcctgctgttgactagaagtcttattaataacaaaaatggtcaattaacaaatattttgtaggttataggtattataaactgcatgcttacaataaggaaagctagagtaaagagaaccttattaagaacatcataaggaagagaaaatatattttctattcattgagtggaagtggatcatcataaagtttgtcttcactttgaataggctgaagaggagcaggaaaggaaggtttggtcttgttgtctcggggtggaggaggtggaaggggggcaggagaggcaggcacacttggtgtaactttatggaaatacatcataatttctgtcgtttttgctttttcctttctctaaaaatgtgtctatatagtaccaatcctttgctttagtttcagtgcccatatctagaaaggttcattatcataaaagaagtcaaaagcagtcaaacaatcagaaccgttctgccagattgtctaacatcgatttgttttctggcactgcttcttctagatcttcttccccttctgaacctggcactggttcagaagcattcatctccatcaagtcatcttctgttagttcctctggcgtggtgtctgtcagctcttgaatttctccaagatctatatcttgaaaccctttacccccaacctttttttttttttttttttttttgccatatccacagtctctttcatgatttccttgattggctctgtcataaatcctgggaggttatgcataacatttggacacagttctctccagcagaaatttattgtttggggcttgatgactttcatggcttattctataacatcttcagtggcataacttttccagaatttcacaatgttctctctattgaagtcatccatagtgttgacatcctttccatagagtgtcatgtgtaatgagacataaagttcctatgactcctgatctaaaggctgaattagagatgttgttttggggggcaggtagaccactttgatgccttggtgttgaactcaaggggttctgggtggccaagggcattgtccaatatcaaaaaaaaaaaaacaaacaaactttaaaaggtagtccctttctggcaaggtacttcctaacttcgggaacaaagcactgacagaaccaatccagaaaagaggttctcattatccaggctttcttgttggcagctggtgttatcttttctcttcaaggctcgggggttaaagctttaatggataagggcaatcctgatcataaatccaaatgtgtttgcacaaaacagcagagttagcctatcacttcctgccctaaatcctggtgctcacttatcttccttactaataagggacctttgtggtgctttttttccagaacggggcactttcgcctgcattaaaaacctgtacaggccgatatcctttctcctcagtgattttcttaatggtgtctgggaattcgtctgctgcctcttggtcagcacgagctgcttctcttcttatcttgacatttttttcagccaaacctgtttctaaaattatcaaaccgtcctttgctggcattaaattttccaactttagatccttcaccttccttttgctttgagttatcatataatgactttgctttatctagaatcatattagagtctacaggtatgtatgccattgttctagcaatactgcactcacataaaagctgtgttttcagccaggcatggtggctcatgcctgtaatcccagcactttgggaggccaaggtgggcagatcgcaaagtcaagagatcgagaccatcctggccaacatagtgaaaccccatctctactaaaaatacaaaaattaaccaggtgtggtggcacgtgcctgtaatctcagctactcgggaggctgaggcaggagagtcgcttgaacccaggaggcagagattgcagcaagccaggattgcgccactgcactccagcctggcgacagagtgagactctggctcaaagaaaaaaaaaaaagctgtgttttcaatatgagataaaaagatattccacaaaaagtgccaggttttcacacctgctggcatagctgcagtgatggcttcatgaatttcgttttccttttttacaatggtccctatgctggattcatttattttgaaaagatgggcaaccacatctgcagacctcaatctatggtgcctatcaagtaattcaattttcccttgtaatatcatgatttttctctgcttcttgggagtatttccagcatcattagtggcccttcgtgtgggtcccacaatgttattcaaagtttacaatattgcacttaaacacagtggaaaatattcagtaaacaagaaagatcactttttactgtgatacacagtttactggagagaggctattcatcagcaacacttgcgttcatcgcaaaaaacagcaggaggtgactacaaaattattacaatagtacagtatgtactacagttaattttatgcagttatgatttaataccgcattttgatgtttgtatttgtctcaactgccagtggcaccatgtacaggctctaagtgtttgtgtgtgtacattttcataaattttaactttttaataatagatttgtgtacattttatgttagtaaatgataaaatagactagtatctacatatattttatggactcattacatttctaactttttttttcattttaaaaaagcttctattaattttctaggtatgcaggtcatctgcgagttttttcaaattgttgtaagtctccaaaaaaattcccaatatatttattgaaaaaaatccatgtacgagtggacccatgcagtccaaacccacgctgctcaagggtcagcctgtatacctgtttaaagtttatctcatttctcttcaaaagggggtcaccaagaacaatgagtggttttagaagattgaattgcagcccttcttttgtcaagttgttagacagtggagagcagagggatgcaggtgaaagacaccgtaggctttaggattagattcagctactagtgaagaagccaaaaatgaccctgttgaaattaatagaagctttttttttctcatataaaagccctgttgaggctgagtgtggtggtccacgcctataatcctagcacttcaggaggccaaggcgggtggatcgcttgaggccaggagctcaagaccagcctggccaacatggcgaaaccctgtctgtactaaaaataaaaaaaaattagtcaggtgtggtggcatgcacctatagtcccagttacttgggaggctgaggtgggagaatcgcttgagcttgggagagagaggttgcagagagctgagattgtaccactgcactccagcctgggtgacagagtgagaccctgtctcaaaacaaaaacaaaaaaagctctgtttgataaaatcctcagggatcaagctccttccaggtctccccactgctatcgctagggtaggccccctgcactcttagcccagatgcgtacagcatcccaaccatcacaactgtgttcagtgcagccggacaaaggaacacacagcccatcccttcaaggaggcctcctgacagtgccatacacttctgcttacatcccattggacagaatttacttacatgccacacctagctgtgagagaggttggaaaataaagtctttaactgggccgctaaaaatcagacattccaaagaatatggatgctgggtggtaacaagtattttatcattagccaatattttataattggcactaatcacctaagtgataaaagaaaaagtcaccatcagactacttatggactgctttgtttaggtacctgtgtccacaagtgccaaacatatatgtatttttttctttaaaccagtaactaagtccagtgatgcctcatttgtcttgcagcattgagcattgcagtgagcccttaagtgaatttaagatgactgaagattacccccttcatacatgaacatattttgattttttaaaaaatgtctagcatgttatctacctccttgcctgtgaaaagatgatacacagataatagccttccctgatgactcaagcatgtcctaacaaacaggcatcatcacacaagtggcagcgccatttgctgtgtgtgcctacatgcttctggttcccttcccagggtcaggctgccctggctgtgtaatattataccccaccctctgccagaagaccactgtcttctggccagctgtgggagtggaagctgatggctgttaagaatttgctgtcattgagatttgggggcatcaagtatgtgattgtagtgttgagacattcagcttcaccattagggacaacctaggacattttccttttatttccattatgcctcttgagtataggaaacttgtttcctctgtataaaacaaaaactgtagcctttccaaggtgcttagcaatctgcttagaggtcgggtgcagtggctcccaatactttggagttgggaggatcagttaaggccaggagttcaagactagcctgggcaacatagaccacattctaccaaaaaaaaagaagaagaagaagaaagaaaaaaaattaaccaggcggagtggggcttgtctgtggtcccagctactcaggaggctgaggcaggagggtcatttgcccccaggaatgcagggctgcaataagctatgattgcaccactgtgctccaatctgcttagaacagccagagctcttttagtgacctttagcaaggaaaaaagactccagggataataatgctgaataatgccctgtagaggatttttggcatacggtcatccccctaaaatcagtgtgcctccctgagagataagcagaactgacaagcatcgcaatatttctgttttcctacaaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggtgaggcccggtggcctggggaaggcaagctgtggccagggtgctgcttcacggggcctcatcctccaggctccctgagggagcagcagctcaggtggtgaaaacagagagggagagccaaggtgggcagtgggctcagcgagtgctcctcaccagggagtactgaggatcttcttgtggtggagggctgaggggtcagagttctctgggaaactcaactcttatgggtgaaaaatgctttcaagcaactggcatgtgaccctggcgtgccagacgtgaaaacatctagcatctcttgtcacaatatatgcagctggtgtttcctttcagtcaatgaaacaaaaataagtgaagtgaagacattggggggtattgtccactgtcactagaattttattttgttatagcatcatgttgtgccacgtaatctatgctgagtggtaaatgaggaagacagggagggccgctagacatcctatgatgtccttgaactccagtttaaaaaccagaggctataaacgttttctcaggtcttgggtcgtggaaggctctccttccctgccagaatggagaagtgcactggccatggtcttgtccaccactggtttgattaaaggaggtaccaccacaggacctcagttgtgcctgggtacacttggcacaagatgcaaagtcagaatgcagaaccctaacaaaacaagtcttcccagatctctaaggagggaggaaggaagtgagagaagaagagaaggaaaagacaaatttccacccagctagctcagtccagtgagcatgaggcttttaatcttagggtcatggtttgagaagggatggaaaatacagtcgttttaatacaaatgctcaattttaggaaataagtcataattgcatgtgaaaggttacattttaagtgaaatagtaatactaatagctattaaataagtccttcaaagtgatgtggactcttggcctttaaaatccaatattatttgaaaacttcaatgtgacttaagaaagtcgagtcagatttgtttacagaatcattctgagagggagcattaggagtggagcatgcgattcttttttctgttccccgctcatgaaggcttgtgttctaaaatatttaagtcaatgatcatcgttcaagctgctataacaaaatactgtgaggtgggtggcttgcagcaacagacatttttttctcacagttttggaggctaggaagtccaagatcaaggtactagcagatttggtgtctggtaaggggccaccttctggttcatagatggtaccttctccctgtgtcttcatgtggaggaagggacacggggtctgtcttgggcgtgtttaataaaagcatgaagctctcatatctaagcacccccccaaaggccccacctcctaatacgatcccctcaggggtgaagatttcaacatatgaatttggggaaggaaaaggatataaacattcagatcatagcaataattttcaagttaaaaatgattacagactcaaaaaaagtattgccagtgatggtcaatttcccagtttaacccacataaatataataatgaacatagcctttccatgtgtttggacctggatgctgaagcctaacctgcatttcaggttgtagactcgaggctggtgtccgtgtttgatgccagggagctggagctggtgatagctggcaccgcggaaatcgacctaaatgactggcggaataacactgagtaccggggaggtgagtgggcaggagctgtaatgatgcaatgatcacaaatagaactcagcactttccaaaagattgttttgttgaggtgaaattgatgtaaaataaaattgactaaagcgaacaagtcagtggcatttagtacattcacagttttgtgcaaccattgcctctagctacttccagaatattttcatcaccccaaaaggaaaccctgtacccatgaagcagttgctctcactctcacgcccctttcccccaacccctggcaaccatcaatctgccttctgtctcaatggatttgcctattctggatatgccatataaatagaatcatacaaaatgtagtctttcgtgtctggcttctttgacttagcctactgttttgaggttcatccatgttgtatgtagcatgtttcagtattttattcctttttatagccaaataacattccattgcatgtatatataactcatcactttttgaagactacaaaaagcttggccttacttcagtacaaagcaggagcttgtacatgcctttctccaactcccaacctgaactttccttcaggtgacatcgtcctcatattggtcgagtctctggcttaactcgatgtagaggcttgcagagaacattccatccaggacccagctcctgagcagtgtgcatggctccagggaagggtgtctcatttcctacagaattggagccctctctgcctcaatcctggtttgccacaacacggttctaaccgtggccttcaccaaagctaatgtctaacccttcctaaatactcaccttgcacactgccagacctgtcttcctgaaacattgttttcatcaggccacttccctacccacaaaacaagttccttattacttatagatttgaagggttttgttagcctcacaactcttcatttacaatatcacagagaaatcccatcaatacagtagagagtgagctgggggcatcgcctcagcctccctcatgtccccagtacactcagccccgcaatgcctcttatagtataaaatcggtatagaatgaaaaccgctgtctgcctagctgggcatggtgactcatgcctgtaatcccagcactttggaagaccaaggcagacagattgcttgaactcataagttcgagaccagcctggtgaaaccctgcctctaaaaaaaatacaaaaattagccaggtgtggtggcacatgcctgtagtcccagctactcaaaaggctgagatagaaggatcccttgaacccgggaggcagaggttgcagtgagccaagatcatgccactgcactccagcctgggcaacagagcgagattctgtctcaaaaaaaaaaaaaaaaaaaagtctctgcctggctgttaaggccccataacaccccccggaaatattccttcctgccttcaccagacacacctctactctagtggcttactgttgcctgcatatttcctcctctttcttgttattctttatttttcctgccaggaatgtcctccttcttccctccacttgcacaagccctttgcacgctgctcgtagcttcacttcctttctgaagttttccttgcttctaccttggcacacatagatttctcctctctctgaatgcctcttgcatttgcagtcaatggcaaatcgtttaattgatatatccaagcatggtctccccagcttactgtgagagggacccagtacttaatccatgggcccagcatgtatccatccagggctggcctgagagcagctgctcaaggggagagcctgggatctcctgttcacgaaactggctgttcgcctccagcctagactggtaagtcctagactctcccgtggtatgtggttgccaagagctaagacagcaaaacaaaggaaatatgatgcaatattatattcataggccctttggtctctaccaggcccttctactccttatctacacctatatgaggcaggaacattttaagtggagtctcagttgtttaaatagaaagcagacatctctgagaacatcacagaacataaagtccttttataaaatgactattttctaaatctgctcttgttctaaaacttgacctggttgcacaaattgttttagacctctctaaaggccatcacaagagaaatcagatcaaaagcagcggttccgttcctatcatacctgatgtgtttgatctctctctccctcctcaccccttcctcttttctccacatcctgtcttcctccctccctttgcctcgtgcaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccaggtacagagctcctgccagccttcggggaaacctgctgaagagggcaaagtatactttgctatttgattttgagtgaccatcctttgggatggaattctttcctgtcacccaaagtattgtcattggagttattagggaaaggtgaaggtgaggtggctgtgagacttgcactgaaactatattattcttagggaggttttgatgactgatggtatttgagctgtaatatcttggtccatgtgtcagttgtgggatgctgtcatagcccaacttaatttaaagatgaatgtctgacacaggagagggcagaggcaaggacattaatataaaaatgctggaacctggaagtaacctctcgagcatcgttatctgtacttctgcagcgtatcacttgatacttcataggatcattatatatttgtggtgtgtcggatttttcctatcaagttttagaacatgtggggatacatgtatctctgggtctctatggtgacttctatttagaaagcacatctattgtgggataaatgtggaaaaggagacgctggggctccaggcagttttacagaagaaattccctgcactgtgagttttaatcccagcacttcctgaatcctttctatgccactctgggtagtgcattcctgatcaggaagcactgaagagacagttgtgcataggcgctatagtgagaaacgctgctgcaacagacagaagaaaagattgacccctattatcttttgctaataggatacgttcgaattataaagaagctttgcatttaactcagctctatttctacatggccacccaaatacctttgctaaatccttattgcagaaggatttactggactatagctttcacctaggtttcccagattttccccgaggacaattcacctggtgtcggtcagcattcatgggcatgcccagctggttaaccacagctgaacaccctggtgcaggcttcagccctggcttcacccactcagttcagcagaccctcagttccaagggtctttgttgtttgcatggctctaccaatagctaaacctagtgaatgtaagtctggcaagaaaagaagactaaaaaggcagaatttgcatttgttaagttgaatgatgatttcaagaatatagttatttggaaacatcttgcttttattttagagaaatgcagcttgagtcatcactgatgatagcatgcagcttgaggaggggctgagctacaaccacacacctgcccgtgggaacctgcaatctagggagaacacggcctgatagtaactaatcacagcacaaggtagaatcagaggagcacagggggtaagagcagcgtgctgcgagagtgtgaaacagagcctcctaatcaagttgcctagagaacatgccactaaaaaactggcatttaggggaggattgggaggcaaggaatagggagaagggggcttccaggctgaagcaataacacaagcaagggctgagagcggggaatggcagcacgtgttcaggaaggtgcagctggccagtgcagagggtaagatgcccggagcaacatcacaggggatgcagttgagaaagagtttggtgagccacaaacaaaagaccctgctgtctgggcgcagtggctcacgcctgtaatcctagcactgtgggaggctaaggcaggcggatagcttgcgcccaagagttcaagaccaacctgggcaacaggacaagacctcgtctctacaaaaaatttaaaaaattagctgggcatggtggcatgcaccggtagtcccagctatttgggaagctgaggcaggaggatgacttgagcccaggaggctgaggctgcagtgaactgtgattgcaccaccacactccaggctgggcaacagagtgagaccttgtctcaaattaaattaaaaaaaaaaaagaaagaaaaaagaaaagaccgtgctgaggagtctctattctttaggaaatgagagtcattgcttctgttatctggggtcacagattgaatgtaatttccatatttgctttggaagctttgaaatacacattaatattattaacccacacagagagcttctaaggcagacattgggcttatgaacacgttcttcatatctgaaccaaggcacccctaagagggctgctgcaccacaagcccccgagatggtttcttggggaagtagggacctcttcttgggacaagaagcaaatgcctctaagaggacactgaaaataactccctgaatagtgacccctgtccaatctcctttggacaatgtctgaagatcaaagaacctaaaaaaatgtcatctatgtgtggatagaaagaaagaacctctgacttccagaaactgtcgttcgggaagacctgacctgactatggcaggtgacaggaagccctgagcaggcaggaagcaaagcagacccagggtggcatgggcttcccaggtactgtgagccacagtgcatgtggcctgcactctgggagaggcagccttcagctctttcctcaagtccttcctctgcagaaaggaaaggcaactggcttcccagatgagagcgccagacaccgccacagcaaaacccggtcatagcccaggctacataaaacctttgtgtcagtccaagcccctgcctgctaaaagatgtgtgagggccaggagaaaggactttgagggtagaggcttctgggatataatttcatagttgaagtagatgagaggcaggactgtcactggagttgaggtcaaggaactgggggcttgggtgttcaccctgtcagccatgtggacttagttgccacacagtctggtaggaggacttgaagtggaaaagaagacttcagcaaagtgccagataatagtcataataagttagaagttcagagggtcagaaggaaccaaagatctatctggatcactgattttcaagcttcttaaaccatagtccacagaaagaaatgccttttatatcacaactcaggacatgcacatgtactcatttgcacatatgtgtgtgtatatctgaaactcaagttcctcaaaacagcactttacccttattatctgcaataaaatctattttctgctctatcctatttcattaaaatgaaatgccagccaaaacctatggttttaaaaataaattatctaaatgacatgagattcaaaggaatggaaactgatcaaggattgcaaaagtcatgacgtggaattgacagcagggagtgtgaagaatgtccatccacgtcacagcgtgtggggcagtgagcaatttccacccatgagaactggagatgggacactaggacccggaggcagcatctggaaagagcttaaggaggtggcaaagtttctttactttgaacaagagctcaaaggaggacagaggaaaggctcagaaggaaagagaagggcagaagctaggtcagagtcgaagtagcactgggcagtgtggagatagaataaaggagaggggagaatctttgggtttacctttggggcagggaccagggatatcaaagctatgagtcatgagcaattaactggcctaaaagttgcaaacgaaattctaatatgaacatgtttcactgcagatgtaaactaagcccagacccagggtggagttggaggcctggttaagttagtagttggtttactctgtagcagtgattctcaaagtggggctggggaaggcgactttgcccctcttcccccgcaagaggcagttgacaatgtctggagacatttttggttgaggggaaggggtgctactggtgtccattgagtagaagccaaggatgctgctaaacatctcacaatgcacaaaacagctcccacaacaaagagttatcaagtttgaaaagtgaatcgtgtcaagctgagaaatgctgctctctagtacctaaggccagaagaggacctacaaaggaggcctgagggtgccatcagggagctcagcagagaaaatggcagccattgagaaaccaaggagaagccaaggagggagatgttccagaggaagagctgtcaaatgcttttaaagagctggagcaggtggagcggtatgggcttctggatttagggatcaagaggttattggcaaacttgaaaaagagtaaatttagaaggaaagagagcaaggcctatctgaagagaacaaggctgtagttaggcagtggaagaagattggcatgaagggaagacacaacttacataaccggctgaacaattggcagcaaagaggagtgactgctgccacttttgtgtgtttctagacaaccttaaagtggtctctagtagagaggagcaagactttctttggccctgtgttggttaacatttcaatctataacttggaaaaatagaggagacggggagatcaactgtgtagatgacacagttagaaggataaacaatacagggattggcacaacccaatccaaaattatctcaaaatgctggaaccctagcttgacaccaatggcatggaattcgacacaacttaaagacccgtgcagatctccaaaacatccatcgcaccaagtgtgagaagagagtgagtcacctgccagtaggtcacgtgcaaaactccagaggcttcagttgccacaagtatgacacggttccccaaatcattatcacaatcatggttgcattattaagagaatcttatgtttaaatgatgattcacaggttacaaaacgcatttatgtgtgttctggcgttgatcctccccataaccctttgaggtgcacgcagcatatattattatccccactttacaagtgagaaaactgaggctcaggaagattaattgacttttccagtgtcataaagctggtaagtgactagaccggggtcagcatagaagtcttccaagccctggtttcttgctgtccactgccccacaccaccgggcaatgcttggtttggtgcacgggaatgaggtaagcaggcactcggtgctgtcagaaccacacctggagggtggtgagctcttaggaatgctgaattggatcatgatttgattgtgttcgttcattctagatgacaaactaagggagttcaccaaggctctaaataaatgcaataaaagcaactagtaagtaaaccatgagtgttcagactaggtgctattcgtcaatgctttctgtttactcccagaaatgatcttttacagaattaatttggttccaactaatttgtaaaggtgattttttttctgtaatatttccactcatgagtgccagttaaaatgaccagaggaagaaaactatgaagatgatgcctgctcctatctcgcccctggctaattcagctagttccaaaagcatgcttgggatttttcaccccacttcgcctgtttagccatagcccaatgtatgttctagtttcattgcaatctttttaacatagagagaaatcactgtaaccatcctactcaatttactgagttccctttcactcaaatatttacatctaggtaaagtatttcaattattttcttttaaagtaaaggaaggcctgtttgaatcttagataataatttaagaattctgccaatctgtattcgtatgtttcttcccagttatgtctttaaggcctaagaccagacactctactgccctgtgcctgcctttggagcttgagcggggaaagggacagggaggagggaggtaggggttagggatagttccccaaggactgccaggaggaggaatgggtgctgggcagatgaaaacaccagcatcctccctagattctcgatgggcaggaaaccccaccttccctctttcctcttcccatcttccttattcccaaaataatctccccccgtaacctgagtgctgcatcagcctgggcagtgatctgatactctgatttatatactttaaaacaaaggtgtaaataatacacaagtcccctagggatcttgtaatgaaaagaagagtttaatatcccaaataaaactctaatgaagagtttagttttgtttgtttctttgtatgtttgttttgtgatttgattttatttgatttggtttgattttagagtgcccttttctgtgctggttggtgtctgaaaacaccatttcaacacaccacccttagggaggaaaaggcaggaaatgaactttcacctgcacccatccacctttctctctactacggtacaggactcggcatcagccaaagtttctgtaaaaacaaagaacttctggcagggagcagctagtcaggtgattcaaggctccacagcagggaatctatgtgtgctgggcttcttgtacccactgctggagagccacatgagtcttccaggtccaggtgttagcctctggcgaggaagacattccttgtctaaggcagacactggccatgcaggaggaagcacatgaagcaagctagaaccccgggcgccaggacactccaggcatccagagaggactggctcacacgggcagcttttcttggaaatgcagcacttcgactttaggttctgtgggttctactggggtagaggagtcagacttgtctccagagcacacttgacttgaatggagaactggatctcagaattccaggccatctcaggttcctctaaatagatgcatgtggttcacagaggctcagaaatcagagctgggcaagaagacttaggaatataatccttcaatactaattatatttctgcctccttcattgaccacatcaaaatttgtaactcatttgcaaatcaggctgataccatagagtttataatcagtttgctagtgtcattctagtgtagttggtttgcttgcaaatgcaaacaacccatttttagttattccattccttccaccagtctattcattctagaggaatgtggctctttagtgtgcaatgttttatggtggtcctaaatcatggtcctgctcacttttgattcctttttgaatcacaacttcagacagtcacagatccagaaccagttgtatcattgaaacaaacactctcaccaatctcttctccccattcagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggt

SEQ ID NO: 2622 - DNA, 8459 bp, Homo sapiens; identical to SEQ ID NO: 1191

SEQ ID NO: 2623 - DNA, 76726 bp, Homo sapiens; identical to SEQ ID NO: 1192

SEQ ID NO: 2624 - DNA, 76284 bp, Homo sapiens; identical to SEQ ID NO: 1193

SEQ ID NO: 2625 - DNA, 76284 bp, Homo sapiens; identical to SEQ ID NO: 1193

SEQ ID NO: 2626 - DNA, 76284 bp, Homo sapiens; identical to SEQ ID NO: 1193

SEQ ID NO: 2627 - DNA, 48838 bp, Homo sapiens; identical to SEQ ID NO: 1196

SEQ ID NO: 2628 - DNA, 107599 bp, Homo sapiens
atcatgataaggtggatgtttatttaaaacaaaaataagaagagacatggcctatcatcatgaagattcataggaagagttttcctttgttaacgtggagatcttgcaggctcacagtgtgaacatatggcacctttggacctctactcttctagattgagggcttcctgaaggcagaaaaaatgtttatttcacctttgtatcctgagcacatcatcaacacggaaacacacctgttcaactgtagggttttaaaatatttttcctgaaaatgttttgaaccaagagtctatattcttgaaaataaaatcagtctttctcattgtctcaaacaagctgataagtcgatgatgggggacattggtagttaggtaaagaagatgtgttaatgtactcaggaactagaatttagagttattatgagcaaagaaagtcagttatccaatctttttgacaataagatgttaaaagtattttgaaactatagaaaaacacactgactcctcttataatctatttccaatgttatttcagatgtttaagtcaaagactcgttgcagaaaactgttagcttctgttccagaatccttgagtggttaacagtacaggctctgaatagagattatgtgaattaaggcacagactctagcttttacaaactgtgtgaacttagtcaagtcagcttatcaatcaagcctcagatttcttatcggaaaaataggttgctgtgaggatcaaatacatgtttagtgcttagcacagtacctgggatgtagacagccctaaacatctgctgcattgccacacctatttcgattctttgcctcatatcatttttcagctcaacttagggcaaataaatgaaacagttgaaatgtgtgcacttatttattcttcactaatattaaaccaggtaatttatatctgtctttggcaaataacatacacaaatctatatatatatatataaatgtttgtataaaattgaatattcatgattttaaatttgacaaacactgtcaggtaaaaatcaaactattttactaagttaacatctcattcaattagttgtaagttgtaatagcggcatattttacatgagactattagaaaaggataatattaagtcattaacattataaatctgaccacttttattaggttgaggtgaaatagagaaatctctactatcctggagagaaacaagcaataaaaccatgtattacaagtttaaagaaatgaatttatcctaaaatcatcagtatcagcaccccaacaaagcaactttgccatttctacttaaagtacactgtagcttgatcagacacttatctcagcagtacttgtttaagcaggtctctttgtacaaaagcaaaacagaaagcaaaacaaaatccatagccattatttaccttgcacccagtaaaagccaagagatttaaggtaaggacattttctaatcccatacccatgctaacatcatcaacattgctgatacaaaactcaggtcaggaaaagaagctcaaacagggaaggtgagtggcaacattttatgtatgctaaattggatggcaatattagattacatcttctgcaactgtggtgtcaaaaatctgatagcaaatttgattatctgttccatttgtgacattgtatgacttgatgaagcattccaaccacggatatgcatctacaaaaacaaaaacaaaaaaagcgatttaaccattaaaacaaaataaataactctgaaataggtacctaagcttaccactgagctagaaaaattaacatttattttggcttgaaaagtaagtaaacgtcccttccaaatttaacattattctctcttcaaaatacatactagattcatgttattgttttggagcaattgtgactaatttgaattttttgccacaagcaggtaacagtgagtacatcttgggtttcaaaatggttggtatatattttaaaaatctaaaatagtggttacaatgggtctaccaggcccatgcttttggatataaagacttacttctagaaatctatccaaaagaatccaaacagttaacacaaattaaaactgacaacaaataaaggtattcaagttaaacttggttagagatcaacacaaattcctatcattatgtaactattataagatgcaaagattgaccagggagagtaaagcctgattaaaaatagtatataaaaattaaaccagctgctaaatctgcagctggtaaaatttcctacgataaaaaattgttagaaaaatcaaaattgtcttaatatgacttagatctgcaagtttcaacataagtacaaatatagtcacagaaggaaaattcagtggcagcaggtataagcagtacaatttgaaatgaggaagatctggtttattaatcaaatgtttatgcagaaaacaaagctcacaaaaaattggtaaaacaaaagcttgtaaaatctgaaactagttaacaataaataaaaaaattaatccatgaattaaattggataattggagtttgttacagaaaatgtttactgccaacaattcatcacttttggtctaatttcaactaaaatgcttgtagcatgacaatgtcaaatgtgcttgtgatcaaaactatctccctttcctatatttaaaaatattttaaaaatcttttgactgcaggaattatgattcataactattttatccctgccactctcttcatcaaaggttgatcatagagtaatcactcactacttagtaaatcatttggaagcaaagctttcagacttctaaaagtccacagagtacatatatgttagtgctatctcaagtaaaagaagtgtgggattgttaaaatattcttgcctaccaatttttattcctggaggacaaaacatatccatgatcatatccacacttttctgaaggtcatcatccatcagaacttctgatgctggaatctggaagaatttgtccttaaaaatgtttcatgagagaaaaaaaaaggaaataatattaatcctttttaatgttattattaacacatatttcaatattgtccaattaaaagataatctagacagtttccctctatcaagattgtagaattcataaactagaatgctggtctcaactccaaaatcttatttactctttaatcttaaaatagctttgagatacacgtaatcaagtaaattgctctgatttaataatgatgatggtaataatgatttaaaaacaatgaggctgactattctctttgtgcatagaaaaaaaaatcttgtgctaagcttaaatgaatataacatacagtatatgtattatatagttatttaatttttctcttccctactatgttataagtttcaagaaggaaggaattttgtttactttgttcaccgctgtgtctccatcacataggatagtacctagtacatagcaggtgctcattaaatatttaatgaaaggttaaatgaattgtgtaggtgggagaaaaattctcctctcaactataactcagatcttttccaatccatgtagtaaacattttaactttaccctaagagaggtctgggctttgaccttagcttgtggaacgtaatctctaagccctttctatgtcacacttgatagaagtatttttgcctggaagccctgggtcactatgaatagtttaacaatatgatgtagggtggaaagtttggagcatgtggtatcagcttgatctcaagaggggctgaagactatgatcagccatatgggcagtcaaccatacctacgtgatagagtcccactaaaatcttttagcagagcttccctatctggcaatatattatgtatactgctacacactgttgcagggaaagtaacagtccacaactctatggggagaggacaactataagttccatgtctggaactttcctggactctgtcctatacatctctttcattatctgattttaatgtacatcctttagctgtaataatctgtaactgtcagtataacagttttcagtgagttctaggagtcttgtgaattatcaaatctaagagtggccttgaggacttccaattgcaattagtgtcagaaatgaggaaggttttgtagactgcctcaaaactttatacaataatatctatcttccctgttaaagtaacttcattcctctaatatgaaatgtggaggtttaaaaagtatgatcaaggctgggcacggtggctcacgcctgtaatctcagcactttgggaggccaagggtgggtggatcatgaggtcaggagttcaagaccagcctggccaagatggtgaaaccctgtctctacaaaaatacaaaaattagctgggcgtggtggtgcatacctgcaatcccagctacttgggaggctgaggcagagaactgcttgaacccgggaggcggaggttgcagtgagctgagatcgtgccactgcactccagcctgggcaacagagcaagactccatctcaaaaaacaaacaaacaaacaaacaaacaaacaaaagtacgataaaatgttgactacaaataatgcttccatagtgtggccgtatctctgcattttggccatggtatagggaatgactctttaaatccctgttccttaatttttcactattcaaatgttaagatttagtgtcaaataaaaaaagagatacatacacagatgattcaagatttatgtgctcatattttacttatatttttaaggtgccttaagtccttttaggaacaaagcaggtatgaataaatgtattcaattttttaaatattattttttaattaaaaatatctttattacctctgatacttacagaatccatgagataggcttctagtactcctgttccatcatcaagtgtaaaggtcataacaaacacatattggaggggtacaatacccagtgctagtgaaggaaaaaaagatcaaaccatatgagtctgctattccttattatcaaggtaaagttaaaattgttttatgatagtatagacctgtaaattttatttactaaaataactcaagatacaaagaaaaacttggcattatctccaggtagatagtgtcagaattgaactggaggacacccagctggcgtctgctgagggattgcctgcttggtgtgtgggtgaaaacccctatgcatttggtcacataagtcttctgcgctgattgctgtggtggcagagcagaggacagtttgtgtttttaactccacagatactcaacctataattaagctcatttagcagattcattttggaatatttcactatacctacatagggagaatatcttatgataagcaatttaatctttttgattaaatattaacgtatttaaaataagttgacaccctcacacctgtattctcagcactttgggaggctgaggtgggcagatcacctgggcggatcttgaggagttcaagaccagcctggccaacatgatgaaaccctgtctctactaaaaataccaaaaaaaatagctaggcttggtaacatacacctgtaattccagctcctctggaggctgaggcatgagaattgcttgaacctgggaggcagaggttgcagtgagtcgagattgcaccactgcactccagcctgggcgacagagtaaggctctgtctcaaaataaataaaaataaataaataaaaaaaacagttgatagcctccatagaaaccacaaaaagtgattcatgaaatgtaactcattgcatgttagttttatgaaagataaaattaaaatacagaatattctaaaaaatagcatgcagttaaataccgttttagcatgcctctctcctttctattataagctaggggaataatttataactttaaaaaagaaaaaagggatatcatctggttgaatggacaagaatgtcagaatctgagatttaataatttggtaagataaggaagaaataagaaattagacatactgggtaaaatgaaaattcacaggttaagataaatatcttcttgtttggaaatggaagatactcaatttatagaatgttttattagcttttatctgtggaacccatatttaaacagtataactaattaacagggaaagtaagaataaattaggacatacagacatgaactagggcatacaacagacattaatacaggggaactgaattttaggcttcaaaaggtctcaataggttaaaactgtgaactaaaactaagaaagatgaacttagcacctactcccaggaaccataaaaacaaagatattacattaagaatagaacgaagagaccaagttcaagaagttcatgtgacagaaaaaaaaattacattaagaatagaatgagaagaccaagttcaagaagttcatgtgacaggaccctaggatttcactggaccacaaataaaacatgagatggctgtatcaaaaaggaaagaaaacaaaaccaagtgtacaaataaatagctatacaatgacatttcaggctagtagaagctgagtgtccagtttcaggtaaataataatttcactctattctgaattggccaaacaacatctgcagcacaatgtccagctctgaatgccaaattctgagaaaagcactggtaaagtggaatgcttactgaggaggaaaaacaaaatagtaaggcataggggaaagtatgtgacggtgcctgcttgaagaaatacagactaaaggaaggcttggcagatatctttaaatttacaaagtctgtttatcttacagaggaaggaataagtatacaaagaaggaacaggtatactttcaggtatactgaaatataagtaggtgaaataaccttgtaaacaaacagttaaaattgcagggcatggaaatttagctaaccttctgccacagaagaaggaatccacgatgttttatcaaccagggaatttagattttgtatggatctcaaactagaacactgtttacatctgaaatttataaaagaaagaaccataaatatttaaaaataatttagcttgtttgttataactttttactgctcaaacatgtgtagttttaaaatataaattattaaacagaagaatactgcatcccctatattgtaatgtgcttgtttgtttcacaagagaattatgaaagagtaagcttattacataagggcaataaaaaagacagtataagattcagaataaacaactctaaattgagaacagggtgctcggttccaggtccaaatcattaattaattttgctctcaatttccttatttgttaaaatgaaaagttgaagaaaatgatcatctctaagaattctctgattctatgatctatatctatatctatatctatatctatatatatatattttttaagacaaggtctcactctgtcacccaggcactgtcacctctgcctcctgggctcaagtgagcctcccacctcagccttccaagtagctagaaccacagttgcacaccaccatgcctgggtgatttttgtaattttatagagacagggtcttgccacaatgcccaggctggtctcaactcctgagctcaagccatctgcctgccttggcctcccaaagtactgggattacaggtgtgagccaccatacctggcctctgtaagtaatatcttaataaattcaaagtgttaataaatatggccaatagagaaaaattactaaacagtcacaacatgcaagattctagataattaatatttttagtaagcacatatccagaggtttgtagtttatgatgcctaattccatagttaacttttgaaatgtatataaatctaagactacacaatacactaaagttgtgcattgtgtagtacagttattttgctttacttgaataccaacatattttaactatgagtaatttattttttattatgcatcatcataatgtttatgagatgttgataagaaaatatacttgaaaagatatacttgaataaaaataaaagttcgaaaggtccatgcaatttgttttcatttgcactttgaggaaaacaagagggtaaccacattacatcttatacccttctatttattaaatatataggtgtttcttttctaataaaagatgtcaatttaacaaaagaatattattgcctaagaaaaagactacgatattgattagcattagacattattaaagttagtataaaaattaaaaattaaggatattaagtcaaaattaaatacagaactacttacttccaaagcagtgaaaggggaaacagaaaaaattagaaacataaactaaatatatcaataacttaagaacatatttaaactccactattaaaactaaaatttagccataagcttttatttatgagtgacatacaaattagaatgccagaaacttgaaagcaaagggatgagagtaacctataaagcaattaccaaacaaaaattttaaaaaaacctataaaacacaagaaaccataaagttaaaaaggcatggaatacactagaagtatggatgaaactgacaaagattagtatctctaacacggaaagaaaccttacaatcaattacatgtatgtgcgctcacacatgaaccaacaaagaaatcagtaaccacatagaaaaacaggcaaaagatgtgaacatggaattcatagagtaggaaacctatgtagctgataaacacgggggctgcttaaacacactagacatctaggaaatacaaataaaaacattatggataccatctgatgctcgctggcctgacaaaattacaaaattaatgccaagtatcagacagaaatagactaataccaagtgttggagtgaacttggtagaaactaaaattttatacattactgatgggaccatatattgttaaaaccatgggaagaacaatttggtatttcttcccataaagcaaaacttatatacaccttataatccagtaattctaatttcaggtaaacaccttaggagtaactttcaaacatttttgttaaggactcacagtaagaaattcatttaatatcatatcttagtaatacatacatacacatacaattgaaatgaaagtttaggaaacaacactgacccttactgtgtaaaatgttctctattatccattccctctcattccattttttactacaaccacatcatataatttaaaaaaaaactgtttatgacccactgaactcattttatgacaagggaaatagacaagaaaacatataacgtgacttcattatggtctgtaaatgaaacaaaaaataacacatatccattaataggaaaataggctaataaattctgatatttcataacatactccaaagatgttaaataatctaaatctacatgcgtcaatagtggtaaatcttgaaaattttaatgaatcaaaaaaagcaagctgcaaaaggcttggcatagtacgaaacagtttatataaatttaaaaaatgaaaaatatgccatactgcttaagagttcacacatataatgaaggcataaaaacattgatgagaaggatttaatccaagtttggaaaagtagctacctctgagaaaaaagagttagagaagggattgatatggcattatactacttctctgtaacatttaatttcttaaaaataaaaaaaaaaaaaaaaaaaaaaagtttggaggccaaggtaggcagattgcttgaactccagagttcaagaacagcctgggcaacatggcaaaaccccatccctacaaaaattagccaggtgtggtggtgtgcacctgtagtcccagctagttgggaggctgagatagtaggattgcttgagcccaggatgtcaaggctacaatgagctgaaatcatgccacttcagcctgggtatcagaatgacactgtctccaaaaaaaaaaaaaaaaaaaaaagtctgaaataatgtcaaaacgttacgatttgttaaatctaaatggtggatacgtaattgttgtgatgttacttttttaatttttctataagttaaaattatttcataacccaaaaataaaaagaagaatcaattaaaagatatactggcttttgatgatgaaactcaagtaataaaaaatgtaaaaatgtcttaaaatctggagtgtgaacagcatttgccttagttttgaagcaaccagtaaaaagtcaacagccttggttgggcacagtggctcacacctgtaatcccagcactttgggaggccgaggtgggcagatcacctaaggtcaggaggtcaaaaccagcctggccaacatggtgaaacctcgtttctaataacaatacgaaacaatcagccgggtgttagtggtgcatgcctgtagtcccagctactcggcgggggggttgagacaggagaatcgcttgaaccggggaggcagaggttgcagtgagctgagatcatgccactgcactcctatctgggcaatagagcaagacttcatctcaaaaaaaaaaaaaaaaatggggtccttaaggtaatttttttgagacttctagtaaaagaagtagtagtatttcagagtttaaaatgaatatgaatatttcctttcctggtttagacgcgtcacggtgcccagtactggcaaggcaaaatagagagaaaggggaaagaacaaaagcaagtgagcgaggatgagcatgcaaaaagagaaagctcagtgacttattatacaagaaaaactgaattttatgagttttaattttttaattaattggcttaattaaaaatcattttattttcaaaaaagatggactctcagatcatgagtctaatgagagggagaattagacactgagtatatcagtaaaaacagctataacacagagatttaagtcagtggcatacactttcgctttatggctaaaattttatgatatgttggaaggacagagggcaatgcctaacagtgactttaccacacaattagggaggtatcatgcttaccgtataatatttttcaaccagtatataatttttcaatcaggatttacacattatgacaatgactactaattgctacaaatgtagaagtcggaaagaaagaggaataggatgataaaacatatgttataatccaaggtttctcaaatcagaatgtgtccagggtgattgtttcatcaagcagtagaggagattttatccctaccccctccttctaaatgtagaaatctgtttatagctcctaatgaattcttttatattccaattttcagtggcagcaaatttgtaatttagtggctcagaaattctgaaattgaatcacttaatttttactaggtttgcagctctgaatttttctctgtaactggaatctaaatcctcactgttaaagaaaacaagtgagtaccagcctctggctgaggaatcaaaagacagcagccttatgcctcacacattgcgtgtactctcactatatatgcttatcaaaagaacagatatatgccagaaaaacctagtacatataagttgatacactgtaagttcatgctgaacatatagtaaccaatgaaataaactaataaaaattactcttcaacagtttttaattccaaaagttttctcagttgaaaacaccaccacacatctgcaaccatctgatctttgacaaacctgacaaaaacaagcaatggggaaaggattccctatttaataaatgttgggaaaactggctagccatatgcagaaaactgaaactggatccccttacaccttatacaaaaatcaactcaagatggattaaagacttaaatgtaagacctaaaaccataaaaatcctagaaggaaacctgggcaataccattcaggacataggcatgggcaaagacttcatgtctaaaacaccaaaagcaaaggcaataaaagccaaaattgacaaatgggacctaattaaactaaagagcttctgcacggcaaaagaaactatcatcagagtaaacaggcaacctacagaatgggaggaaatttttgcaatccatctgacaaagggctaatatctagactctacaaagaacttaaatttaaaagaaaaaaacaaccccatcaaaaagtgggtgaaggatatgaacagacagttcttaaaaggagacatttacacagccaacaaacatatgaaagaaagctcaatgtcactgatcattagagaaatgcaaatcaaaaccacaatgagataccatctcacgccacttagaatggcgatcattaaaaagtcaggaaacaacagatgcttgagacaatgtggagaaacaggaatgcttttacactgttggtgggagtgtaaattagttcaatctttgtggaacacggtatggcaactcctcaaggatctagaactagaaataccatttgatccagcaatcccattactgggtatatacccaaaggattataaatcattctgctataaagacacatgcacatgtacgtttattgcagcactattcacaatagcaaagacctggaactataccaaatgtccatcagtgatagactggattaagaaaatgtggcacatacgcaccatggaatactatgcagccaaaaaaaggatgagttcatgtccttgccaggcatatggataaagccggaaaccatcattctcagcaaactaacaccagaacagaaaaccaaacactgcatgttctcactcataagtgggagttgaacaatgagaacacatggagacagggaggggaacatcacacaccagggcctgtcagggggtgggaggctaggggaaggacagcattaggagaaatgcctaatgcaggtgacgggttgatgggtgcagcaaaccacaatagcacgtgtatacctacgtaacaaacctccatgttcagcacatgaccccagaacttaaaagtataataaacaaaacaaaacaaaacaaaacaaaacaaaatacccatagtgatgtattgttccttgtataagaaatggtgctgaaaggtccaaaagttccaggtcttcgtggccagatctcacaggaattacactattaaacttgttcgagagtttgcaaatttcactgagtgtacctcctgttaagagaataaataaatccttcaagtagtgcaaataaaatgtagacaagtacagtcctattaaataacgtgtgaggtataataaaagactaaaggaattgacagaaaaagacaatgaatgtatgtaaaaaatattaatttgtaaatgtacaatcctatacattgattaaaaaaatcaatgcacaaaaatgctgagactttggtaaaatataaagcttgtgaaattttaaccaacttcttaaatttaaacaaattgctctttatttcaggaacactttggttcaaataaccaaaagagggaatataaattaaaagctaagttatgatcagattctcactaatttgctatatactaattaatatctgggcaaatttagagtttaaatctcaattttcaggtcaatatttcatttaaatatagatatgagtagttcatgtaatatgaattcacatataaaatttgttcatttttcctgggaaaattatcacagttaattctatgacagagtaagcattcaaatgaccaggctggctgagaagtattgtccaatggcatccattattagaaggcagtgtcctttttacttagctaataatgcttcctctctccaggcaaaatgaaaaggatttaaaaaatacctctgtgtatttcctaaaatttgggtagaatttgtaatgtcaacattcaattataaaggagaagcacttctggtatagcagagtgaggacatccaaagacacacttgactataacagcagtaagaatattggcaaaaactgtaaaaccttttttagaattctggaaattaccagaggccttcaacaatccaaggagtgtttgctccagaaaaagggctgaattttggcaagaacggtgagctctgtggcattttaacttgccctgttcccatcctccttcccccaagctctttgttactggaagccagagttctgctatatcatattgcagctagatagaaactctcattatgcatgcttaaaaactcaaaacaatattccctaagcatgctacttaaaagtttcacagcccaaaagttagtctatcttttggagactgatacctagccctgctgaagagactcctgcctactgttcaaaactgcaataggtgaccattcactaactcttttctctatgagttcctccccaaaaacactatttcaaagaatctggtgagagctcatctagtcattcacactggccagtcacacgagtttggctctggcacataagctggacaaccttggtcaagttacttaaactctggtataacagtttccccatttgcaaaactgagaataatgttactctgtaagatcattataaagattaaatgagttaatatttgtaaagcacttagagccatgagtgactattactatcaatattttagtgatttcctcttaatgtaaagtccatgaaaggaagaactttgttgtgtttgctacattgccactaatgcctaaatcagtgtctggcacatagtaggcattcaataaacatgtgctaaacaaatgaataagaacaaagaaagacatttacatgtatatatgtgcatactacatttctcaaggtttgtatctggagacatcctaactgagagcaatttatttgcaatcagtagaaatatttaacatggactatggagacagaaaggcctaagtttgaatttttttctgacatttattaagtctttaaccttgagtacttcaccattttctcttggtctcagtttcctcttctgtttacaaaggggatatatccagcttacagaagaactgttatgagagttaaagataaaatactaaactagtacagtgcctgacacatagtctattcagtaaattataggtattaataataaatattatgataaaatgattcagtgacattagagttccatacaaattggattcaattcaattggaaacaatacaaaatgtttcagaggaagttaaatgttatgcagtttaaaatatagtgttaataataaataaatattataaacaattcgaacccacaagtttgacaccttagataaaatggttccatttcttgaaaggcataatctatcaaaactcacacaaggagaaacagataatctgaataggtctatgtctatagagaaattaaatcaataataataatcttgaaaaaagtcaccaggctcagattgtttcaatagctaagtctacccaaacactgaaatgacactaattctctactatgtattccagaaaatggaagtagagggaatgtttcctaactcttatgaggccagcaatattctaatacataaccaaatacattacaagaatgaagacctattgatcaacttctcttaagaaaacacataaaaaaatactcagaaagtatttaaaaattgaatcaaaaaagaaaataattattcaccatgaccaaatgagatttattttaggtaggcaaggctggttaaacacctcaaaatcaattaatgtaatttatcacattaataggctaaagaagaaaaattgtatgatcatattaatagatgcaatagaaaaagcatttgataaaatccaacatcattaataataaaaattctcagcaaactaggaatattggggaacttcttcaacttgataaagaacatcgataaaatagccacagctaaaattacatttaatggtgacactttccacctaagactgggataaaagcaagaacattccctctcattgctcctattcaatattgtactggaagccctatctaatgcagtaagaaaaggaaacaaaaggtatacatattaggaaggaagaaataagctgtctttgtttacaggaaatcacaacaaaaaaattcctgaaataacaagcaattatagcaacggtagaggatacaaggttaattaaaaaaaaaatcaattgcttccctatacataagcaataaataatcaaagtttgaatttaacattaaataattagcaccaaaaaagaaaatacttagatataaagctaacaaaatgtgatctatattttgttggatttataaggtttatctgagtaaaactataaaaccctagttaaagggatctaagaagatctacatagaaagatagtccatgttcatcgtcaataacatcaagttgttagttctctgtctccaccgtgacttatagattatggcaatcttttttttttttgagatgaagtttcgctcttgttacccaggctggagtgcaatggcgcgatctcggctcaccgcaacctccgcctcccgggttcaagccattctactgcctcagcctcccgagtagttgggattacaggtatgcaccatgatgcctggctaattttgtatttttagtagagacagggtttcttcatgttggtcaggctggtctcgaactcccgacctcaggtgatctgcctgcctcggcctcccaaagtgctaagattaccagagtgagccactgcgcccagctggcaatcttaataaaaatcccagcaagttatttttggatattgacaaactgattataaagtttacatggaaatgcaaaagatttacaatagccaacacaatactcaagaaaaagaagaaagttgcaggacaaacactacacaatttcaagaattactatatagctttagaaataaggatggtgtgatattaggaaaataacagacagattaaaacagaatagagaacacagaagcaaattcacacaaactggtttgacaaagaagcaaaggcaattcaatggagaaggaacagtctttttaagaaatggtactggaaaactggacatctgcatgcaaaaaaaaatctggacacagatcttagagcttttacagaaattaagtgatactgttttatatgagactctaatggtgggtacatggtattctgcatttgtcaaaacataaagaactgtaaagcagaatgagtgaaccctaatgtaaactatggtcacaataaaatagtgtcaactgcattaacttggcatgaatatcagtgaatactgctgcaggtccttaaagtctaagaatgactttgtatttatatcgttttctttggttcatctctaagtccaggtcagtttttgattttgttacttcctaaccagagcagtgccatactgcagtaagatcctagcccttggtccaggttataatacttagaaacataaaataaaaatagctcacatttcttatattccttttacatttcaaagtgcttttacatacattctcattatttttttaaataagccttttttaaaaagcagttttaggttcactgcaaaattaagcaaaaggtacaaagtttccctatgtcccctagcctcttccccattatcaacatcttgcaccagagtggtaaatttagtcaatcaagaaacctattttaaaaaaccattatcactcaaagtccacagtttacattagtaacaaaccattatcactcaaagtccacactttacattactaacaaaccattatcactcaaagtccagtctatattagggtttactctcagtgttgtacattctatgttttctttttaagacttcattttttttttttttaaggagcagttttaggttcacagcaaaattaagaggaaggtacagagattttccgtatccccttctaccatacatgctagcctcctccagtatcaacatcctctaccagcgtggtacatttgttaaaaatgaacctatactgacacataatcacccaaagtctataatttacatagaattccctcatttattaaaaataaagttaaatattactctaaggcaaattaaagaaggtatttttcttctattacaaaaggtttcaagggaagaaaagccttcagaaaaacaatgaaaaggtttcaagggaaggaaagccttaagaaaaacaatgaaaaggtttcaagggaaggaaagccttaagaaaaacaatgaaaaggttacaagggaagagaagccttaagaaaaactctaaatttgccatgaaaaaaaattcacagtacatattttagataaatgagataaaaattagatgaaaatgaaaagaaaatgaaaaaccaaacatgataaatttcatttaaaacttgtcaagttatctttacttgtttcaatggtctcttctttgattttgatacaatagatgactttcaccctatttctatgaaacaacagtgacatccagaggccaagaaaacagcaatggtacataagcaatcagcctcttttattattacttaactagacaatcagcttagcattgacaaaataaaatgcaatccaacaatatagttaaatgttaacacttgagtctgaagtacaatttcaaatgtaattaagataaatttatgaacgtgtgcttatatatatttgaacctagttaacatatatattcaattttgttaaatttaaatactatttttactttatatgtactaggttgtctgtaaaatgtattaaacaataattaattaggaaaaatatgcaaaaggagtattctaacaaaacagtgacttaaatatcttaccttctatcaaaagtagacattcatttgaaagcgggagaataccattatttttcacaaaatgaactgctacttttcgtcctttttgatttttagtggtccagatttttgaatcatataatgatgtattttgtagcttgacatctggggttttagttgcaccatcctgaaaaattatatccaaatcgccctcatgtggaacttcttgcctaaaattattggcaatgaaatgatagaaatcgattttggtgtaagcgtgaagatttccatttaacaagttatcaaattaaaaagtatcattcttacatgtagatgagtcagttactttttcttaaattatgtaaattatggagataattcactttgcagaacaaataactttttttcaatagataattatttgatattttgtgggtaagtatatccaaatcatatttacattaactaccagtgatttctatgcctggttttgtgatacaaagttactcataattatttctagcatcaatttttttctcctctgtaaagaatgctaaatttcccagtaggagaaaaaaatgcagtggccccgtcttcactccagttaaatatccacttaccacacttagggagaagggcacttctaaactaataatatttccaattctgtttaataattaataattttaagaagtcatatggttaggtaccatgtagcagaaatggcatcatttggaatcaaaaggtgtatggctttcttctggttctgttgccagttaactgtgtaactttagacagtttccgttaatttctgagataatatccttatttgtttaaaaaatgatcgcggagagtggttttattttacaaagctgtatgattttacaaaattcaataaaccaaagtttgataatatttgaagaattatctaaaatccttatatatacattttaatcccaaccaccatttcaagctcaaatgggtaaaaacagttccctcacattttatttaaagagattttaaaataaaaaatttcttcaaacaaacccaaattttggattggaaaatatatgtatattaatgaacacagatactcacaatttataagcacacaaatacatggcgatgtacatagatatttacacattgtagcacattttagtgaagactcaatttagggcatccaaatgcatataaccatcaattatctacattttccaaaacatcattttagatattcagaggaaaagtaggcaaattgcaaaaagatgaggagcttttaaaaatgattttcagaatatgtcttgagccgattatgtagtaaaaggattacaaaacagttatatacatttattacatatttatataatcactgatgttcagagtaaaggcactgagaaattctcaattactaaagaaaatttaaattatatttattatattctagttattaagcaggacagaagtttaccaacaaggctctctttatcacttaattagatatttcaagtaattacaactcctttcaaaaatttcagttaataaaggtttatatttcagaagatacttctgtgacaaatgagtctgcccaaatatattcatcatttattatttctcatttgcctttatcagagtgactaagctgaattttagatctgaaaatagcacccacttttattactatcagaataatttattctctaagaatttagcactttacctaaaaaatttaccattcttgcaaaatataatatatatattaacaatttacttattcctaagacacaaaattatacatatgtgtacatatacacacaaataatatgaaaacgtttgttttattatggaaaatactcacagcaaatgacatttagggcaatgaagtttaacagactgaaatagtcttctgggcttatatgacctcaattttgctcggatgcggtattgttgaggagctttttgtttcaaaatggcacatagtggtgtcctctccaaatactgatgatctgtaagtactgtaaagaatttttatattcaatcagaataacaagaatcatatttatgacatgcatcctcctgaaccaaatatatactataaaatctaattaatttaagctctattaagtgtcactccatgaaaggaagggttatgtctttattccctgatgtatacccaaggcccactagcatagtgccaggcacagtaggtactcaacaaatgtgtactaaataaacgctggataatttgggggaagaaataagtaacttaactgcctagtaagcattcaaaaaagcaaggtttatttagctaagaaaatattacgctaggcaaccgtttaagttctaactggtgtctgccacaaaagaatgtaacaaaacacacttgtaaaatattatttgcaaatattatttgcaggctcttggatgtttcaaatcagttactttttacagaaccatcattataaaatcagattaagaataggaagggacattaagggtgatctaactgtcacaggagtggtgtagtagtggagaagaggaagtttggggagttggaaggagggagtggaggaggagggagaggaaaaataagaggaagttgagtcaaactggaaaaaaaactcagacaaaagcattaggagcaattgcctgggaaataggtacaataggtctcctcagctacttgtggaaagatggcctgggattgtagtgatcagtttttactgggaaaaagtataaaattgctggtgacccttagcttaaggcaacagcttgctatacattctagcttaacactttcatgtgttttagaaaagggaaatgatgtacaaatcttattaacctcaatggcgaagacaattcctttcagtactgagctttaatccaatgaaattcttgttgaattagttttccttcaaggagcaaatggccaagaaggacagaagtttaccaacaaggctctctgtatcacttaattagatatttcaagtaattacacctcttttcaaatatttcagttaataaagtttatatttaagatacttctgtgacaaatgagtctgcccaaatatattcatcatttattatttctcacttgcctttatcagagtggaacatttattacatcagagtggaacatttattacagtggaacattttgttgtggtggcgattgtggtttttttttttttttttcggagacggagtttccctcttgttgcccaggctggagtgcaatggtgcgatctctgctcaccacaacctctacctcccaggttcaagcgattctcctgcctcagcctcctaagtagctgggattacaggcatgcaccaccacgcccagctaatttttgtacttctagtagaaacggggtttctccatgttggtcaggctggcttcgaactcccgtcctcaggtgatctgcccgcctcggcctcccaaagtgctgggattacgggcgtgagccactgcacccagctggtgatgcttttaaaaaggccattggcaccgggcgcggtggctcacgcctgtaatcccagcactttgggaggccgaggcgggtagatcacgaggtcaagagagcgagaccatcctggctaacacggtgaaaccccgtctctactaaaaatacaaaaaattagccggtgtggtggcgggcacctgtagtcccagctactcgggaggctgaggcaggagaatggcgtgaacccggaaggcagagcttgcagtgagccaagatagtgccactgcactccagcctgggcgacagcgagactccgcctcaaaaaaaaaaaaaaaaaaaaaaaggccattggcagacctgatcaatttagtgtacattgctacacagtgataagagcaattgcttcaaactcatattttaacctaaagtttttaacttttcattttaaaatgctttcaaacttaaggaaaattgcaaaaacaatacaaagaccttctgtataatattcaccaagattcaccaattgttaacatttttgcacatttatcattgtcactgtgcctgtctttatctgtctctcaccacataaatattattgaatcatttgagaataactaccagacattatgcctcctttcctctaaatcctccagtatgtatttcaaaagaagacattttattgacataattacaggcaattttcaacattagaacatttaactgatttattactataatcgaattaattaacaaacattactcaaatttctacaattgtcctcaaaatgttcttcttagcattcattttattttcaagtctaagatccaattctggaccatgtatcacatttaattctcatgtctctttagacttctttaatgtaaaataagtcctcggcttttctttatctttcacaacactgatatatttgaagagtacagccatttattctgtagaataaacaccaatttgggtgttgtctggttattcctcaggctcagatttagcttatgcatttttggcaggaataatgcgtaagtgatactgtatgcttctcagtgcatcacatcaaggggcatacaaagtgagtgtttctattactgtagacctaaactttattcagctggtaaaggtagtgtccaatcacttctctactaaaaacttactgtttcccccttgtatttaacaagaatatactagagaaaatgtaaatatcttatttttcatcaaatatcctgatagtttagaatccacagattcacaactaactcaacaatgactatcatggttacaaaatggtagcttttttttttctaatttcattatcccttttatatttgttattttactttaagaaagatatttccacttaaccccatatattttatttttcctttatcatcatcaacatgggctcatgcattcctgctttactcaattagtattatttgttttgatgctcaaatgttcctagacatgttctatcctaagccatttgacgagtttcatcattaactgagaacccccttactttctagtacaaggttactccatactaatcttgtaattcccttgttctagttcagaaatctgctgtttcaccaaggagctctgattcctttagagagaaatattatttataaaccaagatctgagcaccaggtgtgcttatggcaactggagtgctgctgcctctatgctttttcatggagagagagatagggtacatatgaacacacattcatactgacacacacacacacacacacacccctataatataaacaaatgtgtacacgtgtgaatatatgcgtatcatacatacacacagctacatcgacttctgtatttacctagaaaacatgagtacataatggtacctccaattacaacacaacattaaaagatttcatcaatccttcttccattcacatttgttatcttccttctccaatttgagaaattaaaatttttacaatagcacatttaataaatttgtggttaaaaatatttttctgaaaatttttttttaatcttagctgatgtagcagaaggagggtacttgatagacacactatcattactaacattaaattaaaattttgaggcatattgcaaggagctcctttatggtacactgttaaatgcatcatgtgacaggataactcttcatgtaatagtttaaagatatgtgtctttacattgcacattttaagtcatgtaactctaacagagatacatgacttcaaatacatcatgtatttaatgtttaaaacatatctgttttaaacattaagtctgttagagatagatgacttaaaatatgcaatgtaaagacacgttatctttatgggttccattttatgccaacaagacacggtagaagaagaaagttaaatatggacatattttagctttaaaggatatgtgttctactattagaaagaaatggattagctggtaagtgtagaggcagactttattatgctcattactgtgcccatctcaaaaatgatacatagtcttacttgtagcagatagctgttgacatctttctacctcgtataatgatactgatccagagcctataaaaaggaaaaggcaaaaaaattaagtccattacaacttcattgtagaactgaaaacaatggagcgttgctgagagaaactgaagaaaatataaataaatggtgagatatgccacattcatgatttagaaggctcaatattgttaagatatcaattctctccaaattaatctgtaaattcagcataatccttcgaaaatagcagaggctggggtgggcacagtggctcacgcctataatcccaacacttcggaggactgaggtgggcagatcacttgagatcaggagttagagaccagcctggccaaaatggtgaaaccccatctctactacaaatacaaaaattagccaagtgtggtgcagatgcctgtaatcccagctactcagcaggctgaggcatgagaatcacttgaacccaggaggtggaggctgcagtgagctgagattgtgccattgcactccagcctgggcaacagaatgagactctgcctcaaaacaacaacaaacaaacaaatagcagaggctttattgtagagattgcaaagcagatgctatcacttatgtggaagtgcagaaaatctagaatattaaataacattttaaaaaataacaaagttggagaaccatgtacatgacttcaagacttactataaacttacagtaatttaagacaacacggtactggcatcaggattgaaaaatagatcaactgaattaaattaaatagagagcctggaaataaacccacatttacattgtattttgattttttactaaagcagcaaagcaatgcaaggagaatgcaaatggtgctgcaataactgaaaatttagtgtgaggaaaatgcatacttcacactatactagtaagcattgaatgggaagcctagacataagcccacatttatactcgcttgatttttgacaaagacattgaagccatctaataggaaaaaggaaacaaatgatgtcataacaactagaaattcctatctaaagaaaaaatgtctaccgcatatcatgtgactaggcattaaaaaggaaacaaactaatgatatatgcaacaatgtgattaactctcaaaaacatatagtatatacaaaaagagtacatatgattcaattttttcaaagttctagaacagcaaatctagagggatttgggttacacgtttatgtattagtcaaaactcatggagtggttcataaaatggaaagttgtccatttcactgctaattttacctcaaaaataaaaaactctaaataactactaaactctagctaattatgttcataccacagtgtttagaaaatgtacttatgtctgcaacttactttgaaatgtataaaaaatataaattaatgaatgaagaggcacataggccaggcacggtggcttgcacctgtaatcccagcactttaggaggccgaggcgggcagattatctaaggtcaggagttcgagaccagcctggccaacatggtgaaactgtgtctctactaaaaatacaaaaattagctgggcgtggtggtgggcacctgtaatcccagctacttgggaggctgaggcaggagaagcttgaactcaggaggtggaggctgcaatgagccgagaccgtgccactgaactccagcctggaggacgaagcgagactccatctcaaaagaaaaaaaaaaaaaaaaaagagatatgtagaaataaatacacgtgacagagcacacaaagtaaaatagttattggagagtctagctggtagttatttgagtattcattgtacaactgttttaattctaccatgtatgaaagtttttatcatgttgaaaaaatacagtgtagaggaaataaaagcggagatggataaaatagtaaacttatgaaatttaatagaatgaccaaatgaacatcaaaaataggattttactctaacaagaaagcaaaagtagtagtcatagcattaaggttacaaaatgctttctaaaaagaagaacttaagactttaaaaatgtgtattttgtaatcactttagcttacattctattatacataacagtacattatgtttttataatttattttataaagcatcatacacaaacatatcctcaatattgctaataagtggtataaaaatccaagtcaagaggacttgaatggacatctcaagctggcatggtataatttcaataaatctaatttagtaattaatattggccattacaacatgagatggaaataatggcagaaaccataaaagtagtcaaataagaaaatgtgtaaaacatacatggttgcccacaaactgacaaaaatataattcaacagaaaatcagataaagagtaagagcagaaaatctgaggaagagggaattaaaaacgtttgtaaatatatagtaagattttcaagtttccaagtagccaggaaaattaagtaagaaaacacctttcacctgcttaactgtcaaaaattacatatagtgttaacttccaatactgtgaaggtgtgagtaaagtatattctcctacactgctatttggatataaatttctatgacctttggtaaataatctggcagcatctattaaaaaatgtgcataaccttagatacatcgacctcacttttagtttattgtggagaagtaaaaacatggaagtacatatattcaaggatgtttattaaagtattatttgtaagagcaaaaaactggtaacgatctcaacatctattaaatgaaaaatgaaaaaagcataacattattattatgcaactataatgaatttgagtcatatgaattagcccagaaaaaaagatctataatatattgttgaagaaagcaactatttattatagtgtgatttcattttggtaaaaatttaagagaaagagaagagtcatattgtttatatataggtatatatgtttgtataaagatgaagtgattgaaggaatcacactaaactgttaaatcttacctcagggagtagggaataaaggtatagtgaaagctattcaactggatattatgacacatattacagtgtactttaaaaataatgaatcattttaaaaggaaaaagagatttaaaaagtataaagtataattacaaattatactgtctccaagtgatttgtcatctgaactaaattggtttcctaatagtagttcaagtaatcatacaccaggccaaaacgttatcacgaagttgttagcattttaaaataaggagagttttaaaacagagagaatgaagaaaataaatgtaaagtatgtacaaaaactcaaaaagcctgcacttgaatctgtcttgctttgtcatcagttaacagctaagtaactatggacaaattatatgatatccatccatcaaagcctcagtttcccattgtttaaaggagacagaataattcatctcacaggagtgttgttagaattaaataataatgcggacgggcgcaatggcctgtgcctgtaatcccagcactttgggagcccgaggcgggcggatcatgaggtcaggagatcgagaccatactggctaacacagtgaaaccccgtctctactaaaaatatatataaaaaaattagccgggtgtggtggcgggtgcctgtagtcccagctattgggaggctgaggcaggagaatgccctgaacccgggaggcggagcttgcagtgagcagagatcgcgctagccacactccagcctgggagacagagcaagactctgtctcaaaaaaaaacaaaacaaacaaacaaacaaacaaaagaattaaataataatgcctgcaggcacttacatgcctaccaagaaatgtgtgttaattttcatgcttattattgagatggaaagagaatacatctcataaaatgattctttggatcatagcagggtaggagttaggtagaaaaaaaaaaaaacaacaacaacagagaaacatgacctagattctaggtcccaaaatgcagaagtagaaattaagacaggccaggtgtggtggctcaagcctgtaatcccagaattttgggaggctaaggcaggaggattgcttgagaccgggagaccaggaggtcgagaccagtctgggcaacatatagtgagatcctgtttctaccaaaaaataaaaaattaaaaaattaagagtaaaaaaagccaggcatgttggcatgtgcaggactacaagtccttgctactcaggaggctgaggagggaggatatcacttgagcccaggagtttgaagccgcagtgagctatggtcctatcactgcattccagcctggtcgccagagcaagacactgtctcttaaacaaacaaaaacccagaaattaagacaaagtggtaaaggaaaaaacaatgcacactgaaagctttcaagttcagatttgactagtcacttattcaagcagacaatattagaaggacatatccctctgtttgttaatattttgtatttagatacctgattaattcaataaagactagtaactatgtatacatctaacataactatgagcaaaaagtatttgggttatgcgaaataagtggcaaaaacaatctttgttccctttaaaaactgacaagcaaaatagtctatgaaatcaatacagattttcttgtgaatacacacatatgatatgtatatatcataatcaagtaatcactaccacccaatttgaaaacgtaattatataatttaggaagaaaccatgtttactttttggcataggccacagataaagattttagtatgttcctctactacatgaaattattaataagagagacaaagagaagacattacaaagaattatgttgataaaactattttatttagcaagaactaaactgtcaatgttaaagattatccttacttggaaagctgtcgtcaggttctgattgacagataacatctgaatgctgattggctgtcaaatttgcagattctaaatccctataattgaaagaatacaatttcaaattgcataaaacaaagtcaatatagtaaatttagctctacccacaaaatccagaaattcattgaaattgtatataaaattttgtatgtatatgcattcttcagtaaaggatctattgctttcatcagattttccgggggttcaaattaaaaatctgagtttagaaagatacaagtgaaacagcagaatgatgaaataatacaaacaaaaataaactgggaatttaatggatagcattctgagtcagaacaatctaactctagattcaagaagctaaatatgatattaaaaatcagtgaaattgatataaaagtaataaaacagaagctaatttaatgtcacactaattccaatgaattaaaatgtagacaaaagttatttaaatttaatgaacagtatgttttctctttgaagatatgaagattttttaaatttctagaatattgaccaaaatgcttctgcacacaatactcactaggaataccttgggaaaagcagatctaaatatatagcaggtctaagatactatttactttctggcacatgtaaaaattttaaaaagtttaaaagagagtgatacaccaaaacatgtgttatctatttaatcagtggcacttcagaaatacatttttttcatgagagaattaaatatttttggaatcttagatatgtatcaaattttccaaactttagctaaggtctagtttcccctgtttgttgctgtacttggagagtgtggtaaatgatagaagagaagcatgagtgtaaaagccagattcaaactgttggaaaacttcaactataaccctggctctgctactacttagctctatgagcctataatcatttgatttgtttcatttggctcatctatttaaaaacatggcaaatggcacaaaaggctagggaactatcagaagccccaggaacaatattatcttagaaatcggcttaatcgataccttatttacattttctaaatactaaaagcttactttttcagttgatccacatcagagttactttctggcaagaccctgattccccgaccgtaactggtacctccatgaagatgaaactctaaacttaacattgtctgattctctgaattcattgattgaagtttggtatgaaggctatagattctaagaaagcttccaacctaaaaaatagatcatttgttatttagaaagtggggaaaaattaaaatacttctgatatttaaaactttaataaccaatatggggccaatgagggcactgaccagtcaggaaatatactaaagtatctgcaaagtatgctatacgagtgtggttgaatatcagctgcatggacactacatcaaaactaaatatatggacatgtgcatgcatatgcgtgtgtgcacacacatacatatacacacacattcaactgtaagagatatttccatttcagatctattaaaatgtgaaaaaatattgtgtcttagcatcaataaaatataatggttaagaaacccattacctaaacggaattcaagccctctatttgactaaggtttctgaaaatgccttgctttaactagtttaaggattaattaaatatgatcctgaagatactgtcattacaagaatgctaagaagaaattttaaatatggtactaccgaaaaataataaacatcttccatcttacaagttctatggaaagaaaacttctgcatttgtgcctgtaccaccacagtgtgaaacactccttgagttcaaacgtaagagttaactaattagagttttgaattaaatgttctatagttaatctcagatgttttgctaaacttagtctacaaatgtctttaattatagaccactgagatttttcttttaatggagatttcaaatgagagagatgcagaatgctattcaaagatattgacacctacctaaaagaagctatataacctaaatcacatttatatttatgaagaaagatttagaagcaaaaggagttacaaacaaggaaatttaattcatttgtataaatatagcactcctgactactggatgactatagggataccactttttttcccctacaagttcaggattgaataacagacatcttacataacaaaaaaactatataggttaaatattctttatctgaaatacttgaaaacagaagtgtttcagatttcagatatttacagattttggaatatctgcatatatataatgagctatcttagagatgagacccaagtctaaaaacgaaattcatttatgtttcacatatatgttatacacatcacctgaaagtaattttctataatattttcaataattttgtgcatgacacaaaatttttgtacactgaataattggaaagcaaagggttcactcgcatactggcactcaaaaagatctgcatttaggagaattctggacttttagattatggaggctcaatcctataaaaggaaacgtttaaaaaaaaaagatgagtagcaaatcaactttccaattctgcttattgtagcttctcttaattatatttcccctcattactctttatttctgatggaggatataagcaaaggaggtaaggagaaaacccacactcccaggtgctactccttcattcccaaggatcttttttcccaaccaatcaagggttttataaggagcagacaaaatacaagcctttcctttgacctctttcacttacatctatatcataaccagggagtagtataaagaaagttaaagaagaaaagaacaaaaagaaaaaagaaaaaaataattttcctcatagtcttcaaagtgagacattggaaaaaacataaaattttctagttttatctcattctttttgactggattattttgtgattcttttaaaatatgtgtgtgtatatgtatatataaatatattagtatagcacatgtatgtatgatctacaaaagatttgaaagaaggcctaaacacatggagaaagatattcacatacaaaaggctttgatattacaaaaatgataatttcctccaaattaaactttaaattttatgcaattcaatcaaaattcccagaagctttcatggaatctgaaaagctaatccaaaaacttatacgaaagagaacagtcaaatcaattttaaagaatatgagaggggggctttaccctatcaaaaaatacataaagaaaaaggataataaacataggtatacgtacaaacctacatatggagacacagagaggagagcaaaaaaaaaaaaaaaaaaaaaaaaaccagagcaggcaggagctcaaagaaggttcgatgtgtagagttttatttcctaaaatttaaaagtgtctgaaataaatgtggcaaaacatttaaaaaataaggtgaacacacgggtgtttattatactatcttgtctactacagtattttttaacataacaaaatttcgaggccaagatataagttattcacataaagataagttgttattatcaaaaattccttatggaggcagcattgtattttttcaaaagcttgactaaaaatactatgaaatgtgccagatgctctattataaaaaaacaagtattggttaatcttgtcagtattaagattccaaaaatacaaatgaaacatcaaccaaaaaattataaaaatacagtttaaaaaacaactatagaagtctatttaaatactaaaaaaaaactagaaacactaaaaaaaaaagcaaagtaaatatggctagtaagaaatgactatccctttagaaataatcaaacgatttgtcataaacggtcaagaatttccctttaggtttattatttttaattccctgaatatgtctcaaaatagccaaccaaatcacagctgttgaactattgaaggccaaaacataattatgaccacgtatattttataattaacaattgtgtctggataagagtagggatttagaaagtaaagctttagtttccagacaaaagatttgaaatctcagtttatgtgactgggtctgtgtaaaatgtttaagggaatgatataacaaaaagtgagattcagaaaatagttaagggcaattcgggctctaaaatacattgcttgtagatgttgattatattatattctataattgcattatactgtcctctttactaaaataaaaacacattttttcctgtttctatacaacaaaagtctttcgtactggttccaggtattttgacacaaaaacgtaattttaaacagttgtcttgaaagtaccaagaagaattcatttatatcaatgtcacgtgagtgaagagttcctaaattaagaagaaatgttacagaggttgtcagaaaacaaataaatgtgatgtcaatgtgtattaaataaaaatctaaagttatattacttacacagagaaaaatcattttcatattgcattgcagacaaataatataatgctattgatatcttcacagaaaacacagtgccatacattttcttaattatgtgtgctcatatcaccctctagtgggcaaaataaagcagaacataaaaaaggagaaaagaatctggaaaaaaaatccacagcattcactgattcattcattcagcagcagctattacttacttcatcctcactacagggaaagcactgcgataggtgctgttcaggactaagacaagaaaagcaggaaaagcggaaacagaaagacctacattggaagacctgtttggaagcagtatagggaaagagaagggaataaaatggcgaaggaaggtatgcagagtgtggaactgaggtgaatctaaaatgtaaattcattttatttatgaaagaactctatgaaaaaacctccagaactgaacttatcatatatttaattttgaaataaactaatcaatgtagataatatctttcagggaaataatgtcaaaaatatatcttcaacagtcagtgttttctgatatgtcacagatgtatgtgcatacatatatacacacagaggacaaaaaagtacagtcactatcttcctggaccctggatttaatctaatttattgatttgagttgagtaaacttacttggtttgttgttgttttgttttctaattactattttttctgtaacccagaacagtattgatggtgaacttatttgtgatacaatgtagaatggatatatttgctactccatggccactgatttataaagggaaattgggcattgaaattcagatcttcactcttactgttttcttttaatttcctataagtaggctagaagatatttgtgatggagatcacttccatttaatgctttaaaagattagctctgcaaagagacattgtggattcaaacactggcttcatccagatagggacaggaggcagggaaattctacgcagaagagggcaggtccccagcaaggaccctgctctcaagctgaaaagcctgataccacggcccaaagtgagaacttacatccctgttttcctgctcaaatgttgccttttctaaaaccatccatggcccaccccacctgacatcctgtgcccataaaaaccccaggctcagccggcagagggaagagaggcagctggccatcagacactatggctggatgtcagagagaagcagcttgacttcagagggacagcttgatggtgtaacctgggagaagaatctggccagagagggccagacttcaaggtaagactaccttcctgctccatcctcttttcacttccccttcccactgagccactttcatcagtaatgaaatcccctgaatttaccatcttcattttattcttgagacctcattcctcctggatgctacacaagagctcgggtgccacaagtgtggtgtgagtcagtcacagctaccctgcactaagctgttaacacttaagctgtccatggatgacagagctaaaacagtactgtaacacttcctctggggcttcaggggtcaccagcaccctctcagatgctgctgtggggccagtacagagtttgcttctgcccgtgcccaaaagcctttgccctggctcctgcacctgctcacctgcatgctcccactcctgtggtctgagtgagtggagctctcccctgccagcactgaagcggctgcctagttccagcacctgtgcactccagttcctgcccgtgaaggggtcagggaaataccctgcttcaatccaactagctgtggaatcttgaaccactgatttaacctgagtgcctcatttcacatttgtagaacgagatgactaccatcacctgtcttataggagagtaccaaatgcatataaagtgcctagcaaaagttactcttattatttactgcattattatttatcataccattctttactacaaaaagtactttcaaataaaagatataatagagaaaagaaattccctacaatttttgttaatagttaagtactgccatatctaaactgtgcaccttaatgtatttcagaagacagtatgcaaattctataaattacacagtatacacacacccaatttataatattataaacttataatataaacttgtaatataaatattacaattataacaaattgtaatttaacaatttgttaaactaatgaacaaaaagttatcagctacattctatcaaaccagtttaccaagcttagcatttaagttagcaatattttatatagcctttttcattctaaagcagtattatctcacacaacaaaatttttctatactattttcacagtaaaattatgtatacctttaagacatttaagaaagattattttaaaaattgctctaacccattaagtttatcttttaataatttattgtaacatacattttacaacttaaaaatcaaagaaataaatataatttctagactgtatcacctatacatgtaaccatatataaaaaatttacatgagcaaaaatcactataatttataaaaacataaaataacattttttcctactatacatcaccttcagagatcttgccacatgaacatggttatcgtagactaaaatgtctattgtcagattttgtagccgatggatgtgacttaaatcaccttcaagaacaaggtcttgtattaagactctccaagatggaaatggtgtcctggtgccatcccatacctgccataagagagtagagtagttttatgatccttttgaaaaaatgcttgtgctaaaaagttttttcctggaaacagtatttaaaagtaattaaacttatgcctctgaatattggcactattttaaatatgacattattttctgattgttaaagaactacatatgaaatatgggtaatgtggaaaatgtagaagaatgtaaaggagaaaaagagtcacactgccataagctcagactaaatattcctgagtcaagtgctttatacaataaaaacaaaccaaaatgatcttgaaaaacactcatatgtattaaaatatttttgcacataaatacaactagtaaaattatgaatgctctaaaaattataatagtaatacatttgacattaatcaaattatttttatgagattcagtctcattcttaaattagttgtaaagcattattctgatgtttccatacaaagaagtaaatgttgtaaatttgaataatttcctttatatgatgattttctggttcacattatgctttttcttctccaaaccgtattacaggtgagacatacaaattacccaccagctctggctataaatgacgcctggttatttatataaaaaaaaaaaaccataaaacaaaacacacaaaagataaggccgcaccaatactgtagatattaaaacaaatagaatatatacatttagagaaaactcaatttgagagtattgctcagaaaaaaaaaacatataatattaacagaatagagaaaaatatggaatgatgtcagatcaacaaatttattaaattatatttaatgcaaacgattggtataccacggctactgaaaaattaaaataaatgcactgtggttagtaaaaaaggtaccaatattaatattgtgcccaggttgagatggaaaatgattatactattttgtatgtaaccagacattatatcgagtaatgtctagctcctctgttattaaaaaatataatttaaaaattatttctgatacataagaaaatcactgtccggaaaaaaaaaatcactcatatttcccagagttgaaaacagtaaaatgttgctttataggcctcccaatatatttttgctatgtacatatacatttttagtgtgtaaatgaaactacagtaatcactaaatagaccatcatgaaattctatctcaacaagtgtatgtctataatgtcattttatggttacaaagtattttatggtgacatttacaatgttattttatggtcatcctacataaatagtgtacacaattctctattgttagtatttgtttttttctaatttttctactgtattctcattttttatactgtaagaaagataaatatattcttttaaatgcacctttgtaaatattttaaattatttccttaagataatgaaaataaaattgctgagttgaagggtacaaaaagacttttgaggcttattcttaaattgttgtaagaaaggcttttactaattcttttctttaaattttgcttgaagttttgggatacatgtgcagaatgtgcaggtttgttacataggtatacacgtgccatagtggtttgctgtacccatcaacccgtcatctacgttaggtatttctcctaacgctatctctcccccagccccctaccccacaacaggccccattgtgtgatgttcccctccctgtctccatgtgttctcattgttcaactcccacttatgagtgagaacatgcggtgtttggttttccgttcttgtgttagttggctgagaatgatggtttctagcttcgtccatgtccttgcaaaggatatgaacttatcctttctttggctgcatagtattccagggtgtatatgtgccacattttcttaatccagtctaccattcgtgggcatttgggttggttcccagtctttgctaatgtgaatagtgccacaataaacatacgtgtgcatgtgtctttataggagaatgatttataatcctttgggtatatacccagtaatgggattgcagtgttaaacagtatttctggttttagatccttcaggaatcgccacactgtcttccacaatggctgaactaatttacactcccaccaacagtgtaaaagcgctcctttttctccacatcctctccagcatgttgtttcctgactttttaacgattgccattctaactggcgtgagatggtatctcattgtggttttgatttacatttctgtaatgaccagtgattatgaacttcttttcatatgtctgttagccacataaatgtcttcttttgagaagtgtctgttcatatcctttgcccacattttaatggggttgttttttcttgtaaattagtttaagtttcttgtagattctggatattagccctttgtcagatggacagattgcaaaaattttctcccattctgtaggttggcctgttcactctgatgatagtttctcttgctgtgcagaagctctttaactttgtcaattttggcttttgtcaattttggcttttgttgccattgcttttattgttttagtcataaagtctttgcccatgcctatgtcctgaatggtattgcctaggttttcttctagggtttttatggttttagggcttatgtttaagtctttaatctatcttgaattaatttttgtataaggtgtaaggaaggggtctactttcagtttactgcatatggctagccagtcttcccaacaccacttattaaatagggaatcctttccccattgcttgtttttgtcaggtttgtcaaagatcagatgattgtagatgtgtggcgttatttctgaggcctctgttccgttccactggtccatatatctgctttggtagcagtacaatgcttttttggttactgtagccttgtagtacaggttgaagtcaggtagcatgatgcctctagctttgttctttttgcttaggattgtcttggctatatgggctcttttttgacttttcaatattgtattttaaactaacagttacgtgacagtggttttcacttgtccaaaaaagttatctgttacaatgggatgcaggtatgtgctgtgtttctgcagagagaaaatgtagactcaactatttcagctaaaagttggcacattttatcttagaatttaagaattttctaaaaacacagtcaaaagatagaatatgcctcagtgcatagtagtagagtccttgtcataggaagtgttcagttgttagcaaatgctcatttgttaagaatgtcacttttgccagagtatgactggttgacctagattcgctctaagtttgtttgattttatattgctttagcttcagctttatcatatttgacttatttaactttctgcagggcatgtatttacgactttctcataatattccatgtgtatatgagtgtgctattttcaactgctagaactttgtattttattcaatgatttctaacttctctgttttttaatatgggcaaggtgtaaatcataataatgctaaactccatgacttgtccaagtgccactgcattccatttcttgccctattattccaaagatagtatagagagaaataaccataggagcaggcctgaagaggcatttgttcaaatgtatcctccataggatgtccaggcaagaaaaacatcaaacatccagcttctccagaagttactctctaaactgggataggtatatacagagatttgatgggtcttaagttatttttttatcttgctgatttaaaagcaaaacacagtaatgcaaaatgcttcaaaactgtccatggtatgactatgaagtaggcagtgaaagacataagaagagaacccaacatcaacgggacaaaaaagtaaataaatgagagggaaggtgaccttgacagggaaacagaaatattcatgtataggactacaaactatgaaataatagaaaacaagtctacatcttattactactaaaattttaaaaatgcatcagtcatactatatttaacatgtagatctaataacactatatttctctggaaggaaagtgtaaaattttagagaggtacaagagtagagctgcatgaatattgaggctcgtcaaaaatagttaaaatttaagttcctagtataatacacagcatgctttatctcatcagaatgctgaaacataagctctttacagacatgtaagtggtgctaacttataattcccagtattaaaaaatatgtacctttagaagaaatgatgctccgtccacttctgctttgcccaagagctgacaagtcaggtcaaaatactgcattggctgaacatcacacaattttagtaatgtccaagacggtgacatatgagtagatgcccaaacacgtaaggcttctaccattttgtggtcctcagtagtgaagttaaaatacttgcttgaagtgcgaggtatgataggggctcccaaagttccctcaaacgtcaaagatgcaaagccagagctggtgataccctgagtctcctttttatatacttgaatctaagaaagtagggcaaagtagaaaacagatacaaataaaatagcttactgatgcacaacctacgaaccaaagaaactggaaagattatcaattttgccagcataattaagagagggcattttttaaaaactatttttcatttaattagcatgtaaattctacactcaagtgctggtgctacaccaagatacagaagtatcatggaaactgtgaacctccatgcaaaattcacttacattttttaaagagctaggtggtagtctccctaatcctatcaagcttgcagttttacatttattagtttttttattaaggtgtaatttatacaaggaaaaaggaccataaatgacagtgacttatgaatattatagaaaagaccagaacacttgaaatatgagaatataaagtgaacaaaatgaagctcaggctagagtttaatcagagtgactgagagcactgagatatgccataagctcttttgctttctgaatttgggggctgttatcagaggcacatacatttatattgttacatcttcatgaagtgacccctttgtccttatgaaatgctccttccaaaactctctcgtagtaatatcgttacttcatttcccttatgtttactttgcacattttttttcctacagttttagttctaacttgtttaggtcttcatatttaaagtgcatttctcataggtagcatatatttggttcctgattatttttgttcagtcaatcttttccttgcaattggaaattagtccattcacagaaatgcagttattaacatggccatatttgagtctactatcttatttgttttcctttttttcatacttcttgcttttttgcttctttgcttttttaaaaccattttttttcctattgttcctttcttgttttctttttggaattcttactagtgctccatttcgttcttcttagctatgaataaatctttaacttcttaatgtccacttggaatcaatattgttccactatgtactttctactttccatttcatacttgccacttcctattttacgcgttctacttcacaaatatcttttcaatggtagaattccatttacttatcccatccatcctttgtgttactgttgtagtattttttctacatattttataatctccaccatgtaatattattggttttgctttaaatagacatttctcttttaattaaattacggaaagaaaaacattgtgtttacgtatttgctatttttttccatcatttcttgtatttttgtcacttcttaactatccagcttctagttgctagcattcctctttggcctgaatatcattctttagcattaatgctatgcagatatgctgccatggactatctcatttttcctttatataaaatgtttttattttactctcattcctgaagaatgtatttgctggatataaaattctgtgtgaataaatttttttctatcaccatataaaacttacttctttgttctctgggtgtcactgtctctggtaagaagtgaaagatgactggtatcattgttctccaacaatgcatcatttttttctccagttgatttcaagatttttctctttctcaatggtttcacattgagaaagttttgtctggatgtgcgtttctttgcacataccctgcataaagtacatttaagtctttgtttttcatcaaatttggggaaattctggtccttatttctataaatattttatttcccttcaccctctctcctcttgcatcctaaattacatgtaacccttgatattgttccataggtccttagggtctattaatttgtatttaatccttgttcttcagattaggtagcttctaatgatttgtcatcaatttaacttatatctgatctatttagcccatccattagatttttcatttgttcttttcagttcctgaatttctatttttttaatagtttccacttctctgatgaaatttcttttcattcatttaacatcttcctctaattcactgaatctattttcacttaattccttttttaagttattttatttattaattattattattattattattttgagacggatctcgttctgtcactcaggctggaatgcagtggtgtaataatatttcactgcagccttgacctcccgggctcaagggatcttctcacctccacttaattctttgaaagtctatataatctgtgctttaaagtttttgtttaataaagacaacatttgggctaccatggagttggtttggaatgtgtatgattttttcttttttcttgactaagggtaacactttgttgttttcatgtagaatatatctttttttctttactagacatcatagatgctatactgtaaagactctgaattatgttggcttcttctgacaaacactgatttttgttcttgttggccactgagttgttgtctggtcatcttaaactcatgaatgcttgtttttatgctttgttagggtgatacgtggaaagcccatgatgtttcccaaagtcttctaccttgatgggactcaccctgcaaactctctgcgaagtcttctccgtagaacttgtttcaggctttgataaaacatgtgtagaataggccttactataagatgtggtccttcgtgaggtgagctacttttggggggtgaaacctttgtgctgcctcagctgaatgtccaagctgttaaggaggtattaataaggttatttgtccctgactatcttggacttccagcaccccattactagacctccagtatccatttcatgttcaaccacagttcaaccacacagcagcttttgtaatccttaagtagttctaccctgctctgtgcagcctggctttcaaccaagtattcgagcccaccccaaccctggtggacttttagacatccccttctgtataactccttcctctctggtttcttgttgtgaaaattccagctttcagctgccttgaactttgactttagctatagcaggaccacagcttgaacttcagcttactgtgcagtggttgagaaaatgtctataggcagggatgtggtcatcatggggctcactttataagtttctcttcactctctgatcatagctacccattgtccgatgcctaaaaaacagttgcctcataacgttttatgggtcttcgtggtagtagggctagtctagtaccagttaatttttcgtaacacagaagttcgctctgcagattctaactatacttgcctacaactgatcgattacctaacttttaaatgggttctacttgatgtatatgctgcttctcttttatactccaatgtctgattgattcttggttctgtggtcatcatttttatcaccaattccatgctcactagtgtatactgttgactaaagcttgcctctgctgattaacatagtaaaccagaacaatcttccagcttaggtgtgttggtagctttcacatatcatttatgagcaggtcctctttgcttgagattcaaaatataccttaattagtctacttctatttccaccaccactgtagtctaacgcatcctcatttcatgtctgtaaaactgaaatagccttctaaagaatatctttgccttcatgcttgttcttcaacaacccatctgttatccacgttagtaagagagatttttttcaaaatttgaaccaataatttcatgttcacatttaaaaccctctaatgacttctcattatacctagagtaaaatctaaataacttacctaccacaatttcatcttgcaacacctcccccatggctgcccatgctggtcttatttctgtttctccaataccatgctcattcctatcacagggccttggcacctatagtgtcatctggtggaaaacattttccctcaaatctcagcaggacttctcattatcatcatttgggtctcaattcttatgtctcctcattagaaaggcctttcctgattttgctttattatttttatttatttatttatttattattttttttggatggagtcgtgctctgtcacccaggctggagtgcagtggtgcgatctcggctcactgcaacctctgcctcccgggttcaagcaattctcctgcttcagcctcttgagtaagctgtgactacaagcacccaccaccacacctagctaatatttgtatttttagtagagacggggtttcaccatactggccaggctggtcttgaactcctgaccttgcaatcttcccacctagccctcccaaagtgctgggattataggcgtgagccaccactttattttctttatagtagctatcactacttgaaattactttgatttatatgcttactttcatactgtctgcttctttgcattaaaacagatgcctatacaataaataaataaataaatatttgctggaaaaagaagagtagatcttgactcttgttttaatgtatatttttgctatgaactatgatcttcaaattgcaataagaaaaacaagaaaaaataaattctgatatctaaaacaaatgtctgtacttagaatgaccttgctcaaccaaagacaacagggcgattcaaagctagtggaactgtcaacataaagagtgtaaggaagcactactagccgtaaatatgaacatttcatgaaaatagagaaacaactttatagaaaaatatagtaatgctaaatctatacaggagcctcacaatatataaaacataaaattaaataagaaggcttaaaccccattaacattgccttaaattattaagcaaaatcgatagagctaaaggaaacaggcaaatcctctatcatagtagcctttaaaacagttttcaatagctgataaaatagataagaaataaaaaattatattgaccatatgttagaatataaagtaagcatccacagatttcaaaatactaaacatttcagagtatgttttctgaccaccacaataaacaatagtaaaaaaaggtaactattaaatgatttaaataaatataaaaaagtaataatcctaaggaattggattgaatataattcaatatatatattatttggattatttgaatataattcaaatataattcaatatataaatatatgttcaatataattcaatatattatattcaataataattcaatatatattcaatgataattcaatttttttgaattttcatattgatttcctctctgacttatggattatttaagaattatttataaacttacagatcagagatgaaatctatgatcaatgtaaaaattcaattatatattgaactgaatggtaatgaagttatgacaaattaaaaactgctggatacaactagggcagtacttaaaaaatttatagtcataaatgaatatattacaaaagaagtggctgaattattatagtagtacagttaattttatacagtgataataccgcatctttacattcattcacatttctctagactgtgaatggagccatgcatggtctgttagtgtttgtgtatacaaattgttgaaaatctccaaaaaattttccaaaatacttattgaaaaaagtctgcatataagtgtacccatgtagttcaaacctgtgttgttgaaggggtaactatatgctgttagaggtcatgagactctttactcctgtagcaggagacacaataatgaccttactggagggggttatgaaggaagtttccagagtgttagctatgtgagtatggttatattgtgaatgatgagatgtttatctatttgctattaaatagtaacttccataaacaataacaacaactaaatatgtttatgaagagtgtattgtttgaatacagtatacaggaaacaatactgtgaaaagtaagcaattttttgacgtttaaataagtatgtattacatttctatgatgataatatttctttttatttatttatttatttttgagtcagagttttctcttgttgcccagactggagtgcagtagcacaatcttggctcaccacaacctccgccctccgggttcaagcgattctcctgcctcagcctcctgaatagctgggattacaagcattaccaccacgcccggctgattttgtatttttagtagagacagggtttctccatgttggtcaggctggtcttgaactcctgacctcaggtgatccgccagcatcaacctcccaaagtgctgggattacaggtgtgagctaccatgcctggctatgataatatttctatttctttttatctttacacaaacattctctattatcctcttattctcaaggaaacagcattaataggtcataaaaagtgcctaagagtagaacacagctgaacactgtcctcgtttatgagcagcagactgaccatgaaggacagaattaaactcaagcattagaagaaaaagacaaccaagatgatgaagaggttacatggaaacccatgtaacagaggaaaagatgaagaaacagaaatatttaaaatctaagggactgaatatatacaaaatatttaaaagctgtccaaagcatcatgtagtaatttccaaagaaaaattccagaagtgcattgaacaaaaaagctcaattaaataaatattatagcaataaagataataattttgagaaaataataatcctttgtatttgtaagttctaaaatttttttaattgtgctatttaataactctaccctatattaaaggctttcttacatttagttatttaactacaggcataatttttaaagttcctgttcatatcttatttcttataaatgaaaaccaacttaatttgattttatacttagtatctcaatgttttcattgaacttgaattaacacaagaaatgggaaagaataatataatctcctaatctttgtatacattttttcttgttgacctaaagctcttttttaaaacattaaaaaataaatgttctttatcaaaatctacagataaaacttctatagcattagtctgtatttagaaacagaagacagaatggaaccagttttaatcatggcatgtaatacatttctggggaatgaaagcagtggtttgttcaaatgaagatgtttcttactgtaaattatttgaagtctgataatatttacattacttcttatctcctgaaaagcttgctgtcatgttctaacaaagcaactatataattagtgctaactagtttcagtgaacaatacagagttctcttcaaataaatataagttctagacaatatgaattataccttcagcctgtgaaagcgaacaatatctccatttttataaattattggaagggcttcatagtttccactaaagagcaggcaagttagttttacatttgtctggtccacaatagttacaactgagcaataatctggaaaacacaaaaatattttacctgactttcaatattttaaagcatttgataaaataagaatatgcttacttcaaaacaccaaaccttattcttccttttaattaagtcttctaagaggattaaaacagagacattttcttggctttcaatacacactgcaaaattattttgcagaagtgttctataaatactaattttagaaagtttagtaaaacaaaaataaaaatctcattcagtgtaaattgtctggagagaaaataaccttttctattgcttcaaggtttacaaatcatgaaacataaatgtagtcaaataagaaaaatgcaatttataaaataaacataactaaatttagaatgaaaacaaaggctaagatatttacagcagatatgaagagttgcatccatactgcataaagaatttatgaaaactgtcataaaaatcaggatgatacagtaaatatgtcgtacaaatgaataaacaatacatagaaaactatgtcataacaaaaactcaaaagagaaaatggtaattcttgctagtcacctataaaaaattatacattataacaaaagagaggtatttttaaaatttaaactggtagaaaaatttaatatttgggttgctataaaacgataacttcaaacactggtggtagtaaaaactgtaatagatcctgccttaaaattttttttttttttttgtaattaacatataaaagattgtatgtatttatggtgtgctatacatggttctgaagtacacatacattgtgaaatcatcaaatctagctaatgaaaatacacacattacctcacagttatttttgcagcgagaacacttaacatccattttcttagcatttttcaagaatgcaacatatttttcactatagtcactatgttatacaatagaacccctgaacttattcttcctaactgaaatattgtatcagttgaccaacatctccccaaaaccttcccataaccacacagacccctggcaacaaccattctactctctacttctataagatcaattttttaagattctgtgcctggcttattttacttaagaatgtcctccaggttcatccatgttgttgtaaatgacagaatttcctttgtatgtctaaatagtattccactgtgtatacagaccacattttctttattcatccattaatggatgcttaggtttattctatgcctattgtgaataagcctgcaatgaacatgggagtgcagatatctcttcaacatactgattatttacttttgatatacatagtagtactccctatctgaagtgtcactttccacagtttcagtttcctgcagtcaactgtgatctataaatatttaatggaaaattacagaaataaacaatgtgaatcatctcttcatgcagggtatccacactgtccacgctccctgcctgtttgtcacttagtagctgtttcagctatcatatcaactgtcgaggtatcgcagtgcttgtgatcatgtgacccttattttacttaataattgccccaaagtgctaaggcaaagtgataagtgcttaaactttatcacagatacgtatatttaggagaaaacagtatatacagggttcagtaccatccacggttttgggcagctgctgggggtcttggagcatatcccctttggacaaaggaaaagtactgtacccagtagtgagattatgggatcatatggtagttctaatttttggaagaacatttatatgttttccacaatacctgtgccacgtacaacgtgcaaatgttatcttttcttcacaccctctcgatactagtcttctttttgataacagctatcctaataggtgtgaagtgatatcttgttgtggttttaatgattagtgatgttgaacatcttttcgcatacctgtctgccatttgtatgtcatttttaaagaaatgtctattcaggtcctttgcccatgtttaaattgggttgttttctaaccatctagttgagttcctcatatactttagatattaacccattatcagatacagtttgcaaatattttctctcattctttactctgttaatgttggctgtgcagaaggtttttaagtttgatacaatcccatttgtctattcttgctttcactgcctgagcttttgaggtcctttccaaagaatctttggtgagatcaatgtcatggagctcttcccctatgttttcttctagtaggttcatagtactacattgaatagagtgggcatctgtcttgatacagatcttagagaaaaagctttcaactttttctgcatttattaaaatgatcatataatttttgtgctccattctgctaacaaacattttgatttgcatatgtggaaccacccttgaatacctggaataaatcctacttgatcatggtgaatagtctctttaatgtgctgttgaatttggtttgctagtattctgttgaggatttttgcatctgtattggcctgtagtttttttgcttgttcagtttttattgtgtctttgtctgtcttcagtatcagagtgatgctggcctcgtgaaatgagtttggaaacattcccttctcttccatttttggaagaggctgagaagaattggtgttagttctccattgaatgtttgatacaatttgatgctgcctatatacatgattcagaaaatgcattgactttctgtccttcctagtcccctagtaatgaaggtatagagattgaaaggaacaaaccccaaaacagtgaaggaaaggagagtggaagaaaatatcaacatatttcaggaaaatggaaggtaagtggttaagggataaaataaacagaggaggccaaaatccagaagatactacaaggtggctacagtgaagatgggagccactgggattaagggtgagagtaaaaagtagggctgaaatcaggggatcaattagaagtttacacacagaacaagtgtttcaatgactacccatccttattctccgcttccctgaaaatgacttcaggcagcatctttgtatttaacaacctttccattttgcaaaattctaggaacaaaggctcttttccaagggggctgcactcattaactgggaagtggtaagacttctcatgttggtgttaacaactagaataatttcctcctcaccatcacattagggaacctacagcctagttggaagttctcatcccacccaccctaggctgaaaatttcaatcaatatgccctaacaagtactattagtcactatcaagtttcccactcaaggggagggcgtattagagaaacaaactacttacatacaaagcaaaggagaaaggtatataaaacctaaaataaactatacctacatttttaaatataaaaagacagcagaaaattaccagacattagaataaaaatggaagacactgtaatcctagcactttgggaggccgagtgggtggatcatttgaggtccgcagttaaagaccagcctggccaacgtggtgaaaccccacctctactaaaaatgacaaaaattagctgggtggtagtggtgctctcctgtaatcccagctacttgggaggctgaggcaggagaatcgcttgagcctgggaagtggaggttgcagtgagccgagatcatgccactgcactccagtctggatgatagcgtgagatctgcctcaaaaaaaaaaaaaggaagacagaaagaaaatgaggttaggaagacaaaggagagaagggaatgagggggaggaaaaaaggagagagagagtaaaggggagaaagaagggaggaaagggagagaggaatgggaagggaaagggagacaagaaagaaaggagggtagaaaaagagaaatctgaatttgtgagaagggtgaaataacttggaaccaaaaaaaaaccctaaaaatgaaaaacctttaataagcactttcagaaagagtaaaaatatattatattctcatcccttgaggacccattggctccagttttaggttttaagtttcctttgtcaatatttcttactattagtaaggactgatacttcatgacattttttctttgctagtggtcttccaaagaccaaagataaattttatttattttccaaaatagagaacacattcttacttgcaattaccatatggctctattgtacccttttatatatctgacatacattatgggatcttttttcctatatcttgaaatatagatattcattatctgagtaattatttcatcactatgcattaattatttctgtgtacacttaaaaagactaatttttaaaatgtgaaatgaggcaattgtctaaaggatgatacaagaatgaaataaataatcactattatatcattcttcagtttttgtactgcaagacataaaagaagtctggagacaccatcttttgagtttcttctttagctttatttaaacatggttaaaaattcagaattttaaaatttgtgcccatggtcagtgagaacactgatggaggaagtcatttaaccattattagatgaatcagaagctaaatgcaaaacagcagcactttagctaatgatgataaaattgatcacataagtgaaatctcaggctatttatctccagatgatatcctatataaagtttctcaagctcaaaaattgatgcatgaaaatatgtttctaaaaatagggagaaaatacaaaatatttctgaaaacagagaggaaatatggtattcttatccagtaagtcattcaacaaaaatgatttcaccatacgttattctgggacatgactgaggaccattccattttgctaaaatgacttgtgatggcattctttcatcttacatgatatttacataccaaaatttacataaaatggcatggaagtggatatgcagtaggcaaatgtataaataaaggtagtggaaagaataggtgatatcaaaatgaaagatcaatctttaatcatttgaattgatgttcagaaatctaaaatagaaactgctttgtaattatggagcaaaaacagctgctctctccaaaaaaatttttgagtcgacaaagttttcaaaagtattttgatgatgcaagtgcaagaagaaaaaccaaaagcagtaataagctagaaccatttgtttgtatatctttaaaactaggaaaatatgggattatgaaataaaaatgactttgctatgtttatatcctttttataatctttaatgactttattacctctttattcgcactgctgtataatatttgaaaaatgacttaaacattcaaaaactttaaaaggtctggactcatatagtaaaagataatgattgtttttcctattatgcttaggtgtcaaaaaactgatatctcctagaacttaaagcaaaaggaaaaagaatgacaaaaggacagaaaatagaaggaaaaaaatgaatgagacagcaaactcaaagaattgggccttctgaactctgccttctgagaaagagatcctctttatggatatctggatatggtgcacctgcttccccacaatgaggttatatcctcacttacgcaatttggttcaaaactcaggggcactgaacatatgtaccattactgaagtatacagactgtttctgtaaatttttctggaacatacatattaaaggaaattcatgtggcaagaatgggcccttgttctcaactgcagcacttgtgcacttttgtggacattccacagcaaatacatactctgtaaaaaatacaggagcaaaagaaaagccatacaaaaatattctactgactgttctactctacatagactttgtttctgttaaattctgtaccccaggcaaaaaagtcagaaccaaagaacagctaacaatcttattccataaaatcaaccttagtacaatatctgaccaagagaagccccaaaagtaaattgttcaagaatagaggaagaacatttactagaaatgaagatgcagtcttccaattaaaagggcccattgaaggcaaacaggataaatgatcacaccaagtcacataattgtgaaattagggaacaccaaatattttttaaaattctgaaaacttctgtagagaataaaacaagttaccaatgcaagactgtgaagcagattaacatcagacttttctatcaacatgactggggttactaaaaagacaacaaatcaatggcttcaaaagtctaaggaataatttcgatacttcaactttataaaacctgacaaaactatcaatcaagcataaagacagatgaagaacatttccagattttggccaatcagatattttacctccacagtatctttcttaggtaattctccagcaatacaatgggaaaaaccataaaacagaaaaaagcagagtacggacaatagtaatggatctcccagatagatagatagagagcaggcctagcaaacaactactctagattggagcagaagaaagggagctgataagaaaggagaggtccattaaaaaaaagagtaatcaaccggtcgtgggggctcacacctgtaatcccaccgcttaggtcgaggtgggcagatcatgaggtcaggagatcgagaccatcctggctaacacagtgaaaccccatctctactaaaaaatacaaaaatttagccaggcatggtggcgggcgcctgtagtcccaactactcgtgaggctgaggcaggagagtggcgtgaacccgggaggcagagcttgcagtgagctgagatggtgccactgtattccagcactccagcctgggcgacagagagagattctgtctcaaaaaaaaaaaaaaaaaaaaaaaaaaaaagagtgatcacttagcataatgttctccagattccttcatgttgtttcaagtgacggagcttccttcttttttccacataatttcatttatacatggaatctaaaaaagtcaaacttacagaagtagaaagtgattatcaatgcctagcgggtggcagtggtgagaaatggggagatgctggccaggcacagtggctcatgcctgtaatcccagcattttaggaggccaaggtgggtggatcactagtggccaggagtttgagactagcctggccaacatggcgaaatctcatctctactaaaaatataaaaaattaaccaggtgtggtggtgcgtgcctgtaatcccagctattcaggaggctgaggcacaagaatcacttgaacccaggaggcagaggttgtagtaagctgagatcatgccactgcactctagcctgggtgacagagcaactctgtctcaaaaaaagcagggggtggggggaagaagctcaccaaaggatatacaaactttcagttcaacaggaggaataaattttcaagatttgcacagtgtggtgaccatacttaataatgatgtattgcatatttcaaaattgcaaatagattttaaatgttctcactataaaaaataagtatgtgatgtaatggatatgttaattagctttatataatcattccacaatgtatacacgtatctaaacatcacattgtcccccacaatatgtatttgtttgccaatttaaaataaaaatttaaattaaaacaataaataatcccatacacaactacatatttatataaacttaagggcatagtgaaggcgcagttttattattaataatgatagcaacaaaaaagaaaaggcattaaaaatcccacaaaatataaaaggctatacaggaatatctgatccaaatatgaagaaaactaaaatgtagcatagagatagccaaagaatggaagaaatatgtatggttacagaagagaatataaatgctcataattatgacaaaagataagtaaaggtatacctgacagaagactagagaagaaagtaaacaacaacactgaataaagttgacgaataagaaatgaaagacaaatatattatttaaagttaaagagaatcaataagaaaaaaagattaaaaatttaaaaggaattatattttccatagtataaaacatttatataatctaaactcttcctctgaaaatactaattgtttgataaattacaaccacatggtaacacttctaaaaaatcatttctccaatcataagttaatcccaggataaaaacaaataatccaggaggtgaacaaagatgggaggcaaattcaaaagctaaaacacatctgaaagggctctcactagaaatctagagttttggaaattatataccaagtctgagaaaagaaactacatcttggtctattgcaaggtagaagctgaaagtgagctatcagcagaaatcagtgaccttaaaaaacggtagctagggaaaaaaatccacctgctagcatagggaatcatgaagaaaatctgcctgtctgtgccacggtttggaaatgagggaaaaataataataggccagtttgtggagtaactggcattaatacattcaatgaaatttctgtagatatcctcttagtttggttttctttagtttttgttttgttttggttttcgttaatggcaaacgacatgctgactctaaagttaaaatggaagagcagggggctaccgttatttaagacatacttggaaaagaagaatgcaataggatatttttctgttgaatagcaagattaaaaagtaaagaaattaggataatgtagtgttttctgagagggaaaattcattctttagcaatataagattttggtgataaagagaaaaaaatcactatcacttctctatttgtacttcacctatgtaaaagttaattcctactacatacattaacggtttcatctaaaaacaaatcccacaatacacaatacaacaactgttcttccacacagtacatcatttatgttatgtgacatccaactaacaccctctcacagaggattttttggtaatagcttatagtgtttccccaaacactatactggctattaactttgcagctggattcataagcatattcccaatagtgtcacttgaacctgtttatgctgtaagtagaactgtgaataatgcctgtatagttttgatgccccttttccccacaaatgtgacataattaagcaatttcacagtgaaacaaatgattggtttgccaataaaaaaaaacacacaatgtactttgcataaaacacaactattttgaaggtttgaagtttcttaaaatttcgtgataaacacaagggcaaagagttcactagtctgacaaaatccaattcagattttaagctgcagtaattctgtattacgtctctcactttaaatgctccaaattgatctactttcgtaaactgtgaatataagaccaatacaggaaaaaaactgtgaatttaactaggcataaataatactaaatagtttaatttaatgttaatgttagtttaacttaatgtttaaatagtttaatgttagccaagatgaactgacaaagctcagtccctgtagcacttacataatattgaagaatgtaatgactacagaaaactattgagatttttgtaaaaatttagatttaatctaaattttaaaatactgaaaattgtttcacattttgatttttctatgaagatgtcaactttccaaaagatgacctaacagactgcaaaagactctaggtaacactttgagaaacattattgtagacccactatcgagatctttacaaggccacctcttgcttttgcagaatctttgtgcaagttagaaaaagactctcctttctcaaataaaagtactgcaaaaacctaaacaattttacagaggaacgtgactgagtccaagagagcagcagccttggctacatacacacacacaattctattaaatcactgaattgtaggctcagatatacttacagtagcaatacttccaaaatatcatctacttgctacaatgcaagctctctaaaatgacgtaactacacgttagcatgttcttagaatctcctaaggttatctataaaataatgagcagtttcaaaataaaatactctttcaatatacagtcatgtactgcttaatgatggggatacgttctaagagatgtgtagttaggcgatttcattgttctgcgatcaccgagtgtacttacacaagcccagacgatgtttatttttaaagttatatatatattttcatatgaaaaaacacaatgtcccagcatcattactacacatcagtcatttcccctaactgatctgttatgccaatattaagtgccacgtatcaggtttctacacatgctccattataatcttacgagaccactgtcatacacgcagtccactgttgatcaaaatgttatgtggcacatgactgtactttatttttaatttaaataagtacatatttattaaaagaaacaaaattcaggttaagagaacaagtggcatttaaaaaatctattcaataatctatcaagaacaataagaaaaaaatagcaagctaaaagaaatgttaaacacctttcaggttccctcaattagcattagattcatggcatgaagggaaccacactacttgttttaacaaatagtaacaatgcaaactgctaaaatatgtcttatttaactgctccaaggaagtgaagtgttttaccaaatacacacgcaaaaatatccttcagtaatgacttcacaaataaaaatattttccccatgccttattttttgctctttcccaaacgaaggtacaaagctaaaggtaatttagaagtctatcttcttgttagctaacattaacagggaaagtggaaagagtagaaaatcctttaataaatcagcattcgtactttaaataaatagtacacagtacttataatgtatatctttaaaccattgataaagtgttgtctttaatgctttagtaatacttcatatttaaactgctgacaaagtacttaactagtttaacactttggtaataattcacatagcttgatataaatctggaaaagataacaaatgataaattaagttttctattttgcaatcttgagcaattcaacgaattgactcagtatgattaagtgtaaattgccttggagttttattataagggagagctggtagttcatcttagcaaggtttttaatcaaagaagcatgcatgcataaattacacaatccagaaaaagttcttccatgaaagttgcttcatctcctttttatctactaaaacactgctgtttttaaaccaatcagtatttgagcaacactattccattggtagaaaagtatatcattaaaacattcaagtaatacctatgaaggcaaatcactgaatcaagctacattatgtgctgtcatcttacttcttttacaaggaaacttactgtacaatacaaaaataagagcactctttatttttctggtgtgagcttacataatttccacttgtgctttcattctattgcaagagcatgacagcatggaagatgaaagaagaaagaatatatgttatgatataataaatattatgatatatacagtgacacagattagatagatgttagacattgcatgagttcataaacgttattctggtggagttttacttccatgttttacactatacataagactagagaaaaagtcttttaactgaatgagtaaaagactgtaccacaagttttaagaattaaaaaaacagtactaaattttatgattcattaaaacaattcaaactctaaactaatgaagacagggataattctctaaattagtatgctaataatttgggaaaaagtcatgaaagacaagctagtgctcgtctcatagaagtcagatggaagcctgaagtctcatcaaaaaagtcattcctgaaaatgagaaatagcaaaaaataaatacaaagtgaagtgatagggagaggaaagtgtcttttctccatctccattctttagatgaaaattgatagaatagctggaaaacagtataagtaagctgaagaggggaggcttgtctcaactacccaaatctttaaagaggtaagtgataacctgccatgacctgaatgagtccatttctgaaaggcagttaagcatctgggaagagtctcccctcactcacctagacatatttattttttgactcctgagaaatggaaaactcagtgtctgtctgatccaccaactccattcattgtaacaggtaactcatcattcaatttgaaaatatatattcaaaaagcatggtatctttcacaaatgaaggttctatcttacatagccaaaaaacagaaaagtagagttttaccaattggggaaagactaaaaaaaagtttatgtaactaatagttatagtaattgtattgtaattattcattaatttatctgtcttcacaaaatttaatcccttgtcagaaacaatgacatatataactttgaatttcccatgtcatattatctggcatatagaaaataaataagcagtttgctgaacaaacaaatgagtgaaccgaaatacaaaactatatatttatttattttatgcgccatacattaaacaaagaggacaaccttacggttctaatattatctaaatattcaggtaagtgaatatgaacatatcacaggtcatgagttaacaacatggagttcaaagtgggagaagcatgaaccatagatatatgcataagtctgtatacgtgtatgtgttgtatatttttctaggataggttctataacttgtcatcacatgtgtatgactgcaaaaggcttttttgttttaaaatgccaaaggtgcattttcaattaaaaaaaattgaaaaatagattaaataattattacatataattttacatcatactagattctttcatctctctgataaatcagaaggctcctaggtcttatgaagtaacaatgagtgattaattactcagtaattaatacattaatatcaatatgtgtatcaataatacatagttgacattttcaactatgtcaattccggatatgtggaagtacattgttatacttttaaaaattaaaacgcaaaatatatattcatttaatgtgcaaccagtattgctaacacaaaaccaaaatattaaaacaattatgctacatgacactacatgtacatgacatgtccttctcagatgtgaaaataatcaatattacataacaaaaaacagcattctagagttagctgggatgtttttatagaacaggaaaagaaaaaaatgttagggccccatatcctagcatcctatcccaaaatctaaaagcaaacaaaactgacagaggctctcagaatccagtgttttggatgctactctgagaaatttgattatactgctcagtaagtagctaaaacagaaggtgtccttgtaagacagtgaacaggaagagagaaagatctgcttctagaaacactgtaacatccaagactgctaaacaaactacttttctaaaatgagttttaatgggaggtagggtaagagaaacaagtaattttggaacagaccatacctgaggtaaggtagtgagcccacaggtgatgtaccacattatgtggcacaaaaaggatgagagatctctagcaaataaaagaaagaaggactcaaaatttgaggaaagaacaaaaagaaggagaggcaaacaatgaatattttgcctctcccttcctctaaattcaaatattaggagattaagcacaaacaaggttccctctatttttcctatttgctcacgttgtgagtaggaattatgatattgatcaagcaaggatgagccatacactattaacaagtctggaaatgttttatggtctgaatacatttgttttattttgtaagagcagataataaaaacagagtaaatgtgtctcaagtttaaaaaatagctatttctaaaaaactgaaacacagctaaaattaaattcccttatatgtgttatctaggaaaatatgatgaatggtatgtgtccacggcaaaaactgcatacctaatactatctagccagctcccaaagcaaaagtataggtaaggttttcagagaaaattattgctataaaatctctagtcttaaagaaggcaatgactttgttttcctatatgaaagaagcacagtacgtatcattgatgagtcattatcaaaaccaattttgggcttggtatggtggttcacaccggtaatcccagcactttgggaggctgaggcagaaggactgcttgagaccaggagttttaggccagcctgggcaacaatgcaagacctccatctctccaaaaaaaaaaaaaaaaaaaaagttttttgattagttggacatggtggcacatgctgctagttccagctactagggaggctgaggtgggaggattgcttgagcccagcagtcgaggctgaggtgagctatgatctcggcagtgcactgcagcctagtcaacagagcaagaccctgtctctcttaaaaaaataggccgggtgtggtggctcaagcctgtaatcccagcactttgggaggccaaggcaggtggatcatgaggtcaggagatcgagaccatcctggctaacacagtgaaaccctgtctctactgaaaatacaaaaaattagccaggcgtggtggctggtgcctgtagtcccagctactcaggaggctgaggcaggagaatggcgtgaacccaggaggcggagcttgcagtgagctaagatcatgccactgcactccagcctgggtgacagagcaagactccgtctcaaaaataaataaataaataaaaataaaaataaaatcatataaaataaattttgatgataaaaggacatttcaatatatgttgcttctaaaatatgtgaggaattctttctcagttttcatcattaatcttatcaaaactgaataggaatgttagtatctatagcattatatgttcttttaactctgatagttctgatagactctatgtaaaaattaaaactttactccaaaggtgaatatgaacttaggaatagaagcatttctaccagaataggatttctaccagaaataagatagcatgctacaggtcatatgtaatctttattcaggataagagcaaagaaaaatttctgtcaaggagtaaagatgccaaattgctaattgcttctatcacactgaattgaacatttataagatgaattttcacgaaaaattctagctaatgatatgtaacagaatacactttttccatctacctaaatgtgaactgcataaaggtaattttccaccacataactagctatatacatctggatgttatttagattgtagccctgtatttgtgaaaaagtactgctttaggtaatattttaaaaggcacagctgtggactgttcctgtacatctattcttgtacttctctgtggtaatactaatgaaggttatcttttcctgaacacaaatatcagtgctatttctctaatataactgtaactgaagttactagagagagttttaaaactttattgtctggctagtagtcaagacatcttgctatgtcttaagatttatttaaaagcttcaacgaccaggttcagataaaattgatgacattcattttaatttagtatcttagaagaaacaaacatattatcttggtaataaaagatggctcattactagccatgaattttttactacgggactgcagtgattgaagtaaacatatctgatagagatataagacacatatgaaaatataatacatattcttgttccccatggctttcattttatatgcaagatttaataacattatcatgagaaaacatgatttttctaataacaactgaaaattaatgttgtcatcaatgttttaacagagctatcattttagtctatattatcatattttaagttttttttaaaatgatgtatttgcagatcaacttgttaaaaaaactttttaaattatatcttctatagatacattattagcaacaatgtagcttattcctaagtttggtgggccaattaaattcaaccaggtaaaacttcaaattcgaagaggatcatagtgattacatctttatggctaactcccagaaggggcagcacacgtaacatttgaagaaaattgatggggagaggaaactactaagggaaaagtatgtgagtttatgttgaacagtatgatggggtggggaaatgaagactctgggaataagctgaaatgagaatatttgaaaaataggtcttcaagcacaaatttctctacttcaactttaatgttcccctttcctctacaacaacagatattaaaaggattttccacaaaacattctttgcagtcttcaggcttagtatgaggtttatttaaaacttatctccgtatttaatagtcttcgcaatgttcatttacacacagactagttttttttacattatacgttaataaaatatgctgaccacaagaaaaagattttcccacatccacctgaccaaagagtagattcctagttcattcctcaacaataaaatttgtatatctttattttaaaaatggttttgtaatatgaagtcaatgagaacatctttgtgtttgcaacatgatcacaactcctggcatgcaggagataaagtctacatttcatcaacaacatccatgtttcactatttaacatctctgaaatacggctctatcttaaaattgacagttaagcatagtttaattagcatttttcccttctgaatgatacataaaatgataaagccttttacagataatggtgttttagaatagatgaaatacaataaacaatgttaaatttagtaaaattaaattaaacacaggtgaagtgtgtgtttctgttcactttattacctcacaataaactgaaattcatggcttttgatgttttcgtttacatgtttgttaaaaccttacattatcatatagcaattaataggttatacatttttactttacttttaaaactatccaaatatatatacacctctgtatcagttcatatatatgtatatatgtatataaaatcatggccagggccagtgccaggaaacctttcccctgttttattccagaacattcagtttcaggtcatactcttaagtctttaatccacattgaattgatttttttgtgtaggatctaaggatccaatttctttgcatgtggatatacagttttcccagccccatttggtgaagagactatactttccccattatatattcttgcacccttgtcgaaaatcagttgaccataataaacgtgtgggcttatttctaggcgctctattcaattccattaatcagtatgtctggcttcatggcagtaccatactgtcgcaatactgttactttttaacgtattttgaaattagaaagagagaagcctccaggtttgatctttctcaggattcttttggctattcagggtcctttgtgtttccatatgaatttgaagattgatttttatttttctatagaaaatgctacttggattttgatagggaatacattgaatctgagatgactgagtagtatgaccatgttaataaaggcataactcatgtaattgtactttactttgttgtactttgtaatactgcaattttataaattaaaggttgtggcaactctgcattgagcaagtctactgtcaccatttttgcaacagtatgtgcgtctatgttacattttggtaatcctcacaatacttcagactttcccattttcactgtatctgttatggtgatctgtgatcagtgatctttggcattactattataattgttttggggtagcacaaatcacacccatataagacagtgtacttaaccaataaatatgtgtattctaactcccccatcaacctgtcattcccctctccctctcctgaggctccttattctctgaaacacaacaatattgaaattagatgacttgataaccctataatggcctataagtgttcaagtgagagagtcacatgtctctcactttaaatcaaaagttacaaatgatgaagcttaggaaggcatatatccaaagctgagatacactgaaaactaggactcttgtgcccagttagccaagttgtgaatacaaagaaaaagctcctgaaggaaattaaaggtgctactttagtgaacacatgaatgagaagaaagtcaaagagccttatggctgatacacagaaaattttagtcgtctgcatagatgatcaaaccagtacaacattcccttaagccaaagcctaaagtagaatgaggcactaactctcttcaattctttaaaggccaagagaggtgggaaggctagagaagacaaatctgaagctatcacattggttcatggcatttcagaaaagaagccatcttcataagataaagtacaaggtgaaacagcaagtagcaagtgctgatgaagaagatggagcaagttatccagaagacctaagatcatcaacgaaggtggctacacaaaccaacacattttcaatgtaaaccaaacagtcttctcttggaacaaggtgccatctaggaccttcacaactatggagaagtcaatgcctgccttcaaagcttcaaaaaacaggttcactctcttgtgagagtctaatgcagttgatgactttcagttgaagccaatactcacttagtctcaaaatcctagggcctttcaaaattagcaaaaccaactctgcctgtgctctttaatgaaacaacaaagcctggatgacattgctcacagcatggctttctgaatactttaagcccaacgttgagacgtactgctcagcaaaaaagattcttttcaaaatattactgctcattgacagtgcacctagtcacacaagagctctgatggagatgttcaagatcaatgttattttcatgcctgctaatacaatatccattctgcagcccacaaatcaagtaataatttttacttttaagtgtcattatttaaaaaaaataccttttataaggctatacccaccatagatagcaatccttctgatggactgcggcaaagtaaattaaaaacctagaaagtatttattctagatgacatcaagaacatgcatgattcatgtgaggtcaaaatccaacatcaacaggggtttggaaaaagttaattccaaccctcacagatgactttgaggggttcaagactttggtggaattaagtcactgcagatgtggtggaaacagtaagaaaactagaattataaatggagcctgaaattgtgactgaattggtgcaatctcataataaaacttcaacagatgaagagttgcttcttatggatgaggaaagatagtttcttaagaagtaatctactcctggtaaaggtgttatgaatatttttgatatgacaacaaaagacttagaatattccataaacttagttgataatgcagcagcagggttgacaaggactaaaattttgaaataagttctactgtgaataaaatactatcaaacagcatctcatgttacaaagaaatcttttgtaaaaggaagagtcaattgatatgagaaacttcagtattgtcttattttaataaactgtcacagctacaccagtcttcagaaaactccatcctgaccaatcaacctatcatctccaccagcaaaacgatgataactcgctgaaggctcaacttatccttagcattttttagcaatactgtatttatcatcaaggtgcatacattttttaatgtaaactagtacaaacactataaaaaacagcatggagtttccttaattgctcaagagtgtattgtttaatatccacacatctaaattttataattttcctcctgctattgatttctagtttgattttattgaagtcagaaaagatcttgctattttaaatttattcacttgttttgtgacctaacgagttatgtatactggagaatgttccatgtgcacttaagaaaaatgtatactctgttgtagctgggtagaatattctgcatatgtctgatacgtctgttaggtccatttggtctacagtgttgttcaagttttctgtttccttattgatctctgtctggatggtctcccccattattggaagtggtgaaatgaaacctcctactataattgtgttgctgtctatttctcccttcacttctgaaatgtctgcttcatggattaagcgctctgatgttagcagcatacataattgttatattttcttggtgaattaacccttttatcattatgtgatatccaaaaactgcctgttgtgacagtttttgacttaaagtctcttttgtctgatgtaagtatggccacttctcctcttttggttaccattggcaagaagtatctttctccattccttcactttcatttagcctatgtgtgtccttaaatctaaggtgagtttttgtagacagcatatagttgtatctcgttttttttaatgcactcagctactctatgattttttattaggtaatttaattcatttataataatagtagttattcattaggaaggtcttacgattgccatttaattcactgttttctatctgtcttgtgacactcaattccctattttcttctcttgctatcttcctttgtgtttcattattttgtaatgacatgctttgattcccttctcattttcttttgtgtatcttttataggtattttctttgtggttaccatggggtttacataaagtaccttatatttatagcaatctactttaacctgacaatttaactttaattgcatacaaaaactctacacttttacttctaccccccaccacacttcatgttactgacgtcataatttgcatctttttatactatgtatccattaacatatttctatagttatagcttttatatatttgcctttcaacttctataacagaattaaacgtgatttatgcatcaatgttacagaattgcagtattctgcatttgtttatatatttaccttttccagtgaattttatattttcatatggtttcacgttgctgtttggcatcctttgcttcattctttgtccttactgtctttaactagactctagaatctaaagatcacgtttattttacaaattaaactagccaaagaatatgcatcagtgttgtttggcaattataggtcagaactgagcttctattctaggacttagggtacagatggaaccgtgttcctaaatcaataatgcatttccactccaaaaaactccaccagttttaatacctaccagttcctttgcttagatatgggggcttaaagaacttcacaacaccatagacattgacaattgtaccacccttaagttgattcaggggtgtatatatataatttgttgctggaacctaaagaaagagaagacagtgaatacatttatacaaagtatttacattgtagaatcatgttataatcatattagcagcaaatccatgtaactattttatccttttaagtgtctaaaagaagttataacctgaaataaggcaatgcacacagcttagcttatccaactagttttccttagaactttgtttataaatggtacaatttgcacactagctcataaaggcataacctataatctaattaaaacattatacttcttcaataaaaacatagcaaacagcatatacatatagtccctgacttatgatggttcaacttacaatcttctgactttagaatgggtctattaggcaatttaatgcattttgtatttataaaatttttgacttatgatgggtacactggatgtaacttcattgtaaatcaaggagcatctgtagtgaaaaacagcaatacatgtcaaaactgaagcaataacacaaaacaagaaaatacttttttttaaatatgtacatcttcaatgtaaaaggtctaagaaaagagagttttattaaaggtaaatgactaggcataaagagatatttttagaagccctgaaaatgcaactagaacactagtcttaacaatacaagttacatctcttgtaagtttagaaaactttttttttaaggacactctcaaggaatcttttagtaattaaatcatcctagctatctttaagttagtatatccctagcttatttggtcaagaaactgtagctgggggacaataaatcaaactgttaacagagagcaaattctaaaaaatgcaatttaagagattttggttctattttttaactaatatctctttgaaacttgtggtacaatttctctcttccccttacccccatgctattatagagattttccataggcctaaattttgactcataactcaagccaggttttgagtcataaatggtataaaaagatttaaaatgctaataatgaaaccctaccccaaagaattaaaactaacaattcctaaattcttgggcttacagtatagtagataagaaatgaaaacttattgagaagttgaaatcagcaactaacacaaattcttgagcttgcagaatatcagataagaaaagaaacaacttgctgagatactactgaaactcctactgattttgagagcaggaaaaaactatctgaaatcagttgaaaccaagatggctgactggaatttgagaacgagtctgctgatatcacagtatgaatttccatcacattcatcatactaactccacctgaatttgcacatgcaacccatgcattaatgtgaagaaataactatgcttgcccaaggactttccaaacttcccctttcatccaactaatgacttactaatcccagtatctactctttaaaacttttctaataaaattactgccttaaagacagcgcagggagacatatttgagctcagctcgtgtctccttaggtgttgactttcagcttttcttttctcaaaaatttgatttcacagtattggcttataacacatcaggtagcgagctccttttgttctataataataagagaaccaaaagataattttttgaaataactgtgaataagttgggaaagaaaagggaaagtggtttacaaggacatgtttgcatattaacagtgatactaaataaagccttaaagggctttgtataagtgatcccaacatcaaatggaaataaggatacctatcactctgagagttaaaattttaaaactcaaattaaaaaattagtttttccaaggaggcttctcagtttaaacaagagtagaatttgctaatctaatcaaacttcaatataaagaaagctagctcatcaatgattaaaaaaagaatgatggaataatggaatggaaagagaaataatggaagagaagcatactgaacagtagggagaaaacatgtgcttagcttacactcaatattctatcttaacatctcatggagagatgaatgggaaaggccagcaaaactcaatgacactaaccattataatcaaccaagtaaccgccatttgttaattcattaccaataaacaacttcttgtttggctttccatgcaaatcagcaagtatttatgtgtacaacagctaagatataaacctcattataaattcataaattgatattttttgcttcttaatcattctctaatgagttgggttaatattcttacaagtttggttaatgtaccattgagtaagctcacacttcaacaaggtaattaaatttacatgattcccaataagccctatcttagtagccaatttgcctcccttgctgacacaataaagtattgtattccataaaaaaggactgtagagggacatccaaatcagtgtgaacaaatgtgttagcgggagaaatagtgtagttagtaggagaatggtaagcaaaggctttctgaaggtggcaacaaaatctaaattttgaaggacaagtaacaaggagaaatgatagcatatactagcattatgtaatcagggatctgaaaatagtttcacactgctggtgcaaaaggcacatggctaatatctaaagcaacaggcatataatatttatgacatcctaacaactcctaggttaataaaactagcacttacaaaaatacttgttgagggtttttattgctcactaaataatctagaacagtactatccaagataatcttctatgataatgaaaatattctatatcaatattgtggctactcaggaatttaaatatgactagtgcaaatcatgaactgaatttttaaaagccacacacagctagttgctcattatcgcacagcacaggcatatgtccatgagaaaaccatcggctcatgatatactaaagataacttgatagcattatcattaagtacatcacttgatccacatttcacacagacatgaacaatttttttttttgactgcttaaggggcagcccattatggaatcaatcagtcaggaaaatgtgagccctggttaaatgagatgcaatttacagcatatgcagaaagttaactagcggacaaaaatcaagcacagcagacaataaaagcctgaagagagaaagacacctagcagcataattcgattcattcattcctttatttatttctgtccttccttcattcattcattgatgggctatgtactatacggggcactaaaaataagtgtgaacaaaacacaaatagaccctgcaccaatggaagaacaaaccataaaagcggagagatgtcttagaattgtcttagaaggtctatttgaaaagatatttaaagaaagaactaattaaatgaagtacagaagttgggaatgagataagcaacagtgttccaagcagagaaaacacattcagtatatttgaaaatccaggaggtttggatggctggagtgtactggtcaaaggtaatgacaagattaggttgaataaaaatataggggatagtttatattgggccttcagatcacataagtgggctagtaaagcttttaaatcctgaagacaatacaagatcaaatgattaccctgagtcacttgaaaagcaaactttctaccactgaaaaacaaatactctattttctaaattctaaaaacaccctggtcctcatagactacacttttaatactatattctcaaaaaaatacactttttcaggaaaacaagaaactcaaaaacagtaactccgttttcttgatatcaactgcaagatccatgctcagtttaaaaatgtagaaatgtaaaaacaagcatcttttgatgagtcaggaaaataaagtcaaatagatctatgcttgatttaacttacaatacctaggctttgtgaaaaaatatttttgcaaagttcagaggctttttcatttattcccgccttatttacaggttcgcagatatatcaaatattttaaattaaacaatttataacaattttgggaaatactaataccagagctaactcacatttttcaaaaagtacatcagttcttttattggtaacagttcccccaaaaatattaattatactaatactcagaatttagtaactgtgtcctacagtcattgtcaaccagaaacagttcctgaattctgtccatttgaaactaaaggttcaaaaacataagtagaacataaacatcatattaaactataccaataaattattaacaccttctttccagtttcactcggctacaagtagactatctgtaaaaatgggaatgggcatcttcctattgctataaggaagctatagctatatctatgctataaaatagtggggaaaatggttaaaaagaaatgtatcataagtataagaaaactacttaaaattatataatttgttcaattatataattcagcacataattgtctggttaaatacaagctaatgtaaaaagaaatgaatttgcctatggtttataacaaaaatttaaggatcttcatacagtaaaaacttattttatttttcttgtgtatgtatagcttacacaaaatatcagcagatattccagacaacagaatattcagatattgattactaggtaaaatatataactctaatataacattatcagctataaaaaagtaaagattatgtttttccagtgtattgataatatatcaatatcagactacaaagtggactgaatatacatacacatgtatctatgtgtgtggcatatacaggtataggtgtaatactctaaattaaactgaatatcatcttaccaaagacattgattctgtagaaaaatctcttaaagatttgacataaacctgaaggaaaaaaagaaagaacttatttgtatacagataacctccaatgtgattacatgcttttagttgtagtaaaagtacacacttacttgtaaaatattcaaattcactaggatgacataaagttatggcttacaaattaaaagtgaaatgtgcaaagttgtctaagctacagaaacttaaaaaaaaaaggcaaagatataaggtcaaatgaaaatgtactttattaaaatattagtgttcttacagattaaatctgaagcacagcaatattcagttctcaggacagttctcaggatagaatgtaaaagaatgccaactcctatcagtccaatagaagtggaaaatcagagctgatattcaaaatttttcctgcatagaaccttagatgttttcagaaagaaaaaaatcaataaggaagtgcttcagtgatcactctaactgcaaattttacccatctccagcctaattcattaattttaatatcaagcagagccaccaccagtgcttatagtacctttgtgcatactagaaaaaaaaaggcagatgttggcctgcaggcttttggcttagcccaattctacctaatagccttgactaaaaaggcagttttcaagtgtgtgtgtggaaggtagggtgttaaaagaggaaaggagaggaaggccatcttcacaacgaataaagtaggagaaggaaaaaatccgttttacctaaagaggggtagttgattaatttaaagtgaaatcaagtagaacaaagtgcctgatggcataatcacaaagaatatccagtctagaatgtctgtgcggttttgtaagtttcattaataagtatttattaaatataaaggaattccctattctatcttgtcattcgaaaaataaaaccaagaaaaaaaaacttctattttttaaacttaaaatattcaattaaaataatttagtcagaccaagtagtttatctgcagatttacagaaatactttcaatcccatcactttagctcattaaatctgcaatgtaattagagaataaaagctgcatacttacataaacagttgatttgaggtcttcaaatgctttcaaaaatatgcaaggtttaccatctctgcttgtagatgaagaagctaaaaaaacaataaatctagccactgcaatggtgtcctacatagaaaaaaaaaagtttttgaatcaatcaccaaaatacgtataatttggaatgtcatataaatccttatttatattattatgtttagaataaaaattacctctataaagtagaaaactggttaacctaaacttgtttaacacttgctgaatacattatttagactaccacttcctctaaaacatcttcaacatctacagctacaatatagccacagatgacaataacgtcccacttcatggaccaggaaaatgctaaatcactaagaaagttttatgtagtgaaactcagatgttccaatagtaataaggatggaatttaaatgaaactaaatctcaaagttgagaaactacattgagaaaggcatgacagtgcaaaaactccacatattacaaaactaatatatgtgcatacaaatacagggcatggacataataagaaatttccatttatatactaataagaacaaagatattttctttctacttaggtttgtaacagtagtaagaagccattctccatttatcccttcctctctcattctttaaatttccttttcttattttccaaatactaaaacagaaatactaaaagagttttgcattgctgcatatatatttttcattgtcttactcccttaattttaacaacgaaaccttaagatacaccaaaatgtctgggcttttggtcatcttccttcaataatttaaaactctatcaagtggaagtcttctgcattaccacagtgtgctctgcacatacaagggcctggtgtcaattctcacaatcctctattcagatttaataattggactgagagcatactgaagatagtggtcatttctaattctgctctgtatttacaggacttggcacaaagcaggccctcccaaaacaaactgtctatgaatcaaacgaaagaccttattttgccttttctaaaaatctcttgccctaaccaggtattgtagctctgcaattcctgcgtttttttcttcacatgagattgcaaacataactgagtgtatgctgataatgccaaattaccacaactcttcatagttcaatgggagaaaatttttcttcttactgaagattttatatttctccgaaaccttttatgcagtttaaaaaaataaaatgaacatgtttctggaataaaaataacaactgagttaccttttttcagttttacaaactgaagtatacactctgttttcaagtgacctcaaaccaatacattctgattaaatgaaaacttgagattttagtcaaagatttaaagttgtttatcaaactaacaccggaagataaacagaagtagggaagccaacagtttatcagttctaaattatccaagtagaaaaaaaaacctacctcttgttatcctctgttccacttaaaaatgttttcaaaagtaaatattatacaccaaatgcaaatgttagagtacagatgaccattttttttctattttcctgtagattctaaacttttttaaaagactgagtatgtatgcatttcttttatcatgaagaaaaattttgaaaagaataaatgactaaaagctggacatcagcattcataagaaaaatttttctgaatttaacagtagctacacacaattcagtaaaaagttacaacccttcctctggcatatattcaacagcatggaaataacaatcacagttttttttaattgaaatgcatttattatattcataaacatggatttatatttgaatatacatataaaaactgcattgaaggcccttcagtgatctcatcccaagcaactctgcctgttttatttccacatacttcccattcaatattagacaaattggatcctctcataagtatagtgcttttccacatatattctttatttattttgagccactgctacaaataaataacatgtttcccatctgtacatatctgacctaatctatatttcaaagtctagccttcttcttcctggtagaatctatcacagattctctctcagaaacaagtaattctaccttcctctaaactctcctatacagcgttttagcatttttcactttgtatgttatttacaaacttttcttaatgcctttaaagcccttaaagtcctgtaagttccttggactgaaagtaatggagatcattccaagatggccgaataggaacagctccactctacagctcccagtgtgagccacgcagaagacgggtgatttctgcatttccaactgaggtactggggtcatctcattaggacttgttggacagtgggtgcagcccatggagtgtgagctgaagcagggcagggcatcgcctcactggggaagtgcaaggggtcggggaattccctttcctagccaagggaagccatgacggtcagtacctggaacatcgggacactcctgccataatactgtgcttttccaacggtcttagcaaactgcacaccaggagattatatcccatgcctggctcatcaggtcccatgcccacagagttttgctcattgctggcacagcagtcccagattgaactgtgaggctgcagcgagtctgggggaggggcttccaccattgctgaggcttgactaggtaaacaaagcggctgggaagcttgaactgggtggagcccactgcagctcaaggaggcctgcctgcctctgtagattccacctctgggggcagggcatagctgaagaagaggcagcagaaacttctgcagacttaaacgtccccatctgacagctttgaagagagcagtggttctcccagcatggagtatgagatctgaaaatggacagattgcctcctcaagtgggtccctgacccctgagtagactaactgggagacaccttccagtaggggccaactgacacctcacacagctgggtgcccctctgagacgaaggttccagaggaaggatcaggcagcaacatttgctgttctgcaatatttgctgttctgcagcctctgctggtgatacccaggcaaacagggtctggagttgacctgcagcaaattccaacagacctgcagccgagggtcctgactgtaagaaggaaaactaacaaacagaaaggaatagcatcaacatcaacaaaaaggacatccacaccaaaaacccatctgtaggtcaccatcatcaaagaccaaaggtagataaaaccacaaaggtcaggagaaaccagagcagaaaagctgaaaattctaaaaatcagagcacctcttctcctccaaaggatcacagctcctcgccagcaatggaacaaagctggacagagaataactttgatgagttggcagaagtaggcttcagaagatcagtaataataaacttttccaagttaaaggaggatgtttgaacccatcgcacataagctaaaaaccttgaaaacagattagacgaatggctaactagaataaatagagaagaccttaaatgacctgatgaagtggaaaaccatggcacaagaactacatgatgcatgcacaagcttcagtagttgattggatcaagtggaagaaagggtatcagtgactgaagatcaaatgaatgaaataaactgagaagagaagtttacagaaaaaagagtaaaaagaaatgaacaaagcctccaagaaatatgggactataagaaaagaccaaatctacatttgattggtgtacctaaaagtgatggggagaatagatccaaattggaaaacactctccaggatattatccaggagaacttctccaatccagcaaggcaggccaacattcaaattcaggaaatacagagaacgccacaaagatgctcctcgagaagagcaacctcaagacacataactgtcagattcaccaaggctgaaatgaaggaaaaaatgttaagagcagccagagaaaaaggtcaggttacccacaaagggaagcccatcagactaatagtggatctctcaggagaaactctacaagccagaagagagttggggccaatattcaacattcttaaaaaaagaattttcaacccagaatttcatatccagccaaactaagcttcttaagtgaaggagaaataaaatcctttacagacaagcaaatgctgaaagattttgtcaccaccagacctgccttacaagagctcccgaaggaagcactaaacatggaaaggaacaattggtaccagccaatgcaaaaacatgccaaattgtaaagaccattgaggctaggaagaaactgcatcaactaatgagcaaaataaccagctaacatcataatggcaggatcaaattcacatataacaatattaaccttaaatgtaaatgggctaaatgctccaattaaaagacacagaatggcaaattggataaatcgtcaagacccctcagtgtgttgtgttcaggagacccatctcacatgcagagacaaacataggctcaaattaaagggatggaggaagatctaccaagcaaatggaaacaaaaaaaagcaggagttgcaatcctagtctctgataaaacagactttaaaccaacaaagatcagaagagacacagaaggccattaagtaatggtaaagggatcaagtccacaagaaaagctaactatcctaaatatatatgcacccaatacaggaacgccgagattcataaagcaagtccttagagacctacaaagagacttagactcccacacaataataatgggagactttaacaccccactgtcaacattagacagatcaaagagatagaaagttaacaaggatatccaggacttgaactcggctctgcaccaagcggacctaatagacatctacagaactctccactccaaatcaacagaatatacattcttctcagcaccacatcgcacttactccaaaactgaccatagttggaagtaaagcactcctcagcaaatataaaagaacagaaattataacaaactgtctttcagaccacagtgtaatcaaattagaactcaggattaagaaacttgctcaaaactgcacaactacatggaaactgaacaacctgctcctgaatggactactgggtacataacaaaatgaaggcagaaataaagatgttctttgaaaccaatgagaacaaagacacaacataccagcatctctgggacacatttaaagcagtgtgtagagggaaatttatagcactaaatacccacaagagaaagcaagaaagatctaaaatggacaccctaacatcacaattaaaagaactggagaagcaagagcaaacaaattcaaaagctagcagaaggcaagaaaaaactaagatcagagcagaactgaaggagatagagacacaaaaaacccttcaaaaaatcaatgaatccaggagctagttttttgaaaagatcaacaaaattgatagactgctagcaagactaataaagaagaaaagaatcaaacaaatgcaataaaaaatgataaaggggatatcaccactgattccacagaaatacaaactgccatcagagaatactatgaacacttctacgcaaataaactagaaactctagaagaaatggataaattactagacacacaccctcccaagactaaaccaggaagaagttgaatccctgaatagaccaataacaggtactgaaattaaggcaataattaatagcctaacaaccaaaaaaagtccaggaccagacagatccacagctgaattctaccagaggtacaaagaggagctggtaccattccttctgaaactattccaatcaacagaaacagagggaatcctccctaacttattttatgaggtcagcattatccttgtaacaaagcctggcagagacataacaaaaaaagagaattttagaccaatatccctgatgaacatcagtgtgaaaatcctcaataaaatactggcaaaccaaatccagcagcagaatcaagttggcttcatccctgggatccaaggctggttcaacatacacaaatcaataaacgtaatccatcatataaacagaaacaaagacaaaaaccacatgattatctcaatagacgcagaaaaggccttcaacaaaattcgacagcccttcatgctaaaaactctcaataaactaggtattgatgggatgtatctcaaaataataagagctatttatgacaaacccacagccaatatcatactgaatgggcaaaaactggaagcattccctttgaaaactggcacaagacagggatgccctctctcaccactcccagtcaacatagtgttggaagttctggccagggcaatcaggcaggagaaagaaataaagggtattcaagtagaaaaacaggaagtcaaattgtccctgtttgcagatgacatgattatatgtttagaaaaccccatcggtctcagctcaaaatctccttaagctaataagcaacttcagcaaagtctccggatacaaaatcaatgtgcaaaaatcacaagcattcctatataccaataacagacaaacagccaaatcatgagtgaactcccattcacaattgcttcaaagagaataaaatacttaggaatccaacttacaagggatgtgaaggacctcttcaaggagaactacaaatcactgctcaatgaaataaaagaggacacaaacaaatagaagaacattccacgctcatggatagaaaagaatcagtatcatgaaaatggccatactgcccaaggtaatttatagattcaatgccatccccatcaagctaccaatgactttcttcacagaattggaagttcatatggaaccaaaaaagagccctcattcccaagacaatcttaagcaaaaagaacaaagctggacgcatcacactacctgactccaaactatactacagggctacagtaaccaaaacagcatggtactggtaccaaaacagagatatagaccaatggaacagaacagagccctcagaaataataccacacatctacaaccatctgatctttgacaaacctgacaataacaagaaatggagaaaggattccctattcaataaatggtgctgggaaaactggctagccatgtgtagaaagcagaaactggatcccttccttacaccttatacaaaaattaattaaagatggattaaagacttaaacgttagacctaaaaccataaaaaaaaaaccctagaagaaaacctaggcaatatgattcagaacacaggcatgggcaagaacttcatgactaaaacaccaaaagcaatggcaacaaaagccaaaattgacaaacgggatctaattaaactaaagagcttctgcacagcaaaagaaactaccatcagagtcaacaggccacctacagaatgggagaatatttttgcaatctactcatctgacaaagggctaatatccagaatctacacggaacttaaacaaatttacaagaaaaaaatcaaacaaccccatcaaaaagtgggcgaaggatatgaactgacatttgtcaaaagaagacatttatgcagccaacagacacatgaagaaatgctcattatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattggggaagacactgtcgcgattcctcaaagatctagaactagaaaacaccatttgacccagccatcccattactgggtatatagccaaaggattataaatcatgctactataaagacacatgcacacatatgtttagtgcgccactattcaccatagcaaagacttggaagtaacccaaatgtccaacaatgatagactggattaagaaaatgtggcacatatacaccatggaatactatgcaaccgtaaaaaatgataagttcatgtcctttctaaggacatggatgaagctggaaaccatcattctgaggaaactattgcaaggacagaaaaccaatcaccacatgttctcacccataggtgggaactgaacaatgagaacacttggacacagggtggggaacatcacacaccggggcttgtcgtagggtggggggaggggagagggatagcattaggagaaatacctaatgtaaatgacaagttaatgggtgcagcacaccaacgtggcacatgtatacatatgtaacaaaactgcacggtgtgcacatgtaccctagaacttaaaagtataataaaaaataaaaaataaaataaaataatgtcttattcatgtgtatatttcatataaatggctgccagaggcttctgttcatagtgttcaacaaatatctggtaaattaatgaattaacactggcaaaaactgaagtacagaactaaacaaagagaaaaaataaatggctcttaggatccagtttccatgaatttatgaatcataatggcttttaaaacattcaagtacacagaggataagaaaaatatataacagataatagtagtttgtataaacactcattagatcgaattgaaaatgagattttatatggggtgttctaagcttctgagaagagcatactgaagccattcaaacaagaattggaattacctagatctgtgccaagagtatattctgacataccacagatgtttaactcaattgggtgaaaaaagttaggagaccagcctggagaaaaaaatactatgctacaaaaagtgagaaggctttatcaatgcatatacgagttataaaactaaaaacacatttggaatcactgaaatctttaaactaatttaagatacttcaatattagcaaatgggtcatttcccttttgtgtctgtactacctgtcatccctgtcacattgccttacaaagagtgagctcccttgtcattaaacaattccctgtttagtatagccaaatagaatatttactgcaaaccagtctcagagaagaaaaatgaagtcagtaaaggtcttcttaacaacaagaagtgttcttcaaaaaatcaacaattaacttaactgcttcaccccccacaaaattaaggccacatactgtatgattctacctaaaagactggaggttgccagaagttagggaaagggaaggatgaataggcagagcacagacgatttttagggcagtggaaaatactctataaggtactataatgatagatatatgtcaaaatacatttttcaaaactcatagaatgtacaacactgagagtaaaccctaatgtaaaccatggactctgagtgataatgatgtcattgcaggttcaccaactgtaataccactctggtgagggaacactgatagcagaagaggctatgcataactgcaggtagagaatgtgagggaaatctctctaactttctctcaattttgctgtgaacctaaaacttcttttaaaaagtattttttaaaaaaccaaagctttaaacatgtattttaaaaagtatatcagattatttatttgcatattaacaaatatggtttttatatgttagtacctcctaataaaggaaacagtcagtggtgaaataagcaaatcaacaggcaaataatagcataaactacaagactcatgtattagtttgctaatttttaacaaataatacctcagaaattctcaagtcattacacttagtgggcaagaaaagggcattgaaaatataaaataactgataatccaaaatgaaaaacacttatttgactttaacaagcattaaataattttcctatattgaccttacaaatcttgttaggttaccatattttaaaacatttttcaagagtaagggtacaggcagaaaccaaggacctgacggcgttgatagtgcagtgattgacagaaaatgtttctctataaaaatgtatttcatgagcatttgcatgtactgggttgagtaataccaaggtcataattggaagtaatgtatgtgaataatattagcattaaaaaccaaaattcttaaattgcctacaaatcactgtatgatttgacccctacccacctcatcagccacatcagccacatattgtgtgactcactctggtattctgtcttctcaaaattcattaaatattccaagatgcttgctcaaggcctctgtatatgctattctctctttgcaatctataacccaagtatccctgtgatcatttttccattactcttctcattctactattcaatattcatagttacatatcatatctggataaaataattatgtaataattgtttaattcttctccaggggacactatgctctatgagggcaaggtccatgactgtcttattcactgctatatctccaacatctatcatagaatacaaaaacatttaacaaatgtttggacaactaaataaataatcaaagatattaacattcatacatatatagatagtataccttcacgaatcttaaaataaaataaactgtacaactgctacaaaacttacttcatagactgttagcattttagaacttaaaaggaccttagagaccatgtaatcaaacatcttcatttttcagataagggagaataaataaatgatctaaggtcacatacagttaattagctatgaaccaagacaagaagccaaatctcctgactttcaagacaggcaccactctaattcctctttcagaactaactctaacagggatacagggagaaaaaaggtattaataagtgtctttatttttgacagttttggggtaattttttttaactttcagaatactttggaaaagtctttcctcatattttatgtccacatattaaatgttaaaactgactttaaaatatgaaaactaaaacaaaaaatgtctcatacagaggaaggcttaattacagcttgtgtatttctgcaaaatatatcacattagtctaccaaagcaaggattaaaatcttgttaaaattcattttagtgttttaggattattgtattcaaatacaacgctacccttaagcaaacaagcaaatggcaaagaagggtttaagaatcaaattggagaaaactcattcctttaagcaaaaagttttacctttgggttggaacaatcttcaaccttgatactttaataaattggtatattagaccctcaaataatcagcatttctgggttttaaatccagaaataatttaaagtaaatgtgacctcagtcttcacatcattatattttaaaagcaagaaaccttgacttaccattattaacaacctctgttatctgacaggtactaattaactagtgtagttctattctattttaatgaatacctatttaaaatgtatttcaatagcagaaaacacttcacatgtcaggtaaaacactaatacctaatgtaatgtacatgttttgtagatgtactatacatgttttgttaattcatagcataacccttttatactgtttctcaaataaacatttaatataaaaatcttaaaggataaaggtgaaatatatttaaaatataaacaaattgatctctgatattcgatagcatgtatttatttttaaaacacatctctaaaatatccaagatatattaggtaaaaataaagcaaccttgcaaaaaacagatagttacttggtgaaaaatatgcacatacaggcttatccatgcccacagacacacacaaaagcatgtgcacatatatagacacacatataaaaaacctggaagggtactaaaaaaagcatagcagtgttttttacctgaagaatgggactaggaaatggcaagggattcagtgggaatgagggaacttttgcttttcagtttatagcctgccatactgtctgaatgtttttaaatcatgactacacaaaaacaacaaaatcttctcagacaaatatttgcaagattgtcaagtccataatactaccatgaggtaagaaaaaaaaggtgtggagatagagcggtttctctacttattctaagtcctttaacaaatgttagccttagagggttatcttcataataaaagtgcttatcaccatcatcacagagggctaacagttaatacttaaatgaaaaacatatacgaagacactttgcaatctgtaagatttcatacaaatataatattattagttaaattttaattctgaaaaaaactggttaaatgttaaaaattggctataataaacgtttgaaaaagaaacagtggtttttactatctaatggctctttaaatatagaccttatttgctattgaactatgtaaaataaacaaaggataggaaaagaaacagaaaaataagttatttaatctccttacctcacaagaaattagaatttgcatctctttacatcatacctcaaaacatctaaaatgttaactagaaaaaccctttaagttatgaattcccaacaaacataaacacacataggtgtgtaatacagacaggtatacaatcagacacaccctaagagtcatgagaaaaagcataacacattgatacactcaaatacatttttaaatgtattcatacaaatataatgtacacacacctctctcagagcaactctacctacatttaccccaacactattttctgtattatgttaaaacaaatgtttcaaaaattctttagtgaatgagattttgtattcatatttgcacctgacatttatttaacattcataaatgcaaaatttttataagctaccaacactgaattcttaataatttagaaatgtcatctcaaatattaataattttaactaagctgaaataaagtcttgccttcaagaggaagaataatacaaataacagtaatgacagcagacctttactggggccaccaactaacaaaagcaccttatcaaaatagatatttacaaagggattcatttggagcaattaattcctatctgacatcgcctcaagcaggcatgattgtgtgtatgtgcactcacgcttttttctgttttatttcctagtgtccttccctgatgactgtcaagagacttctttgtagtatatttgtctctagaatttttgtgccacatcgactagattagaactatatttcaatcaatattttaaaaattttatcagcaatcaatctcagagaaatggtccgatgatttgttctatgagctttaggacatgaactgtatggcaaatgcattacttccctaaattctaaagcaaggttttaagatataccgctgattagtaacagcattgcagatggaaaactaacacgacactgattttccttttctttgttcaaagtagaagtgagaaaaaaattaactgatttaacagttcttcacagcaacttgagcaaaaaagataaaatctgagtttgacaatgtatcacaaaattcttgtaacaaggaaataaaagcagatgttctaacagcttgcttgaaatggatctttattccagaccccacaggttttacaaaaatggtaccatttctcaagggcattgaattatttaaaccaccacaatttctgcaactactgtatgtcatagctattcagaattctcagctaatccaaaacccttattttatatttgattaaatttgaatctggcaacattcaatgttactcaagggccaataattaactgaagaaaagcagagattagaagctaaactactgggctcagggttcagatgtcttccctctactctcttcttcctcactgaggctgtatctaattacaataatagtaatgacaataataatagttgctatgtactgagttcccactatgtgctagtagtggctatattctgtcttgagttctttcaacaatccagaaaagcagatatcattacctccatctttaaaattgggggaaaaaaaaaaaactcagtggaattaagggttttaactccaagtcacacctgctgggttttagataccctgagcctctccttgacataaatgaaacatacactcacactgcagaacctttgtacttgctaagactgttctagaatactcttactttaaatatctgaaggatcacttcacatcacttctttgaagtctcttatcaaatgttacttgtcagtcttttcttcaccaccagataaatatataccttccctccccttctcatgtttacagttctgccttacattctccatagcactgtttccaactagaaaaggtatatatttactttttttggtttattgtctttcttccctagaacgtatgctgcataaggacaactttgtttggctcatcggtgtctaggaatagggcctgactcctcataggtattcaatatattgtttaataaatgtgtgaatggcttaatgaatacatgcaaattctcctatttccttcaggaagcacagatgtattcagagtaatatttcaaatacaaaagactagcaaggtatactgcagaggctccagttccagaaagccaacagagggccacagcctcaaaagataagatactccccagaatgccaggaccactgtattagtccattttcaagctgctaagacatacccgacactgggcaatttacgaaagaaagaggtatattggccttacagttccacatagctggggaggcctcataatcaaggcggaaggcaaggaagagcaagtcacatctcatgtggatggcagtaggcaaagagagagcttgtgcagaaaaactctcgtttttaaaatcatctgatcccgtgaaactccttcactatcatgagaacagccaaggaaagacccgcctccataattcaatcacctcccaccaggttcctcccatgacacatgggaattgtgggagttacaattcaagatgagatgtgggtggggacacagccaaaccatatcaacaaccatcagtattgtatttcttctttgaggatacactaaatcaaatcacctatttttttaattgaattgcttatctttttgttgttgaatttaagaagtcctttatataatcctggatagcaaatcctcattagatatatgatttgcaaatattttctcccactctatacactgtcttttcatgttcatgataatgtcctttgatgcataaaatttttacatttttatgaagcttaatttatcaatttttccttcattgctcatcccttttgtaacatatctaacaatccattgccaaatccaagctcatgaagatttgcctctgtatctctgaaggattttatggatttagctcttatatatagatgcttaatccattttagttaaattttgtatataatgtaaggtaagaatctaatttcattcttttgtatgtggaaatccagttgtctcattattatttgttgaaaagacaaatggtcattcttaaatggagatagttttattccttcccttctaattggaacgtcttttatttcttcttcttatttaactgtttttgcaattgactgaacatgtgatccttgtcaaaaaattacttagccatagaagtatgggttttctgtaatcccagcactttgggaggccgaggtgggtggatcacgaggtcaggagatcaagaccatcctggctaacatggtgaaaccccgtctctactaaaaatacaaaaaattagcaagacatggtggtacgcgtctgtagtcccagctactcgggaggctgaggcaggagaactgcttgaacccaggaggcagaggttgcagtgagccaagatcctgccactgcactccagcctgggtgacagaacgagactctgtctcagaaaaaaaaaaaaaaaaaagagtatgggtttatttctggactcaattgtactccattgatctctgtctatccttatgccagtaccactgttttgattactgtagctctgtgataagttttgaaactgggaagcctgagtactcagactttgttgttcttttttaaggttgttttcgcaatttgaagccccttgaaattccatacaaatttggggattggtctttacatttctgcagcaaagttttataattctgatggggactgtcttgaatctgcagctcattttaggtagtattgacagcttaacatatcaagtctttctacacaagtttctgctatgtacaaggcactaaccacagaaagtaccaaaaaaagaaaaaagaataaaagcccttcttctgacatatagttagccctgtatctgcaagttttgcatctgcaaattcaaccaattcagactgaaaaatattcagaaaaaatgttttttaaaaaattatactacaacaataaataataatacaaatttaaaaatacatagtctagctatttagatagcatggacattgcattaggcattataaataatctagagatgacttaatgtcaatggtagggagaatacacatgggttatatgcaaatattttgccattttatataagacttgagcatccacagatttttatatccatagggggctcctggaactaatctcatgcatatacagagaaacaattgcaactcaattttctacaagtatctgttacttaataaatgtatttatatttaatttattcagaaaattaatttatttctcataactcccctatgctctaccaccttaacttgctttttcttcagaccacatttctacctcatattactttatgtaattattcactgcatttcctcattcccctaaaatgtaaattcaataagacaagaactaagttttgttcacagcttataaccccagtacctagaacagtgtctgatatatacttagtagtcagtagttgtagaattttgtagtttgtttcccatttgctgctccagactgttctaaccaaccacaggcttcagatgagatctacttttgtccctaagtgttacaaagtagcccttcctagcttaccatgattacttgagggctatatggagaaagaattctccctgtgtaagaacaacacctaggtaacaaatacagctatgtaacaagtacatctatgtaacatgttaaaagccaagttttaagacagttaagctgctaagatgtttaagtcacataagtgaaactagaagcagttagctactgcaatggtctagatatgagagtaaagggctatgaagtagaatacacacacatatatatatgaagtcacatatttatatattacagggaaaaagataagtagaaatagtttgcttatactatataccttgtagtccaatctgcaaaacagctgttttatttccacgataagttaaagaagagataagtgaaagttttccctgaaatgagaaaaaaaaatagttacaaagaggagtcaaaggagtttataataaaaccaagatagaaataaaaattagaattttctatagcaacagttttctttcaagaagtcagagtactgtgttcaagtaactattttaagacaagaaactgttgaatttgtttttctagagaaaaatcagatctacaaatacttcaaggtttataatataatttcctaagtaatcctattagttaagtactatcagttccttattttgcagataactagatcaactttccctagctttgttttaatctgtaatattgttctctacaaaacaataaaatgatgtttgctcctagaaagaaatgaaaacttaataaagatttagaaatgcaaaatggaaatctcatatagtgtggacaaatcaacagattaagacacaagtacagtttagtctttgttcagtttctgtaactaaccagctctgtcagtttaaaaaaagttacttagattatcagataaaataaagtttttaatctggatggtttttgtaaataaaatttaaaaatagatcctattagcctcccaggctaatattccagactttgatatagctaataaaaaatagatcaattttacttataaaataggactcaattttacttatacatcaattttacttataggaacataaataaaaatatggttatcaacaaagcatgattcatagtcaaaagtaaaagtagttacacttaaaagatagaaagctgaaaaaagtgtcaacaataaaaagttaatctgtaaatctcagaacctttcttgacccatcagagagttgaggtcacagggcaaccaactaagcagaaatctgaggaaagcaagtaattctcattacttctaatgagaataaaacaattgttttatttctatgataagttaaagaaaagtgaaagatttccctgaaatgagaaaaaaatagttacaaagaagagccaaagtttataatcacaccaagatacaaataaaatttttatagcaacttgcttacctaaggtaaatgacaaatgttcccagacatctgtaagaaaaattcatctaacactttaatgaattgctagaggccaagtatggtgcaatgaaaacacatggagcccccaagctgcaaacacaggggaattcattcatttacatgcgcttctctacagacctgacaaggttcaggacagaagtagggcaatggcagcagcagttactgcacgaaaggctggaaactctgcttggctctttctcctctatctttctttcagaacaaaggacttaaaatgctgggagaagggcaaaaaaaaacatgtcaatccaagaccattggtgaaaacccactgcagctggaaggcaagaacagaaaaaaacaccttctatccctgttagggatgggcaggaacgggtacataggtgtaaggcccagacctatacagctagaggcaaagcaggatcattgagaaggccccactcacaagacccaggacctactgctaccaagacaggcttcatcagaacagagaacatctacctattaaaggctaaccagtacctagtaaaaagtaacatggtctactactggaagagaagctcttgagcagggaggagatcttatttgaggcaaagcacaaaggaaagacctaaaactaaggatggggaagacaagagaaaaatcctctcgtcaaccatctccgatcctacatacaaagtaactctgaggaatatgaagcctctagtgcattgaagcaccaaaaacaacaacaaatcccaaacctaactctaaacccgactagattaattcaatgcaccaaactaaaggcctagcacaaagaaagacctacacatgcccagaaataaaaactaccccagtctccactgtcctccacaagacgtacagctttgaacaataacaacatatgaggcatacaaaagaggcaagaaaaaacgcaaagcaatcaagagaaccacaatcaattagattaaaagacattaatcaaattaaactcaaagcaggtgcttttgcttcacttgtatgtgatccaactagaagaaaagtctcagagtagaggggataatcagaaaaaatataaagttatagttattggaatgggccacactggttttagaacaatgaaaagagagcaaaaagcacctaagcatgtaggaagacactcctagcacctgcgaaagggccctagcacctggagaagaaaactctagaacttggaaagggaatcccttaggtcccaggaggtgtaggggaggggaggcattaatcatctttgtctttcagaactccaggaacctcctttcccaaggaaaaatattctggtgctactctcagaaactactgggaaatttgaaagtaaatcaactgctaagcctgcctaccatgtctcacccaactgctctaaccatgagccagcagggcatggcccagctcctgcagcttggatgctgattacttccaaatgccatccataactaggacaaatggattagtaaattaagacaaatttaacaaactgccctgaggcagtctctctgaaaaccagaccaaactaaattaccgggactaaactaggggccttaggagactactagctaactaataacacaagaggcactgtcaacccatgctgcctgcctatctattaatacacacttcctagaggggggaccaacaattataaactgtttgttttcaggggtagcatgtgtgccactgggactgcgtttcttgtgtgaaaggcagaaactaaccaaataaacagtgtgacttgcacctaggagtagtaataagaaacataagaaacattcaagtcttcagtaaacgacctttttgggtgatcatgctatacattatgtcaacagttttacctacaatggaagttattccattagaaaggtggtaggaaatttgtccctgcccttgttgaagtgagcaaagaaaactggaacctgagttaaaagacaagctttgaaaattaaaggacactgagagacttccagagagactgatgtcccagaattacatgtttacaattcaacagatgaaatctatagctattcccttaaattccaaatgacgtatttacattaaggaaatgaggtttctctccctctctcgggaggggtaaagctgaatagctgccctatataaactcctagatgcatcatttcagccttcctctctgagagtacaagaaatccccttcacacagcaggaagacatctggccctcactgcatcactctgaatggggaggatgggcagggagttattgctgagaataatataattatgtggtgcttaacaacagggatacattctgaaaaatgtgttgtcaggcaatttcgtctttgtgtgaacatcagagtatgcctaaaccaacttagattgtacagcctactatacaccgaggctatacaatatagcttattgcttttaagctataaacctgtacaacatatacggtattgaatactgtaggcaattataagacaatggtaagtatgtatgtatctaaacatataaaaacctagaaaaggtagagtaaaaacacaatactatgatgttatgggatggaccaccatcatatatatgcagtgcagtgttgactgagatgttgtatatggtgcataactgtaataagagtctgcctgtattctagaaatcctgtttgcttttaggacaaaaatgaattagtatagatataaaaaatgtaacacatcctgttatggacttaattgtgttctcccaaattacaggttgaagctctaaccctcaacaactctgaatttgactgtatttggagacagggccattaaataggtagtttggttaaaaagaggccattagaatgtgcctcttttgtgccaccagtctgactggtatccccaaaagaaaatgggacacacagaaacacaacagagtctcaggcacgtacagagaaaatgccaggtgaagacacagcgagaaggtgagcatctgcaagccaaggagagagacctcagaagaaaccaaccctgcagccactttgatactgatcttctagccttcagaactatgagaaaataaatgtttaagccacccaatctgtggtactttgttatggctgacctgacaaactaatataccctctttaaaaactggggattttctaagctcagtgcccctcagatgtgctacaaactccgtgtgcacgttatgtacctgtccctgcccccatgggacttggggaggaaagaagaaccagtgcaaacataaagttcatgttccctgctgtgccaataagtaatatactacctaaatctatttgggtgccttgcctccttaacagctgaatctagagaagtgtagcatgccaacctatgagctatatcacatactgttgcttaggaactatttgaacatttgacctttactcaaatgaaataaaaacctatgttcagataaaaatctgtacatatatatttacagttgcattattcaccatcacaaaaactggaaagaatccaaatattcctacactgggcaatggataaataggctgcaacaaaattctaatcaccaaaagaaagaaatactaatgaaaaaaacaacctgaaagaatgttatacgtatcatagtaagtgaaagaagccagatgcaaaaggctacatgctgtataatgccatttatatgacattcttgaaaaacaaaaaaacagtgtcaggaaattggtaagcagtcatgagtggttagagttggcaaaacagctaactataaaattttggaaggtgatgaacgaattgattgtgattgtggttacatacacatttgcacgtattcgtcaaaactcacagaagtgtatgcaaaaaacagaatgtagcactaaaatccatttaataaaattcaaaaaacatagatatctgcaggttagaaaagggtaagtacacaatagagagctgaaaaattattcagatatgtaaaagaacacaaatacttcaatctttttttttaaaaaagtgagcattctacataacaatctgttaaccatgaaaaatacataaaagctatttcctagttttaaccctagtagatactaatgtgttcacttatagctaaaagaattcattaataaaaatgttaaaattggacaggggcaatgctcatgcctgtaatcccagcactttgagaggtcaaggtgggaggattgcttgaggctgggagtttgagaccagcctgggcaacacagaaagatcctgccactataaaaaaaaaatttttttaattagctgggcgtggtggcatgtgcctataatcccagctacttgggaggctgaggcagaaggattccttgagcccaggagtttgaggttacaatgagctacaatcataccccagcactctagcctgggtgacagagcaagatccatctcttaagcaaacaaataagaaaatgttgaaacttaaaaaaatatttcactaatataagtaagaacaaaaataaaataagaacttagcaaactgtcatagtatttaacatttctatatcaagcacacaaaacaataaaagtatgtcaaaactagatgcagcttggaaataatcagtattaatgatatgtcaaaaagaaatcaaatcatagcactttattaataaatacaagtatacaagaaatatcacactaactgaccaaatgtaaaataagttgagaatgctaacaagcatctgataatcatttaaatgcaattaagtagaaaagaccagctgtaattcataaaaccttatttaataagaaagaaaattccaggaaaataaatagaaataaaacttaaaaagaaataaataggtgagtaaaatgtgtaacaaacgtctatacgaagaatatagacaagcaaaactgaaatgtagatttctctctattatcagatgcattttgtccctcaccccctcaactaaaatttaaaaactcactaaaaatgcatccagaatattggatatggcagacaaaaggttcagtgaactcaaagagagagcaacagaaattactcaactgaaaatcctctctgccacacaaataaaacacaataaaataaaggagaaaggaacagaatctcagagatccgtgttacagtatcaaatagcctaatacatgaacatacacacgtaattggcatcccaaaaaagagaaaagggtaataatgtggcaggaaaaaaaaatatttcaagaaatattatacaataatttcccaaatttgatgaaaaatactgaatgaatccaagaagctcagttacccacagaggagaaattcaaagaaaaagcttacttaagcacatgccagtccaactgctgaaactaaaagataaaacagaaaggtggcaggaaaaaaaatgcaaatcacatacgaaacaacagaatccagaaagcagtggaccggcatctctatagtcctaaaagaaaaaaaaagtcaacacagaattctatatccaataaatatatccttgaaaacaaacatgaaataaaggcattttcaaatgaatgaaagctaagagaagttatccccagctgaaatatatgaaatggtagatatttttcacaatgaagggaaataatgcccagataaaaatggatctacaggtaaaaatgaagaacaccagaaatggtaaatatgtcagtaaatataaagactatactttttccttcttttaatttccttaaaagatgactcattgtttaaacaaaagcagtaatataacatagagtttataatacatgtacatgtaaaagatcataacagttcaatgaacaggggagtgagtaaatggaatttcactattataagattcttatatttgtcaagggggaagaaaaagcaggacatgagaaataacaactgtaacatggggagtggtacaatagtagctgtaagtataccttagtaaggatgtatattgttagtactagcataaccactaaaggaacaaaacgggtgttgctcaaagccaatggtgaaaataaaatagaataaaaaatatttaacccaaaagaactcaggaaggagaacaaaaaacaggcaaaacaaagggaactcaaattgtttgacagacaaacaaaaccatatcaataattattttacataaattgactatgctgattaaatagtgagactgtcagactggatcaaaaaagcatgatcccgttatatgctaacagatacttaaaataccaaaccataagtaagttgaaaaagaaaggaaatgttcatacactcaatataagggccacactaccacaggcacccaaaatcaaagccaaagtatcttaaccaacaacatacatacatcttcagaaaacatttctttgctacaaatgcaatttcaaaaaaaatagaacaagcaattgctacactagatgcacagatatcaaaggaagggcacaggaaacatgaaaaagcagggaaatatgatatcaccaaaagaccacaacaattatctagcaatatatatcaattaaaaaaaattcctcgaaatgccagataaagaattcaaaatagtgattttaaagaagtttaatgagattcaagagaaatctgaaaaccaatacaaagaaatcagaaaatgaattctgtttatgaatgagagatttaccaatgagacagacatctttaaaaaaagaaaagaaaacggaaaccatgaattaaaaaattgaagaaaatacaaaatatattcaaaagattcaataacagattagatcaagcaaaagaaagaatctcagaacctgaagacagaacgaaattttgaaataatgcggtcaggcaaaaataggaaaaagcataaaaaggaatgagcaaagccatttgagatgtccaggactacataaagcaaacaaacatatgaattatcagtattcctaagggggaagagagattagaaagttaaaaaaacctatttaaggaaataatcaatgaaaacttcctaagtctagcaagagcatcagacatccagatacaggaggcccagctatccccaggaaaatacactgcaaaaaggacttcatcatacacattatattcagaatgtgtaaagtcaaagttaaaaaaaaaaaaatcttaaaattaccaagagaaaagcatctatctagtcacctataaagaaaacattataaaactaactggacttttcagcagaaatcttacaggccagaagagaaagaataacattttccaagtgctcaaacaaacaaacaaacaaacaaaaaaactgtaagccaaaattttatatcctgccagaataagcttaataaataaaagagatataaaaaatttcccagataagcaaacaacgcgggactcagtagtgaaaaaaagtagaaagatcacaaattaacacactagcatcacacctcaatgaaaccagaaaaacaagaacaaacgaaagtcagagttagcagaagcaaagaaataacaaagatcagagcagaactaaatgaacaaaaatccaaaaaaaaaaaaacccaaaggatcaatgaaaaaaaagttggttatttaaagagagaaacaaaattgatgaactaccagctagactaaccaagaaaaggagagaaaagatccaaataaaatcagagaggaaaaaagagacattacaactgataccacagaaattctaaaggtaattagagactactatgtataactatatgcccataaactagaaaaccaagagaaaatggataaattgctggaaacatacagcctcccaagactgacccaggaagaaagagaattcctgaacagatcaatgatgacagcaagactgtatcagtaataaaaaaatcccaataaaagaaagtccaggaccagatggattcacagcctagatgtacaaaacacaaaaagaactaacaccaatccacctgaaactattccaaaactactgaggagggaattctccctaactcattctacaaggtatcaccctgatatcaaaaccagacaaagaacacaaaaacaaaaactacagactagtatctctgatgacatcgatgcaaaattattaacaaaatactagcaaattgaatccaacagcatgtcaaaaagatcatacaccatgatcaagtgagatttatctcagggacgcaagaatagttcaacatacgcaaatcagtaagtgttatacatcacataaacagaattaaggacaaaaaccagatgatcatcccaacagatgaagaaaaagcatttgataaaattcatcttccattcatgacaaaaatcctcaacaaactagatagagaaggaacatccctcaacataataaaggtcatgtatgacaaatccacagccaacataatactgaattggggaaaagttgaaaagattccctctaagaattggaacaagataaggatacccactttcaccactcttactcaatatagtactgcaagtcctagccagaacaatgaggcaagggaaaaaaacaaaaggcatccaaattgggaaagaagtagcaaattatcatagttggctaatgatatgatcttgtatacagaaagccctcaagactccaccaaaaatctcttaggttggtaaattaagtaaagcttcaggatacaaaatcaatgtacaaaaatcagtaatgtttctatacatcaataaaaatctagctgagtaccaaatcaagaatgcaatcccatttacaacagctacaaaaataaaataaaatgcctaggaatatatttaactaacaaggtgaaagatctctgcaaggaaaactacaaaggacggatgaaataaattgtaaacaacataaaaaaatggaaaaacatcccatgctcgtggatcagaagaattaatattattaaaatgaacatacttcccaaagctacagattcaatgcaatccttatcaaattactgatgtcattcttcacagaattagaaaaaaacaattctaaagttcatatggaaccaaaaaagaacccaaattgccaaagcaatcctaatcaaaaagaacaatgctggaggtacacgttgcctcacttcaaaatgtattacaaggctacagcaaccaaaatagcatggtactagtataaaaatagacacacagataaatggaacaaaatagagaaaccagaaataaagtcaaatacttacagccaactgatctatgacaaagatggcaagaacactacactggggagaagacacacttttcaattaatggtgctgggaaaacgggattgccacatgcagaagagtgaaactggaacgtatatgtcaccatacacgaaaataaacttaagacggattaaagatttgaatgtaagacccaaaactataaaaatatagaagaaaacctaggaaaaactcttctagatattggtttaggcaaacaattcatgactaagacctcaaaagcacaggcaataaaaacacaaatagacaaatgaaacttaattaagctaaaaagcttctgtgctacaaaagaaataacagaatgaacaatctcaggaatgagagaaaatatttgcaaactatacattcaacagaggactaatatccagaatttacaagggactcaaccaaaaaacccccaaataagcccattaaaaagtgggctaaggacatgaacatttttcagaagaagataaacaaatagccaacaagcacatgataaaatgttcaatataactaatcatcagtaaaatgcagattaaaaccacaatgaaatatcaccttacaccaatcagaatgggtattaaaaagacaaagaaaaaacagacattggggtgcaaagaaaaaggaattgttatacactgtcggtgagaatgtacattagtacaacctctatggaaaacagtataatgagttttcgaataactaaaaatagaactaccatttgacccagcaatcccactactgggtatgtacccaaaggaaaagaaatcattaaataaaaaagagacctgcactcatatgtataccacagcagtattcaaaatcacaaagatatgcaatcaaccaaagtgtacatcgatggaggactggatttaaaaagtcacatatgtacacaatactatttagacattaaaaagaatgaaattatgtcttttgcagcaacatggatagaaatggagaccattatcttaaatgaaacaactgagacacagaaagagaaatactgcatgttctcactcaaaaatgtgaactaaataatgtgtacacacagaagcagagtgtacagagatggacaatggaaacttggaggggtaggggattaggagtggagtggatgatgggaggttgcttggtgggtacaagctgcattgctccagtgacagatgcactgaaggcccttactttaccacagtgctatatatcaacatagcaaaactgcacttgtttcccacacctatttacaaaataaattttaaaaattttgtttaaattatcaaaagtatcacaactcatttcttgaaagacattttctgctttcattttttcacctgacattcaatcctcaaactactgaaaaatgaatttgctcttagtgtttaagcaaaactaatctttccaagtgatcaataatttcttggttattagaatgaacagatacttttcagacctttgagcatctaatagcaacataatgctctgtttagtagcaaagacaatgggaatgcaaatcactgctcagccacttactggctattagaccttgaataaatcacttaacctgtgtttgttttccagctataaaatgagaataatacttagagttcttaggagagaacatatacaaagagattacatatacaaagcatttaggagagtgcctactagacaacaatctatacaagtgttattgaaacttgcattcttacgtatcaaagactcctgagtttcttcctccttctctagaccatctctgctacttattcatactactttctttcactgactccttcaacatggttctcttctcttctatgctttggctcaaacccatctaaatgagagtccctttgggcttcaaactccccaatccacttgcctactgcacactactatttatatacctctaaagacctttcaaatatgaccaaaattgaacttatcatgtttctccctaagtatgtaccccctattttcttctccttgttggctaggaattagaaacagaagtttcctgaatttctctttgccactctagtctaattgttctctaagacctactgattctgcttctttatcctgtcaggtctaaaggaaatcatctatattcaaattcctgctctacttcatatcatcaatatgatctcaggcaaattgcttaacctttctgaaacacagtgtctttaataacagtacctatgtcataggtctttgtgatgattaaataatatacgtaaaaactacctaacgcatggaaaaaaatgcaatgaatgttaactttagttattattattactatcttttttcaatatccttcccatcatcccctctgccactggcccagatcatcatcaactctcacctaaattactgtaattgcctcttaactaaacatctttcctctaatcttgcattcgccaatatattctctacctaggagcaaagttttttgaactcaaagtaaatcatgtctttctcctgctaaaacctactaaagacttcccatagcttttagagtaatatccaaattcctcaacatgcacataaggactgctttttacctcaaaggaaggtacagcacagtctgttatcccgtaagttccagctcaactttcgtgatctgtcagaaccaaaagctctctcatgttcacacatcacaatgctaatatcacacctattaattttaattggagatcaggtgattgatctgtcagaccccacagaaatgtgattatctttagttccgggactatatttattcatctttgtacctcagaaacttactccaatgtttcacacacgaatttgataattgttcgctaaataagtactgaataagaataacttattgaaatattcaatctcaaatgttatgacaaagataaaaaccatacctaaaccagttctcataaataaactcaacacttaaaaactgcattccttttagtaggaaaaagcattctgagttatagaaattcttacctgaatatatttcttgctataattgtaacctggctgtagggatccgaaatctactttatgtaatttactcagcggctgaacttcaggcaccccattgacttcctttattaattcaagtggcatatcagttctgcttcacactgatgtccaaagcaaattcaactagggaatctgacaacttgctgctgaaaatacaaaaccagtgttttacccaaaatgaagtcaataatttgctttaagtctctttgacttagttatgcttttccttattatagttaacacggttcggggttggggggtgacaggaggatggattattttacaattttattgcaaagatcaatacaaaacattcttccaaggaactgaaacttaaccattttctacttagctgcgtaaagtacctccaaaaagccagttttaagatctgtaacgtcactaacaaacgcttttaacattgtgctttaaaatgtaaaatttattggggaagagggaggctgaaaaatcgtgtttttttttaacccccacgggagctgtaatattgtatagacaaactgtgcaccaaaagcatcgtactccaacatgtttctgtggccccctcccttcacccgctaaataaatgaagaaacaaaaattactgaactgagattaacttctgcatcgtaggctcaaccttatttcacagacctcttgacggggacactcactagtgtcgatatctaattttaatgtttgcgcaccaaccttcccccaagccacctgagctctgtgagggcggggacttggacttaactcctgtctgcttctcccaaaacaccaagaaagatgctgaacacagcaggctcgagataaacactcgtaagaaagcgtttctctgcgataattacatcaaattttgatctaaactaattcaatcccgggcccgttacgtctggcacccactcaaatgaacacaccaaaccttacaaatttcactcacccgtactctagaaagaaccctaggaagagtttaggcgggcgcgcaggtgacgtcacacgcacgctgacggttcagctccacgcatgcgtgcaggatccctgggcatagtcgcttgttctccgcccgcggtggaccagctgcgtaacggttcacacactgatggcgcctggaggtttggcgaaatactgac

SEQ ID NO: 2629 - DNA, 107599 bp, Homo sapiens; identical to SEQ ID NO: 2628

SEQ ID NO: 2630 - DNA, 107599 bp, Homo sapiens; identical to SEQ ID NO: 2628

SEQ ID NO: 2631 - DNA, 107599 bp, Homo sapiens; identical to SEQ ID NO: 2628

SEQ ID NO: 2632 - DNA, 107599 bp, Homo sapiens; identical to SEQ ID NO: 2628

SEQ ID NO: 2633 - DNA, 804919 bp, Homo sapiens
caacatttgcaaaacattcctttattattagaaataaattatttgtataaaaaattgcatgcatcaatcattgcatttatttttagcacaacccagggcttcaatctggtcagccattacaagaaacagactcattgtcttatacaagttaaacaatgtgggacaggaacgggagttctcacaatcacagaaaaatacaagaataacatcagacattatttatttcaacagcattttttttcacgagctaacattagttttccttttgtgatttgttttaactgctcatgaataagcaatactttagcttgacactcattggttttattgtataaaacgggtttcttcactccccgtttattgatacttttggctcatggctaatttttgttccttacaagactgactattgatttgattgattgtagtctacggagatctccaggagtgaatttttgcggtctcatgttcatcatttaagatcatataccacatctcttcagattgtgccatttccctgtttcagattgaatgattgctgtaactgatatatgttgtcttggtagaggaagctgttaagataaatgaggacaaattaaaatagtatataataatacatccttttgttaatatgattttaaaattcaagtcctgtaatgactttttaataatatccagcttttacagcatgttactcattatttttaaaccattcacagtcatgcacagcacaacgacatttgagctcgacagcagactgcattatataaaggtggtcccatgagattataatggagctgaaaaattcctatcacccagtgaacacataacacaacacaacacataacacaacacataattcacatgtttgtggtttgttgtgtaaacaaatttcctgtactaccagtcatgaaaaagcatagcacatacaattatatacagtacatagtacttgataatgataacaaatgactatgttgctggtttaaatatttactacactatactttttatcattattttaaagtagacttcttctacttatacattataaagttaactgtaaaatggcctcaggcaggtcctccaggggtattcccgaataaggcattgctattacaagagatgacagctccatgtgtgttattgccccttaagaccttccagtggaataagatatggagatggaagtgatattgataatcctgaccctgtggaggcctaggctagtgtgtgtgtgtgtgtgtgtgtgtgtgtgtgtcttagtttttaatacaagaagtttaaaaagtaaaatgaataaataaaaatagaaaaaagtctatccttgagtaagggtataaagaaaatattttttatagctggacaatgtgtttgtgttttaagtttttattacaaacaagtcaaaatttaaaaagaataaaaagttcataaagtaaaatttatagtaagctaaaatagtatatattgaaaaaggaaatgtttaaaataaatttagtgtagtctaagtgtagagtttttataatatctacagtggctgggtgcagagactcacgtctgtaatcccagcactttgggaggcctaggcaggtggatcacgaggtcaggagtttgagacaagcttgaccagcatggtgaaatcctgtgtctactaaaaatacaaaaattagccgagcatagtggcacatgcctgtaatcccaattactcaggaggctgaggcaggagaattgcttgaaccgagaggcagaggttccagtgagccgagatcgcgccactgcacaccagcctaggcaacagagcaagactccatctcaaaaaaaaaaaaaaaaaaaaaaaatttacagtactgccatgtcctaggacttcacattcaatcaccactcattcacttaaagatccagggcaacttctagtcctacaagctccattcatagtaagttccctatttacatgtataccattttttatcttgtatactctatttttactgtatctttactatgtttagatatgtttagatatacaaatatcattgcattacaactgtgtacacaattcaggacagtaacatgctgtacaggtttgtagcttagatagactaggctacaccatattgcctgggtgtgtcgtaggctataccatttggtttgtgtaagtacactgtatgatgtttgcgcaaagacaaaattgcctaacaacacatttcttagaacatgtcatcaagcaatccatgactgtagtaaaaattaaatgacagtagaaacaaaaatgctgcagcaattttaatctgtcaaaatcagtagcctcatttatagtatataaatatttactagaaaactaaaaatataaaagtgctaatctttaatattttggtaaaattttacatttgcacatatgtaaaatgaaagaacagatcaattatctgtcctacaaaatataaaaaatattttttactacctaagtcaaagacctcaattcttagaggctgatgtaatgaccaagaaaggtaagtaattataattagctgtcctatgagaatgaatacctcttccacttaaaaatacacaataatcttagactctagaggtaaacatgctaaaatatcaaatatatagaaaacatgtgaattgccaatgcatatttatggtttcttttggtttcatcaaaaggagacaaatgaagataaaatttaagaaaataaagactcaaataaagaaatgtttaattgttctgttgccaacatactgtaaagtaaaactcattattgtaaggccattacagagatattatgccaaatttatactcatgcctaagcttctggagaatataaatctaaatccaaataattcctttgtattgttgaaagatgtgatgcaatgaatctctgtcctaaaattcaaatgtgatgtcctattttttcatgtaattctggaatgaataatcgtaagataaaagatactttaaaaagcaaagaatgtatgtgtttcaatatatgaatccaattcaggatgaaacagatttttagaaaataatttatttattgaacattgaataagactagaaattgtaaagttcctcctcggaaataactgacaatcagactcattccatcttagtgacactattgatggattagacaagttcttaccagagaccaagttcatacaaagttcacaaccactaaaattaactcagatagccctaagaagtgctactatagatgtttttttcattgttgttattttttatttcattgaatattatgagcttcaggctaaaaatagttgacatatctgcttatcttatctacattgcttatccttctaggttattattgtggcaccctgcaaaggaagtagactttagacctggttttaaattacattctattccctgcaaaatgcgtgaaaaaaaaaaaatcattgggccaggttactgggcctcagttttatcactggttcaaaacctacaatactgtgttcctgtaaggtcaaaagcagaatagatcgggatggaacagctgtagtctggaagaaccaatatagaaccagcctccctccctcctttcctccctatctcccttcctttcttccttccttattttcttttctttccatgaaccatacatgagacctaatggagtcttactttctacttaacctttccaaaaggtaaaatatttgttacatttggtttggtgtgaagtgaaacacaatgattttctatgatcactcacttttactttctatttttaatttatataatactctcgtatgcctctaaatttcctctaagaaaataaaatctgtccttcagttctgcttttgaaggactttcatataatcttcacagacaaggtggagaaaaattgtcataagagtgataaaaatgactgttaaaagggtcatccaacttcctacactgttcaatattttcaacaataactaaaatgtatgaaatagttataaaatttgtatatagctagaaaaagaattatggttgaaatagagtagcaagagctgatagatcttgaacaataaagttttcagaagatgtccattcaacagatggcagtttggattagatcagttttaaggatctttctaactttggggctctgtagctaattaaaaattaacatattattttttgaactcttaaacatggtttctagaaagaaaatggtagaattctattgagaattgagaaaacaattcacaaaaggacagcaatgctaattttcctactggttagaaaaggaagtgtaaggttctggaatcagatgatttagtcaacatgaaagcaatgataagggacaaactttgtggatggcagatacctcgcaagaatctttatcccagaagtattatagagcaaaatgaatcagagatgtaccaatgagttcatagggagatgtttttcacggtgctgatgaatatgctcatatgaaaatcagtttttgagcacagcaacagtaaattaatttccttgtgtgcatcacactgtgttcataagctagaaaaaacaaatctacctccagcagcagctgttttcatgaattattcatgaacatagcttaaagaatactatgtacagcatttgttaattgggtacagttggcaaaattcatatatatcaactttgtttctaactcccctcgcactctgttgtgaaataacacttgaccttttttaaaaatgtaaactatagtctgcaaattcagcaactaacacaacactcattggtttcccatccagcttcgtattacttatatttactctgtgtagcttttgaaactttaaaatcttgaacacagatctaccctttcattgtaggatggccatggaagtgaacaaaggttaaaaatggtgatctggagtaggattgtggaaggatgtgtgaagatgtcacacatctttctctcctgaatgagtacactgtaatcactttacttcggcccaacttattcaaacctaaattatactcctgtaaaagatcaatgcactaaaatctccaaagtacaattaaacttttttttcaggcagtaactgatattatcttgatttactttttgactttacttcaccttctaaacgtgagcatctgactcctccagaatattataggcttaccctccaaataggccttgtttttgcaatctttcattcttattttagagaaaatagagaaatacatgcaggctatataatttccatttcaacattaatagaaaataaccaaaggaaaacagtatctgtatgagatttacttcaataatatgagattggttcttatcaatactgagaattttgtttttcagggcatgtatttattcttttaaagtggtgaaaaagtttattaaattttttctccaccactttccaaaggtgagtctgaatgactggtatttatatcactataagtttggttctttaatttggcaaccatattttataaagttttctggattgctgctaaaaaagaaaaaaaaaagagaaaaacaggtaaaacaatagactctggtgagtcatagtgagaagtgccagtgttcaaattacatcactggccaacagcagtttattggcatcctataatagctttcaacttcctacactaatgctgtcaaggtaggaaaaaaggtaaaattctgtcctcaaatcacaagcattctactttgatgcctttaatggcagttacagtataccttttgctaagagccgaaataggtttatcattagtaaattgcttacctatactcagagatgattgtaatgatttgttactaaagcccatccttaccttgcttcgcatatttcttacttcacaaggtttcatgtttgcagaaaggtgaatatgtggagggtgtttgtgaaattcttgtaaggttcatttctctacacgtgactaaatttggtattggtgacccgaagataatctttttagaaccaatctggctaatgattccaggtaagctgatagtaactgaaaccaatatgtctaattaagcaatgctaattaactatcacaggatagttctgtgtatggtaaattagagtagacaatgcttatctagaaatcttgatagaaaagaaggtttgtagatggaatgtagaccataagttgctataataattaaaccaaataaaattaatttttagttttttcttatatttagtgtcaaaagtatggagagtaggggatacagactgctggatgaatatgagaggaagagaatatttttgcataggattttgtccttaatgcctgaccgggtgtggtaactcacacctgcaatcctagcacttttggaggcttaggtgggaggatcacttgagcctaggagttagagaccagcctgggcaacagagtgagaccctgtctctacaaaacaaacaaacaaacaaacaaacaaacaaaattagctgggcatgacagcacatgcctgcagtcctagctatttggaaggctgaggtgggaggatcacttgaacccaggaggtagaggctgcagtgagcctagatcataccactgcactccagtctgggcaacagagcaagctcctgtttcaaacagaaaaaacaaatattgaatccctatgctatattccaaaagactggaagccactctaatacaagtacctttgcttttctttcttttttgattcatctgtagaacctagtaaggtaaaggttgtaatgtttaccatattcagcttcctggtattttaccatacaaatcttcaaattatttgccactctttcatagataccaagatgggcttcaatagatcagttaaattctactggttgagcacagatttctgtgtattgttatcatgtgctttttcctgggtggactgtagagacgaaaataggtaaagaaaagaaaaatggaaaggtggttgtagaaaagattctatttccaggatcatgaggcttttaaagaagaactttaattatcttaatatatccaagaagggaagtcaagggaagccctcaggaagcccaaggaaaggggaccacgtgggagaaacaagtattaactgtgacttaactaaacatattggctaactagagttctcatttccctaaaggcacaaataacatcatttatatgtgtaagatctgtagtgatattctgtaagtatcagcaaactactgatactataaaaagcacccagtatggaacaagaaaaattgtggaattgtttccaagtactaaaagataatttttataagaagatgacgctttcaaataccaagctttgtaatgcttcaaaagaaagatctgaatgtcatgctttgtaaaagagattttgtgagcaagtttgtactctgtagaacagccgctcatcttgagaccatttgcttcgaatggttttaaatgtgatggtgtcacggtatgtgagtaccatcatgcccctggaaacatgtagcacaatccccaagactaggagaagaatgttcaacgtacatctattaggaagtgctcccgctcttgaccatcggaaactctacagatgacttactgttggtttcaagactctcacagagttcacttttcacctcgccatttggtctgtcatttcctttttggatcagtttgctttgcatggtggcagctgtcaccacagccttgaagctcctcttgcgtttttgaacattctgttctggatgaaaaattataatataaaccttgggcatatagagcatgcccagagatactgaagcacttaaactcatggagacagtaagtgttgttgtctggatgtacatctgagggaagaaaaaaaaaagaatcactgttggtaagcctaacagtaggagataaagcaaataacatactattttctaaaattgttccagcttctctgctaaaggcacattaaaaggcacttattgaaattgtccttaattatagtcaaccattcctgtgtcctaacctgcaaatgtaaatgagtaaggttatttttttattgaacccaatttattaaaataaaaatacaaacaaccaagctggtggagtttattttcctttttagattataaataaacatacataaggaaggggaccaaaccagtctggcaaaacactaacacttaatgccacacagaacttctttagaaggtactagtgggccaagtgttattgtagcaataagtttaacccagaaggtaagtatacatagtgaaaatagagtgggagtgcaacattccagaacatcactattacacacctgtgcttgaataatgctagtggttgcatcttcacatcattacataattccaactaccaaaaatcacaagcatgtcataagggcttgattttttttaacagtccctctaaagaacacttccagaaggttctcagtgatagcatcatatcgaaataagtcaggtgcttttataaaatatgtaagatctcctccctccaagatatatgcactgggatatggtcccggtcactgcattctgaaattctccccctgtgctcattgcttgcccttatcccactgaaatcgactgctctgatacttacagagagagctctttctggaaggtttttctttctacaagctagaggttaagaatctgaaaaaaaaaccaaagctaaaatcactgctttggctttttcttttttggttatggtatagaaacagaaacagcagtatttcattctttaaaaacagaaacaaaaacctttgatctggttccacttttcatgtcctgagctcaaaatagaattttccccaaataacttgggatactgaggccacggagaaaccacatcttaagactgtaaagagattctccctttgtcatatctacgaccctcattaatagatctgttcactctatttacatctctgaatatgatcctgattagttggattttttaaatatgttttaatctgttagtcttgctaacatctatcatactagttagatctcatctggcaatcctcaagaccaaactaattgtgtccttttaaataaagaatcaaaaacaaaacaaaacaaaacaaaacaaaaaaaaccattcgccctcaagggtaaataactgaatcagcattagtgttgccttttcctagaggagaaggtttctcttaacagatggcaaaaccttgcggtaaagaactgtccaaaccatgagcaggatgtgaggcacaagttaagaaactgtctttggatataaaatcataccatgcacactgctgaatttactgcccagttcatctgccactaaggctgtccttgcatccttgcataagagctcattgtttaagtgtggaaaatgctttaacgagatttactacaaagtttacaagatttactacaattaagaccatcccaatgaaatagggatgtgtacgtttacggcttataaatctcctaagttttgccatctacttttaagcaacctattattttaaacattcctaagcttcctaagtattggttaatcttttttgaattcctgcttattttcaagctagcattgctgcaaaaacctacatagaaaattgactgcagagagaggacataaaggtaagaaaagaatgtggcaaagtacaaaccacacccatacatgttccaatgccagtcaaatagaaaaccaccagtcagactctttcaagtcaatttagcctaaaaacaaacaaacaaatccaacgacgaaacagccataaaatgatgggaacatctatactgattagttggattttttaaatgtgccttaatctgttagtcttgctaacatgtatagtactagtccaaatagtataaaaatatttttgtaataaacatcctatacattttctctgttaccaaaaatataaataatagtcttctcttatttggaataatttctgcgatatatagtaaatttaatcctgccaaatattagacatgaagaggactttggaatgctagcttcctcgttaaataaattaccgcagtctatccttttggcaagccaactcaatgaaagatgtaataaacacagatattagaattaaatagtaccatggttagtgtagcaagctcttcattggacgctatactttcaaattataccaaaatgctgatcttaattatgtactttcttaagacagcttctgaaaaattttaatgtgagtttaatacaggaaaggcatctaacaaaatccttagcaaactaacagaagaatagaaaaccaaatactgcttgttctcacttataagtgggagctaaatgataagaacacatggagacatagaggggaacaacacacactggggccttttggagggtggagggtgggaggaaggagaggatcaggaaaaataataacaggtactaggcttaatacatgggtgataaaaataatctgtacaacaaacccccatggcacaagtttacctatataacaaacctgcacttgtatccctgaacttaaaataaaagttaaagaaatccacaaaatcataccctaagtccacaaccttacagtggcctagcatttgttacagggccatggaaggaatatgttccagtagacctgggtatgaattctgaaccaccacttaaatacatttttttaaaagataaagtttacagagaaactctagagttattttctgggtgattaaagtccccaaaccaacctcccaggctacaatctaaaccaatcaatcttccctggttattggacaaatatggtatcttattttcttctctgaacagtaagttcttatctatgtcacagggtggggttgggggtaatacttttctcatagaggagttacagggtagcatgatatatttataaaatctcttacagatacaagatagctcaagaaacattctttaccctacaactttgcatctaaaaatatgctaacaaagtatcctcccaggagtataggacaaaagaaggacctattacacacttattcaaaccagttttgtttagagaagagctgatagccaggctctgactatacgatgttgaggaaaaggcctttgtaatctcactttaatgtagacagaataaaattttgtccaaatgtgaactcaagaccatatttactgcctgggccacatgcttagaataatataacagctctttatctcaaagttacagctcatcagaatgcaggaggggactgtattaactcccactaacccacaaaaattcaagagatgctagcaatgatattggatatgtcaataataatcttctctttcccagccttctcttacgtgctccctcctggccctgtcactccaaaatactaacacccagaggatggggactatcttttctatcacacgcactgatggcttgttacttactctgcctccatgccccatggacattttgaacctgaagcagtcagatgccctgaagcagatttaagcaatctctagataagccaggggtgagctgtgacaatggagcatactaatatgaaatcttttctgggacctattacagttccctcttcaaactctggataggtcatttgtacatatcaaggtctactcaacgtaggccatgatgtggtatcattaaagactccaggaagagtgaggagggaggagattttatttttccaggataaaggtcagtcttttgctttcaaccagctgccagtgcacagaccaccacagactctgacatccaacctggtatttttgcaaccccttagtaactaaggtaaactattatgaaacctaacactcaaagcaactttatgccacgtgataagaaacagactcagtatttattcctgactatttctgttttgccctcgatggtttaatcttaccactttgttttagtcaccaggttctgtttggctgctttgcataccgtttgaccagctagaaagctacactaacactgacagcctgtatttctctgcttctgtttctacttcctcatctgcgtgtctgccaaagtgaaacttgcatcaaaaaatgggttttcttttgctttttagcagccaatggacttcaaaataccatttactactagaagtgattttttttttttaaagatgaagaagtttatagagaaactggagttgtcctgtgggtggtaacaccccaaatcaatctatcatgcaaaagtccaaactcataaaattcccctagcaattgaaaattgcaaaaaccagaggcaaccattcagctttgctggctgagcctgaaaccactaccaagctcatatcaaacgtttttattttgttcctgtcttgtttacattaaatatcttcctagtttcattgcttagtctttttctctctgtctcttactcgcttgctgatcatattagaattacacccttaaaccaagacaagcttcatgggtgtgcacttgtacacaagaccctgtaatagaagggccccatgcttggtttaatgctctgccacgaatgttttgaagtctgtaataattgttaaagaaagactcctgcattttcatttcttactgggttccacaaattatatagctagtcctcttttaaaaatcacttatatactgacaaattccgggcttttcttaggaaaggcatttgtcttttgggtcactcccttcggtgcctgacagcatctgaaacttaacaagcctctgattcccaatcttcatccctaaacttgatctcccagtggtctaccctatctcattaataccgtgcttctagttcttgggagagcaggtggacagggaacttgaaattgtcttttactccttttttatactcccaccctatctatgaccatatcctattgattctaccttcaaaatttgctcagaactttcagaatgtctccactggtgttacattgctcagagccatcatcatctctcatttggatcagtactgtaactgtcctagtgttctctttcctgctgcccttgctctcttctgtttgagcatttgattgatcctaacacagaagctagaataatcccattattcataaactgaattaggtcactcctactctccaaagcctactctccaatgacttcccattgattgtatcttgacaatggtccacaagatcctctgagaactcctctggtttactctttttttactcattcccttccacccatactggctccctggctgatcttggaacataccaggcatgcttctacttccagacttttatatctggtggcttgcctcttcactgccttcaagtctttactgaaatgccccagctcagtgagacctttcctgaacacaccattgaaaattgtaacccccaaccttctaccagtattcctagctttatcacactccttagtatctaacacattatatcctaaaagtctatatattttactcatttaatgtatgtggtacctatttcccctagctagaataaaaattccatgaatattgggaattttacctgtgttgttcacggctgtaaactcagcacttagaaaactgtctggattaagaaaatgtggcacatatacactatggaatactatgcagccataaaaaatgatgagttcatgtcctttgtagggacatggatgaagctggaaaccatcattctcagcaaactatcacaaggacaaaaaaccaaacatggtatgttctcactcataggtgggaattgaacaatgagaacacttggacccaggaaggggaacatcacaccccagggcctgttgtggggtggggggaggggggagggatagcattaggagatatacctaatgtaaatgatgagttaatgggtgcagcacaccaatatggcacatgtatacatatgtaactaacctgcatgttgtgcacacgtaccgtaaaacttaaagtataataaaaaaaaaaaaggaaagaaaactgtttggataacagacattctctataatcttttgagttggtgtgagttcatactcccaaatttgggttttaaggaatataactcatgtatttccaagaaggaaaaaaaaaaacagatactgaaactacaaaatatcagaaaactggaggactggaggactccattctttttcatagcaatctctaggctgggagagaaatgtaatcttgggcagataaacataatgcccttttaaacagtaaacttggtaataatgggccattttgctctccatcagcaatgaacagtataattcaaagtcagtcgttttcactttgggaataggagagctctgggatctgccctcaaaacaagttaactgtataactgagggtcaggcactcacattacttctaagttttcatagacttaaatcaaaggatttagtgagacaacatatatacacagtggcacagagcctgggatatattaattaataagggatagctttattgtcattatttaaccttgacaacctgttctctattcatcttccttcattctccacgtcagaaacgcttaacactacttctctctcaaaatcagcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgctgctgacccagcagcaggtcagatacattgcactgtgttttcattagtggaggtggagaccagttgtctgtaatccatttgcagtcacttatcacatcccctttcggctcaggacacatatttgcaacatgaagagtcaaatcaaaagctacgaataaagaattgtgaaggaagactacagatgcagagcagggcttgttctccctcctgtgaggtctttctgaacccttaaccttggaatgattgggagaggtggaaactagctaaagagaatgatacagcatcaaccaacaagcagaatatcagcttctctaatgataggaaagaaccacgtaaggaagctcaagatctgttaaagaaggagaaaatctatctgatttacaatgactataattaaacataagtgatctttaatatttggattagtaaataatttgtttttattaaagcctgatggaaaatttaaaaacagagtaaatttttaaaactatggcattattaaataaaatgtggtctttaattttcaattattatatatgagaattatttacagaaatatagtaaataagtaaactgatgttgcattttctactgggatatgtatatgaaaattaatacaaggtgtctactctctcagtgcttattaattcctcctttacaggtatttttgctcatgttttccttcgtggatttctgcttccatggtaacttttggccctttatcactgcagcagcatggacagaactgggaataacagcaatggggatgtctttaattattatcatttgaacggatatcaaaatataataatattttcaggtagagaacaaataaataaaagtataaattagtttagaaagaagcaaggaagaggaaacaattgtttcaggaacaaaatttatctctgaactatattttaaagtatctctatctctatctatctgtctatagttctagaagccaggaaaagagaaaatatgttgaatcctatatttatcactgcctagagacggaagccttgctagaatttaaattttaggctaaataataaattcaggttgtgttatctaaggaaagttggtaaaattatgaaaatggtttcaactgtagttttgcgaaaggcactaaatcttggtcagatagatattttctctataaccctttttaaagacaaaataattgattcagtaactcagtgcaggtgcttttgcggaggcacatgatgttttaaaagtgctatttttttttttctggtgatatcccttaatatagtaagaatcaagaaaaatggtgttatgggctgaattgtgtctcctccaacatttgtatttcgaaggcctaacccccagtacctcagaatgtgactgcatttgaagacggggtctttaaagaggtaattaagttacaatcaggtcattttggtggtccctaatcccatatgcctgatgggcttataaggagaagaaattaggacacaagacacacagaaggaaaatcacgtgataacacagggaaaagatggccatctacaagccataagccatggagagaggcctcagaggaaaataaccttgttgacaccttgatctcagacttctagtatccagcagtatgaggaaattgatttctattgtttaaaccaccctgtgtgtgatacagccctggaaaactaacaggaatggggagttgatatcactgaaaaagttctgaaagttctgtgatagtagttggttgtggttaaatataccaatagaatctcaaagatgtctgatattgattaaaacgatgagtttagatactgtacaataactacaaccataacatctatcaattattgaggatcaagtacagcattatgccaaaacttttatgcacttatttaacccctcacactaatcctgtaaggtaggaatgaataagtctatttttgagaattacacagtcacgaagaagtcatttttgagacacagtcacttttgaaaagtcatacaatacatgaaaataaagtgtagattcaaactgaggtttctctaatttgaaagcccatatccttaccacacaccatctggcccccataaatacaccgagaagtgaaagagcaggattaatgtgacttgagtcctctccaaatcagagaagcatcccttttctaatagatttgggccaaatttcttctaaataatagaggcacagttaaagcacttcaattaatatttagttgtgcattagagggtttctgctgttattaatcagctactttcttcataaataaaagcctcatgtggatcctagaacagctctggctttcttataattacatcttcttaaacttgacaaaataatctagctgagaatatgggcctgaagagctggataagttaatcttttaaatgatgtttagcattgagtttgcactgggttggagcagaaaagtctctgatgaaccactggccaccagaaagaacagggattccctacatgcagaagacattgctgcataggcaccattccacctctatagcaccagagacaggctattgacaatacagcaggcaggcgaaggtggattcaaatacagatgaactgacaaccaagaattagcaaatacttaaggagaatcaagacaccttacaaagagaataatataaacatacaaaaatagatccaatagagctaaagaaggaagactgtggaattaaaattattgttatcttagagaagttttgaaaaaaaaataacaaatccataaaaatatcaaataaattcatataagctaacattttaatcattaaaataaaatctcagtagatgaaggacttctgattctggctatggaggagtagctataatcaaaccaaaccaacttctgagaataactataaaacaatcataaagttaagggaaaaaagactatttggaggtgtcagaggagaaccaaggtagccaggactcaggggaccaagatcctagtaaggaaaaagaaagcacattgacatatgtccagcactctccactgcctcttattcccaggtaacgtactgattctacataggaaagacagaaatctttagacagacctgtcagcagtctcatgggactagggagataaaatctggaatttggggttatcattgcaatcaggacttaaggacccacaattctagggtactacagagaagtaaaccgggtattttataccttttttttcccttgagactttgctgaatcctaagtgtaagaaagcagcaagctaaaaaaaaaaaaaaaaaaaaaaaaaaatcaaacataatctagattcagagagaattcagttagaattcaggtccatggaggagaatgattactcataaaatatcagacatttagccaatatatctaaagggatattgctgaggaggaaaggtaaatcagaaatagacaaatccataaaaacctgaaacttatcctcgaattatcccaatcccagattatatcaaggtgaaatgtcttgatatatatatttcaattgccgactagtagaaaattgaagcttctctagaaggaaataacaatatatataacatctacatttttttaaaatgtacaatgtcagttattcaataaaagattaccagccaggcatgctaggacacaaaaacaaatgaccaaaaaccgtgggcaaacaacaacaaaaactaaacaggtgacagaaatggtgccacagatgatcagaaccaggcttctcagacaaaactttaacataaatgtattgaagaaaatacataatacgatattttcatcagaggactggaatgtgtctgtgtgtgtgcctgtgtgtgtgtgtattgaagtcaaaaattataggagtgaaaaatataataattgaattgaatagatgagtttaataactaattagctacatggcaggaaatgactgatgcattaaagataaatcagtaaaaaaaatatccacggtgaaggatggagactataaatatttttaaaattcagaaagaaattattggagatatataaaacatgatacaaaatttgaataaacatgaatcttaagtcctagaaagaaaggagagatataatagataaaaagaaacacttaaaagagacactggacaataattttccaaaacttatgaaaaataatctattaaattgtacagaaaaaaattaccagatggccacattctgggaaatcctaaaaaatttcaaggatttaaatacagggtatgctatctgactaatgtgaaatcagattagaaaatagaactaggttggaaataaataacaaaagaaaattgccaactgtttgaaaattaaacaatacatttctaaatcactcataagtcaaaagaaaaacaatggaaattagcaaatattttgaactgaataataagatacaacatatcaaaagtcatgggctaaagcagacacaaaagaagaaatcttgatatgattattcatctcaaaaaactaaagaaaagggagagaaaattaaatccaatcaatatagaaggaaggaaataataaagataaaagtcaataaaatagaacacaaatgtaacataaagaaaatcaacaaagctaaaaaaaaaaatctttggaaagactgtaaaattaaaccactcacaaggttgaccaagaaaacaagaaacaagacataaattaccaataatttggtaattattcctaaaaagggaagaagatgtgatataagattttaaaaatatgccagcaaattacttctaaatgttgttagccaaaaaaaaaaataaagtgtatgtttaaagtttaagagcaacttagaaaaaaatgaaaatagtatctaaaactcctgaactatcaaatgaaaaaaaatgagagaaaacttgatcagttaaaataatttcagagaagacaaaaaaagaaacatgagaacatagtaaaaagaaaacagaaaacattagcaaacataaatcattaattttcattataaacactaaattccctatttaaatacagatattatcaggtttgattttaaattgtattctcaaaagagaaaagcatatataaagattataataagccaagttgaaaatacattttctatgccaggaaaatgtaaacaaagaaatctggaaagtaatattaatataggacaaaatagaatgcaagatataatcattaaattatgcaaagaatatatatacacacatacaattaatccattatcacaatgtatgtaagcaacgcattatagaaatgcaaggatagacaaatccataaccatcatgagagattttaattcatcttttcaaagatagaaatttgattatacaatatataattaagaatagtttgaataagtcagtaataaaattatcattttcactgcattattttaaaacataaatgagcttcacagagatcaattatgaattaggttatccagcaacaaaaataaaattttcataacaggaaacatgagactatatcctttcacctaaaaaggtaatcaaattaaaattataatttataaataaatatgagtttttatttggaaaccaaatatcatccctgtaagtaactcctataaaaaggaaagtacaaactatttagaaattgaataatcatgaaaacagtatgtatgaaaacttgtggatacaacctaagtggtgcttgaaggaaaatttaaagtccaaaatggcaatcttaggatgcaggaaatctcaaaaattaatcatggaactaggtaaactttaatagaaaaaaaaaaagtaaactcaacagagaaagaagaaagtatttgatataaaagaagaaagcgataagacagaaaactatagtactcataaaccatatcatatttggtaatatgataagtccacatagaaatgaaaaataagatgtaagtaccagtacaaattagtttttttaattctaaaagcaaattttgcataactttacaccaataaatatatacatctagaaaaaatgcaagattgcccaggaaatagatattagaagtgagaaaacaaaacaaaactatatggaactaaaactatggtgagtaaatcagaaaggtagtacgtgactgacagaatgatgatgaccctgcctgagagagagccagccatggagtgagaacaaggaaaacaaggaaagtattcacccccagctcctatgctgttcccctacctctcatcctctgacacttacatcagcatttttattttgcttttcattgtgtattaggtagggtacagtccttttcagaattagtgatgcaagtgcatggcaaatatagtggcagagacaatttttctgatgtttaatctcctcttctaatattttatagtgtcttgctgctatttgaaaggaagaaaataatggtgggtatcttttcccaacgtgctgaaaaaactaattacggtggcaatgcagaggctccactcaccccttatccctgggctatctctggggagcctggatatttgctaagattggcccctttactaaggacagccctatgataaggagagttgaggaagatgtaaagggaactctatctgaaagggtggaaagcataagacaactaaccacttccaactcagcctcaaagactcagaaccctttctgtgttccacaccttgataaatggtatctttcacaactcaaggatcatgacctgccatgattcagcaatatttttacctgctctttttatgtctgcctagatcctgacagccctagacttactacatctctgagacaatatatagggagatgttcctgggtataagaaaatcttagtgctaggactggagcctccagaagattcccatgaaggtcaaagtagccaggtttcaagagaggaaaattctcagacatgacatttagaactttctataattggtcactatcatgtctgatgtagatatatgggtctgcttggatactagctatggctgaagcactccagaaaattaaaactttatccatacatatggtgacctctccaagtcactatacctagccaagatgaagcatgcactaatatgagaccagtaatctgctacagtgtgtactgattacacaaattggcactaagagccccatgttgaagattcaattatttgtggtaatgacagctttcaggaaaagacaaaatcatttcaaataggtcaaaaccttaaaacacccagtaatcacaacctcagaaactgtaggtctcaaataactaccagtgaaaggtggagaaggctttgaccagtactcataactctagaccacagacaaaaagtcctcttcttgcacattattccataagctctgtgatgtaaaagagagcttagttgttgcacaatcttatctacggctgaaaatcctcaccagctttagcagaggcattactctgaataaagcacctacagggctttaagattattaccgtgaccaggtacctgaaagagctaaatacaagagagtgaaggagaaaagccttatgtacaattttcaatgagaaactagcccgaagtccctcccacaacagtttgagacagcttctaggaccatttcatgacagtcattaccttgctggtagccctgcaactgacataagttctcagaacaagagagttgtgaagtatgagccagaaccaagaaacttgtaagtatattttagagccattagtcactcagaagccctaggcatctaaatctcctaggacagtgaactcagacatcatctgaaatatccctctttttgatgagcatagtgccttatgctactagtttcattaacttcattgatgtcctgggttcagatgacctattttgcccccacccagatcaactggacaaccttcttaggtcctgaatagtccttaggtcattagcagtctgactgagtcttctcttactgaagccctgtgttctgttgagaataaggacagcagattactcctctaatcaccagtctgctcccaaagtgatgcagctcagacacaatattccactgaaccaactagaatactctgaattttattgaaaatcactcaattctttatacatctctcacctgtaaatccattttagtgtgctttgtactcctaacccacaaccacaactcctctctatccccagcctcttctccctgcctctgcccttgtggtcttaactgaaactgctctttccaagagagttgtttccaccccagactttcaagtcatggttgtctttatttcttcaattcatattcctcagggaagatgataaggttggaccatcctttattcacctttgctgcttccaggtcattacagacttgtctttttctccaatatcctgcctttgaaactgtcttaacattcaactctacatcctctttctttcatccttgttcccgtatctgccatcagttgccttcattcattggaggttctggctctggtacctaggcttgctctcaatcccaaatgatgctgttatttcggatgaattctacatctcattctcatgatcacagctagaatcttcaatactgtgtttagtttcttgtaatacattctgtaaaatacttttggcttaatgtattgtttttagtaagagattgtttacattgcattgcattttcctttaagttatttcatttttcccttagaataaatataaagagttatgtcacatgcttcagtgatgtgagcattgttgtcgaggagtgacaagtaactaaaaatatgtagaagggatggatatttctcacttctcataatgcatgtttccttatggaagtggcttgccaggcagcctttcaaggtaccaaaattaatataaatgtgtacaggaatcttttgcaataaaactagttatgacttgttccaagtatattttaaaactgaggctgttaagttttaccacactttactgtgacagaatgtgaacttttccaagtgtgaaaatataggtattaaatagggtaacttgtattttcctcagtaataaaaaagcacatctagctattatcagacaaggtatgtgcagttataatagctgttttatatattatggtgttaaaaattttaattaaatattttatattcaaaatgaatctttatttctaggatttttatggtaattacccacatcacaataacaatatttactacagttttcattgcaaaggtcctgtatttcagttagacaattagttagatagacgtttgtggatggcataaagacaattatcacatgtaatattatatgtataaaattatatctcaaatgccaccagtcaatttaccagcataattttggaacataaaacatttttaagttggaaggccatctggatgctattattaaaactatgttcctaagagtaggagtaaagaattatgtggataaattattccattagtaaatctgataggctgagttccaaatatgtacaaactactgatgcttcagttttcagaataattgcactcaagtgaaaacttttattgtcgtggaggaaatattgagtattctttcttttgatgtgatacaaaaaatggtcctatactttctttttccttttattatttttaccaagcaactttataaatgtagcattttaccaagatgacactcaggagaaaaagacagacatttgtaatagggaaaagggatgtggcataggtagctaacaggacaccaaaatgtgtactccttcttccattgtattggattgtttctggggagtgcctggccagtcatcgactgttctgactagatgtagtgtggttatttgactggttttcaacctatataatgtgaacaagatgataaatgtcataaaagtgttttacagaattaatgtgtgtgcacttttccctagaaactcttacctcctgttgctgattctattatttatgatgaagagacatcaggggatgcaaagctataggatggaagacataggggttcctgaatcactccatggaagaaaattgccattcaaccaggaactacctcagactactatgtgagtgggaaataaaattgtatactcagtgcatatactttgaattattttcctacaagtggtggatacgtatcgtataactggttagtcagcccctctgactaaggaacaagtgaaaactgagaaggatgacagatgatttccatggctatggcagaaaaatgaaattacagtatcctcagatggattgtaacgattgaccttgtgcacattaatacgatgttctaacaaagtgtctagtctatcaaatataatcccaagccattaaatttattcctaggttcagtgacctcggtctttggttagggaaagaaagcaccaagctaggctttttattaaattttcaaggaagaatcatttcaggtacttcatatagccttcagtaccagagggagtttataggaaaggaagtctatataacagcatttccaaaaggaagttgggctgtcaagttaatagcctaaaattcctatgtcagcagctttgcacttgtgcctgatgtacaactttctcttttgacctctttccctcagctagttcaaatctgacactgcctgtaaccaacttctttgtctctggaaacaactattgccaatctctgaatatctaagaaaaaaaataactacaaatttgtcttcatttaaatatagtgtttatatatatacatttttatttttgccattatgctgtgtttctactacataaaatatagttacagttttaaattgcagttttctatgattaaagaagctgaattgcttttcctataattattgagcatttgagtatcttcttctgaaagtgatcaaattttttgcccattttctattgagtcatttatcttttttcttatcaactttagctcctccattacatattatggatacaagtttcttgtatgtataatgcaaatatcttccacttcttttactgtgtggcttgccatctttttatagtttttgtcttgaaatctattttgtctgataaacgtatagctacccttgttcctttttggttccaatttgcatggaatgtattttaccattcctttattttcagtctatgcatctttatggtgaagtgtgtttcttgtgggcaacagatcattgggtcttgtagttttttattattttttatgatttttgaatcgattctgtcactctgtcttttgattgaagattttagcctatttacattcaatgttactttattgataagtaaggacttactcttgccattttgttatttgttttctgattgttttgtggtcttctcttccttccttcctgacttcctttcagtggaggtgatttttctctgttggtatgttttaattttttgctaatttttcattgtttatctgttgtatgctttttgatttgaggttgccacgaggcttgcaaatatcatcttatttttttagactgatgacagctattattttaaactcatgacaatgtaatgcttattacataaacaaactaataagcaaagagaaaactattaaaaactctaaactttaacttcatccccccacttttgaggtttttgttgtttccatgtatatcttagtgtattgtctatgtcttgaaaagttgttgtagttgttatttttaatcttcatttcttagtctttttactcaagatgggtagtttacacatgacaattacagtattataatagtctgtgtttttctgtgtacttaataataccggtaagttttgcactttcagattattttttccttactctcctagcatattttttttgataatcaaattctctcagctacatatgttgaaaaagaatttccacaaccctccattgtgaccattatcatgaatcagatgaacatatatgacggggtctgtttctcaattctattccattccattgggctatttttccatccttgtatcaatacctgctgctttgttactgcataatttgatagcaaacctcaatacttggtagtatatgtcttccaacttaatttttttctccagactgtcttcgctcttcttggtcctgtataattccataaaaattttagagtcagcttgccagttttcgatacacacacacacacacacacacacacatccctactgggattttgattaggattgcattaatgtatagctcaatctcggtatttgatatctttataaaattgaatcttctgatccatgaatttttatatacttccatttacttaagtcctctttaattcgtttctctactattttgtagttttcgatgtagaggtcatttattttgttagatatatttttagttatttgatatttatgctgttgtaaattttatatttttatttttatgtattcattccttctatatagaaatgtaattttgtatattgatcttatattcagtgaacttcttaaacttattgattctaatagtttatctgtaatttcttttggaatatctttacacagaatttatgtcatctgcaaatattgaatcttaccttttctttctaaactttatgtcttttttctttttattgtcttgcactagataggaatatcagtacaatattgaataacagaaattattttcagtatgaaaaacaactaggcatctttgcttttttcccaaatccaggaagaaaacttttagcaattcactgttaagtgtatctgctgcattttataaagcacttattaccagattagataaattctcttatatgcttagtttgctaataatgcattttaagttataaatggatattaatttaagtgaagtttagttaatttaagaaaaatttgcctttttatactttttcagtcttcctgtcaataagtgtgtcttttattaaaatcttgttctcagtctttcagtggaatcctgtaattttcttaaaaaaggtactttttttttagttagaattgttctaaagaatgtaatggttccattataaagagggtattttttaacccatcacactttctaacaggttattaataggatataagagagatgttgatttttttcatttaaaatgcatctggtcattgtattccttattaatgtaagaagcatttacttgatgtctgttgatattctaggaatatgatagttgaaaaaagaaagattatttttcctcttccttttgaagaagtagaattcttgattctgtataatgtccatattagtcagggttctccaaataccaatttcctattgatatatgtatatattatggaaattggctcacacaattatagaggctgagaatttccatgatctgccacctgcaggctggggaatcagaaaagccaggggcataattcaaagtccaaagacctgagtaccaggggagccaatgatataagttctggtccgattccaaaggcctgatgtcccagagcagaaaaaaatcagacgccccagctcaagaagagagacggaattttcccttcctgtacctttttgttctattcaggccatcaatggattggatgatgcccacccacactggtggaggggtggtcttctttactcagtctacctattcaaatgctaatctcttctggaaacaaactcataaagatacccagaaataatgcttcattggctataaggcatccctttgcccagttaagttgacacaaaaaacttaatcctcaggacatactgcattggttttgaatttctgggtaaattctaaataaaattaaggaataaacattcttttattattattattatactttaagtttgggtatacatgtgcagaacatgcaggtttgttacacaggtatacacctgccatggtggtttgctgcacccatcaacccatcatctacattaagtatttcccctaatgctatccctctcctagccccccaccccccgacaggcttcagtgtgtgatgttcccctccctgtgcccatatgttctctttgttcaactcccacttatgagtgagaacatgcggtgtttggttttctgttcctgtgttagtttatttcgttgctgagtcttcaagaatgcctctagaatcttatcattatgaatggctttaattctttaagacaaattttcttcattagcaaatgagagcatttttctattactagttttcacagcaatttcttttcttttaaaaaagaacagatatcgaaggcttcatgcttttttcatattccatttatagtatcttaaggcttttatgattagacaaaataactagatttccttgtatatttaatatattctcattgtgacagtattttaattctattgaattgttgcttccactattttatttactcttttacatctgtatttataagtatagttagtctagttccttttaaacaaagtgtatactcttaataatgcattactacaataactaacatgttatgaattactatgtgtgcttaaaacaaaatacttagtgtttatctcagcaaagggcagaaaaaattaaaatgtattctgaaaacaaaatcaaatatgtttaagaattttttaaaattccattgcatacaaatattcaggcaaaggcaggggctttataaacatgtcaaagaatgaggtcaatatatttggttgtgatactcaataaacttccatttaccattctcagaacatatccatgtggaaattggtctcatggaaaaattttttaaatcattttccagccatagatatagtggcaaatgatttaatataatcaaacttcaatttcctcatctataaaccttttataacgatatcatctctaattgtctcactagataactataaaaataaataagataatgcatatgaaattgcctcataaaccatgaagcccataaagcactgtaggacactttgaatatctggtgttgaccataaaatttcaatatctgcccttattgcttgcctacaatcccagagagacaactggtgcaaaaagaattgaaatgctgaataacaagaaaaagacagtgtaccattgacataatatttgaaggttttgtatccagctaaatctctgtctctctcccctactattctttttgatatcaacatgtacattgatagtccacccaattccttggcctttcaatccttttcatttctcacttgcaataatcattttctctcatttgtcttaagaataattgcacacttgccaatgtcttaacttcaaacatcctgagctctgaccactaccctactttttcaagcctatttcttctcttacccacatcaacaattcttcaatcctacaatttcctgtgatactccaggatataagccctctcatattcatctattccttcattatctgtcttgcatttcattgccattaaaagcattgctttgaaaaattcttcacttctttgttcctttctcctgccattgtctgtgtccaaaaaagaaagttccaacctgctaaaatctaactcactgatacttctattgcaaaagtgctaaaagctaccagaatgctgaaagttagcttattgtcaattagactcattttaaatggttaacgataagcctcaagtgaatctcaggcagcatgctatactattagattgtcctcttcaatcctacctttcaagaacatgactaattcatgtatctttcctaaaaactgcaataccccctcttctcttaacttttatttgataaaatagttcttatctcacaaagaaaatagaaaagacaattggagaacttcacaaacttctatacaacttccaacaatctactgactcctttaatctttgtttcagcatttattgttgttagtatataagaccaacacccacttgtgcataagttcccatctccttcacctaataaaggacacacttggaacttgttttcctcacatacctacattttcaattttaccagagaataatccagtagatggctatcacattctatcttatgaaaagtcttctgagattctctaacaaatattttaaaaatcaactttcaccattctacagtaaaattcagtgaaactattatctgtatttgctgaatccacttgccttcctttcattcttttctgaacctactccaattaggctttcccctcactcttttatgaaaactgcttttgtcaagttaacccccatgttgtcaaatcaaaatgaccatttctccatctgatatggtttggctatgtccccacccaaatatcattttgaactgtagctcccacaatccccacatctcatgggagggactcagtgggagggaattgaatcatgagggtggttacctccaggccattcttgtgatagtgagttctcatgagacctgatggtttaataaggggcttcccctcactcctttgctctgcacttcttcgtcctactgccatgtgaagaaggatgtgtttatttctccttctgccatgattctaagtttcccgaggccctcccagccatactgaactgtgtgtcaattaaacctcttccatttataaattacctagtctcgagtatgtcttcattagcagtgtaagaaaggactaatacagtaaattggtactggtagagtgtggtactgctaataagataccagaaaatgtggaaacaactgtggaactgtggaactgggaacaggcagaggttggaagagtttggaagtctcggaagaagacaggacgatgtgggaaactttggagcttcctagagactttttgaatggttttgaccaaaatgctgacagtaatatcaacaatgaatccaggctgaggtagtctcagatggaaataagaaacttattatgaactggagcaaaggtgattcttgccacactctagtaaatagactggtggcattttgcccctgccttagagatctgtggaacttttgaccttgagagagatgatttatctggcagaagaatttcttttttttattttattttattattattatactttaagttttagggtacatgtgcacaatgtgcaggttagttacatacgtatacatgtgccatgctggggtgctgcacccattaactcatcatttagcattaggtatatctcccaatgctatccctcccccctccccccaccccacaacagtccccagagtgtgaggttccccttcctgtgtccatgtgttctcattgttcaattcctacctatgagtgaaaacatgcagtgtttggttttttgtccttgcgacagtttactgagaatgatgatttccaatttcatccatttccctacaaaggacatgaactcatcattttttatggctgcatggtattccatggtgtatatatgccacattttcttaatccagtctatcattgttggacatctgagttgcttccaagtctttgctattgtgaacagtgctgcaataaacacacgtgtgcatgtgtctttatagcaacatgatttatagtcctttgggtatatacccagtaatgggattactaggtcaaatggcatttctagttctagatccctgaggaatggccacactgatttccacaatggttgaactagtttacagtcccaccaacagtgtaaaagtgttcctatttctccacatcctctccagcacctgctgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgctcatgtccttcgcccactttttgatggggttgtttgttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggctttggttgccattgcttttagtgttttagacatgaagtccttgcccatgcctatgtcctgaatggtaatgcctaggttttcttctagggtttttatggttttaggtctaacgtttaagtctttaatccatcttgaattaatttgtgtataaggtgtaaggaagggatccagtttcagctttctatgtatggctagccagttttcccagcaccatttattaaatagggaatcctttccccattgcttgtttttctcaggtttgtcaaagatcagatagttgtagatatgcggcgttatttctgagggctctgttctcttccattgatctatatctctgttttggtaccagtaccatgcttctttggttactgtagccttgtagtatagtttgaagtcaggtagtgtgatgcctccagctttgttcttttggcttaggattgacttggcgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgaacagtggtttgtagttctccttgaagaggtccttcacgtcccttgtgagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacaatggggttttctagatatacaatcatgtcatctgcaagcagggacaatttgacttcctcttttcctaattgaatacactgtatttccttctcctgcctaattgctctggccagaacttccaacactatgttgaataggagtggtgagagagggcatccctgtcttgtccagttttcaaagggaatgcttccagtttttgcccattcagtatgatattggctgtgggtttgtcatagatagctcttattattttgaaatacctcccatcaatacctaatttattgagagttattagcatgaagggttgttgaattttgtcaaaggccttttctgcatctaagaaatttctaagcagcaaggcattcaagatgtgacttgggtgcccttaaaagcattcagtttcattcattcacaaagatatggtttggaattgaaacttatacttaaaatggaagcagagcataaaagtttgaaaaatttgcagctgacaatgcaatagaaagtgaaaacccattttctgaggagaaattcaagccagctgcagaagtttgcgtgagtaatgagaagccaaatgttcactgccacgacaatggggaaaatgtctcccgagcatgtcagaggtctttatggcacctcctcccatcacaggcctggaggcctgggtggaaaaatggtttcctgggcagagcccagggccctactgcttcgtgcagtctcgggacttggtgccctgagtcccagccatggctaatagggtccaatgtacagctcaggccattgcttcagagggtacaagccacaagctttggcagtttataaatggtgttcagcctgtgggtgcataaaagtcaagaattgtgatttggtaacctctgcctagatttcagaggatgtttggaaatgtctgatgtccaggcagaggtgtgctgcagggatggagccctcctagagaacctctgctaaggcagtatggaaggaaaatgtgggatgagagcctccacacagagtccccactggggcactgcctagtggagctgtgagaagagggccactgtcctccagaccccagaatggtagatccacctagagcttgcaccttgtatttggaaaagctgcagacactcaatgccagcccatgaaagcagccggaactggggtggtattctgcaaagccatagggacaaaactacccaagaccatgggaacccacctcttgcatcagcatgacctggatgtgaaacatgtagtcaaaggagatcattttggagctttaagatttgacagtcctactggatttcaaacttgcatggggcctctagccccttcattttggcgaatttctcccatttggaacaggtgtatttacccaatgccggtacccaatgtatctaggaagtaactaacttgcttttgattatgtaggcttataggcacaagggatttgccttgtctcacatgagactttggaccgtggacttttgaattaatgctgaaatgagttaagacattagtggactgttgggaaggcatagttagttttgaaatatgaggatatgagatttgtgaggggccagcttggaataatatgcttaggctttgtgtccccacccaaatcttatcttgaattatagctcccacagtccccatgtgtcttgggagggacccatttggaggtaatttaatcatgggggcaggtttttcccatctgttctcatggtagtgaatatgtctcatgagatctgatggttttataaaggacagttaccctgaacacactctcttgcctgtcacaaggtaagatgtgcctttgctcctccttcaccttccaccatgattgtgatgcctcccaagccatgtggaactatgaatccattaaacctgtttttctttataaattacccagtctcagatatttcttcatagcactatgaaaatggactaatgtatcatttttatattcgttttatattcattgttctctcagcaatatctcatacatttaattatctcagtttcagttgatgtcctaaaacaatttggaatgatttattttccacattccaaaatgaagtgctagatttccaactaaaaagtatttgcaaaggaggtatttgaaatacacacacacgtacacacattcatatatgtttgtgcatgtgtgtgtgtgtgtgtgtatatatatatatatttggagacagggtctcactctgtcacccagcctagagtgcagtggcaggatcttggctcactgcaacctctacctcccacgcttaagcaatcctctcacctcagcctcctgagtagctgggactacaagcataggccaccatgcctgcctaattgtttaattttttgtagagatgaggtttcaccatgttgcccaggctggtcttgaattcttgggctcaaataatctgcctgggatcccaaagagctgggattatgggcaagagccaccatgcccaacctacatgcatttttaatccttagctgaaaacctatgttcatcctgaaaagactttaaagagtcctagagataggccgtgagttgaatagggaattttcttgaaggaagctactgtgctgctatagctttttccttcctaggcttgcaggggagggttttcctgcctcatataagactggtatgtaagaaataacagcacatgaaatgtatcattcattcagcaaaatcaagtgggttttatccctgggatgtaaagatggtttcatgtacacaaatcaattaatgtgatacaccacacttatagaacaaaggataaaaattatatgatcacctcaatagatgcagaaaagacatttgacaaaattcaacatcctttcatgataaaaataattctcaacaaattaggtggaaagatcctcaacataacaaatgccatatataacaaaatcacagctaatgtcatacttcacagtgaaaagctgatagcttttcctctaagatgaggaacaagacaagggtgcctacttttgccatttctattcaacatagtattgggagttgtaaccaaagcaattatgcaagaataaaaagataaacgtcatcctaatcagaatgaaagaagtgaaatgactaatgtttacaaatgacatgattttacatacaggaaaatctaaaaactatgaaaaaaactgttagcataaacaaattcagtatagttgtaggatacaaaatcaatatataaaaatcggttgaatttctatacactaaataacaaactatccaattaagaaaaaaattctatgtgccatcacattaaaaaaataaaatacatagacaaaagtttaaggaggtggaagatctgtgtactgacaaccataagacattgatgaaaaaattgaagaaagacacaaaaaagttgaaagagagtccatgttcatgaattggaataattaatattgttaaaattctcatactatccaacatgatctacaaattcaatgtaatgcctatgaaaattaaaatgacttttaaaaaatagaaataggaaaaaataatcctaaaattgtacggaaccacagttaactccaaatagacaaagtaatcttgagaaagaagaacaaagttgaagacatcagactgcctgattagaaactacattacaaagctatagtaatcaaaacagcatggtgcaaataaaaacagacttatagaccaatggaacacaataaagagcttagaaataaagctacacatatgcagtcacctaatcttttacaagggttccaaaaatatgcaatggggaaaacatcatccaacaaatggtggtgggaaaactggatattcacatgaaaaataatgaaattgaagttttatcttatatcatacataaaaaataactcaaagtgaatgcattaaatgtatgacctgaaaccttaaaactctttgcataaaacacagggaaaagctcctttatgttggtcttggcaaagtttttttatacaacaccaaaaacaccagcaacaaaaataaaaataaacaaacgggactacatcaaattaaaaagcttctgcatcctgtaatcccagcaactcaggaggctgaggtgggaggacagcttaaggacaggagtctgagacaaaccaagttatgttgttttgaggctgggcaacatagcaatactcatctctaaaaatatgaaaataaaaagattagccaggcatagtggcatatgcctgtagttccagctaagaggctgaggtaggcgggttacttgagcccaggggttcgaggctatgcagtgagctatgattgtgccactgcactctagcctgggtaacagaaagagccatctctaaaaagtgcttctgtgcaggaaaggaaacagcaaataaaaatacaagttgtgaaaatagagaaagtatttgcaaaccatacatctaataatggattatgtccaaaatatgtaagaaagtcatataactcaatagcaaaagaaacccctgattttaaaatgggcaaaggacctgaatagacattttttcaaagaggatatacaaatgaccaataggtgtatgaaaagacactcaacaataataatcaccaaggaaatgcaaatcaaaacaacaatgacacattacctcacaactgttagattggctattatccaaaagaaaaaaataagaaatgttgacaaggatggggagaaaaggaaaacattgcacactgttcatagggatgtaaattgttatagccattatgaaaaacattatgaagattcctcaaaaaaataaaaaaaaaactgccatacaatctagcactttgggtatatatctaaaatgaatgaaatcagtatctcaaggagatatctgcacttccatattcattgcagcattattcacaatagcagagatatggaaataacctaagtatctgtcagcaggaaatgaattttaaaagtgagatatattcaattctttaatagattattattcagccttaaaaagaaaagaaattctaacatatggtacaacatggatgaacttggagaacattacgctaagtgaagtaaggcagacatagaaaaacaaatattgcattatcccacttatatgtggaatctaaaaaagttgaacttatagaagcagagactgaaatcttgcttgccaggagctggtgggtgggggaaatggggtaatgttggtcaaagcatacaaagtttcagttatataataaataagttctggagatttaatgtggcagcatggtgactgttttgtatactaaaaatttgttaagagagtagatcttaagtgttctcacctgacacacagacacaaagataactatgtgaggtgatgaatatgttaattatctttattgtggtaattatttccacagtgtatacatgtatgaaatcatcatgtcagatatcttcaatatatatactttttatttgtcaattatgtctcaataaagagactgagaaaaggagaagtaagagaaagaaagaaagaaagagagaaagaaagaaagaaagaaagaaagaaagaaagaaagaaagaaagaaagaaagaaaaaacgaaagagaaagaaagaaaagaggaaggaaagaagggaggaagggagggagtgatgaagggagggagaaaggaaggaaagaaggaaaggagggaaaaaaggaaagaaattttaaaaacttttctaccaagacaatttatttagagtattgtgttactttcctgtggctgttctaacaaattcacacaaactgggtggatagaagaaacaacagaagcttcttttgtttgttttcaagtctggagaccaaaagttcaaaatcaaggtgttggccatgcagttctctttccctcttctagcttctgatggctccaagcattccttggttggtggctgcataacttcaatctctgcttccatgtccacatggccttctcttctactctaaggacacctgtcattggattcaagtcccatttggctaattcaggatgatcacagagcaaaatcattaactttagatctgctaaggccccttttccatataagatcacatttacaagttccagaggttaggaagtaggactatctttttaggagacaccatttaacacacaacaattattaatctcatcccttgctttatcctttcttgcctaaattaattttcttttctttgttctgaatgccacatttactttttactttaatattctgattttaagtatgtatgcatattgtcttaaatccatcttgagcaaggtaaaacataaatatgagattattctttaaatatccaaagctggatcagagacattactggcgtgagataaggaaatcaacgatcacttctctggtcagtttccatttttttcctgtttatctatgattatttttctcataattagaataattaatacctaacagtaaataatctatttaattttcatggtttttgtatattacttagactcaaaattcagaataaaagcaatattttgcatactgtttattacattaaaaaatgatttctcttagaagctataaaattgtcttcaaagtagccaaatgatatgagcatgctaattgagaaatctagttatcattctcaaaattcatgctggtaatcactagaaagtatcagggctttgggataagttagacctagatttgaaaactaggtcgaacactaaatggctgtgctaatttttagtaagcttcttgccctctctactattggggttcctagttttcaccttatgaactaacaccaaaatatatttatgataaagaatatgaagaatcaatactgccctagatcaaagcagaaatgtatgatataatagccatttttataattaaatatgggtaaatctgttttcaaaagaggggtaggtggtaatgggctagatattttcacatatttctcagaagatgatctttagtctctacatcaatcatgatattaactttcttttgcttgaaattttgacaagcctcaactaccttagccttttatgctaaaaatctacactagtaaatatatgataatattctgttcttcacaagcaaatgaaatgatcctaatcttgtgttggtaaactgaattacttttaatgtaatggaagagagttgtgcattaagacatttttaaataaaattattgatacagaattcatgtatccacttaaagtacacaattcagaagtttttagtatattcacagagctttgcaaccataaatgtaatctaattttagaatattttattctccctgtacccattagcaatactctccatgagccttcccctagccctaggtaatcactaacctactatatgtctctgtgtatctgcctaaatctggacattttataaaaatagcctcatactatatgcaatcttgtgattgccttctttcatgtagcataatgttttcaaggtttatccatttcatagcatgtatcagtacttaatttcttttggttgccaaataatatttcatcatatagataaaccaccttgtgtttatccaccagtcagctgatgtttatttgggttgtttccagtttttgactattttaaataatggtactatgaacattaatgtacggatttttatgtggactttcaaactttatcgtggagatgacagagagatagacagacagacagacagacagacagacagatagatagatagaaccactgtgttatatagaaactatacttaacattttgaggaactgccaaattgtcttccaaagtagctctatcatattataatctcagcaatatacaaggttccaatttctccacacttttaaacacttgttgtctatctattttcatttatgacatgacccagagggaaaaaaatcaaccagaatgtgatggcaacccaaggtggaatgcagactgtgacgaatcaatctaaccgtattacaaataaattatataactagactgaagtgggtgaagaagaaaggaaatgacctgagtaactgaacaatggtgttttgggccaggctcagtggtgcacacctgtaattccagcactttgggaggcagaggcagacagatcacatgaggccatgagtttgagacctgcctggccaacatggtgaaactctctctctactaaaaatacagaaattagccgggtgtgggggcgcacgcctgtagtcccagctacctgggaggtgaagcacaagaattgtgctaacctgagaggcagaggttgaggtgaactgaaattgtgccactgcactccagtctggttgacagagtgagattctgtctcaataaataaataaataaataagtaagtaaataaaatggtgttttgactagctactgtaaggttaaagacaaaatcagttgtacacaaaaactataattggtaaatttgtttctcacagagctatgggttagatttgtaagctactgtatacatataccagggcttaacaaataaagatatatattgtatataaagggagccaaatttctcactgtgtgagaaagaaggtacaatcaagaaaacaggaaaagttagaatgacccttgtaatgttggttcaaagtcagaggtatcagtaaaacgcaagggctttcaacatatatttatgtgtacgtgtgtatatatataaaaatagatgcaaaaataaataaataggtgactgtgcccatggtttagtgcatatacatgttttctagctttgagagagcctagagacagtgacaccccagtagtaatgggcacacttagcatccagattttgatttctaaataccattctccagcatccttgtagaagacatcgatcccagggttgtagccgggaaaatacaagatgaacctggaacatcttggggtacaaaattaaaggaaataatttttacgaaaatgatggggcatgccaaaggtaaacaggagccatctcaaagagctctcaaaggtcaaagctaaaaaatttgagtgcaaaatatatgatgattagattggattataaaccaataaataaaataaatacttatgtgtccaaactgacataaatatttgaataaataaattgaagagaaaggaaagcttttcccttaaaggataattccaattagtgaacgaaaaaggaataagggaagtagaaaatcatcactagaacatcacagtaataattgctatagacaagatccagttatggatgacaaatttagtggatatgttttaagaagaaacacctatttgtacagttacaaaaatctcctccaaataaatatttatcaattaccaatgaaaaaatcataacttcataatggagaaatctggaaaaagctaccttaagcaaataagcaaggttcattcacatgtaataaaacatattactgcatattagtacataagacataagacatcatatccttgatatgatacaaagataagagtgtattatttgtgtgacaatcttcccaacagtatatacattcaatctaatcaagagaaaagtgaggggtacttcatgaagttaactgaccagtactattcaaattctcaagtttattaaatttgaagaaagcctgaggaactgtcacagattgaaaaaaaccaaggaagcatgacaacttaagataacgtgggatccagggttagatcttacgactcaaagaggatattaatggaaaaattgttgaaatctgaataaagttggtagttttcttagtatgttagtttatttgttttgatcattttacttaccatagttatatgcaatgttcatattagggaaagctgggagaaggacgaaggagagctttctgtgtcacttttataatgcttttgtaagtctaaaagtatctcaaatttaaaaattaggggaaaaacaaataatcaaacaactatattaagaaatgggcaaaggacttgaatagacaattcttcaaagaagattatgaatggctaataagcatataaaatgatgcacagcatcactgataagtaggaaaatgcaaatcataagtatgagacaccacctgatacccattaggatggctactactataaaaacggaaagcacatgttggtgagaatatggagatattggaatctctgtgccctgtttgtagtaatgtaaaatggtaacgttgctttggaaaacaatatggcagttcctcataaaattaaaaatagaattactatataacccagcaattccacttctggatatatgccacaaagtattgaaagcagggtcttgaggatatatttgtatgcccatgttgacagtagcattattcataagagataaaacctggaaacaacttaagtgtccactgacagatgaatggaaaaacaaaatgtggtataaacatactatggaatattattcagcctcaaaaaggaaactctgacatacacttcaacatgaatgaatctggaagacattatgctaagtgaaacaagcaagtcacaaaaaagacaaacatgattctgcttatataaggtacctagagtactcaaaatcacagacacaaagcagaatggtagatccagggtctggggggaagaggaattgagaagatattgtttaatgggtatagaatttcagttttgtaagatgcaaagagttatagagacaaatggtggtgctgattgcacaacaatatgaatatacttagtatcactgcactgtatacttaaaaatggttgagagtaaattttatcttctgtgtaactttactacagtttaaaaaatagaaaaaaattttaaaggggaaaaacatgaccatgggcaaatatctgtgagattacaagtgtgttcaggagtttaatctggtaaattctataaaggtttatgtgacagtctcatgattttggtttttaaacttttttgacagggtacccacactaagaaaaacatttatatcttatccaagatgtttatgtgtatacttattttagttacatatatatatgtatatgtataatttattttagttacatatataactatatttatttgttatataaatatataactaaatatatataatatatataattataaaataaaatccttccttcctttccttcaacttccttccttccttccttcatcatgatgcattaaagagattttatggtctattgaagggctgacaaaaaccacttatgcgtccctaaccaaaattgaaaaacaacatttatctggtctagagtatatataaacgtgttatctgttactcaagttttcatatttcctcaacacttataactagacttgagcatcagtcactacaatgtttatcacaggtactttatgtataactaaaataaaatttaataaaacatacccttagtattcactattctctccctccctccctccctccctcccttccttccttccttccttcatcatgatgcattgaagagattttatgatctattgaagggctgacaaaaaccactaatgcgtccctaaccaaaatttgaaaaacaacatttatctggtctagagtatatataaacttgttatctgttactcaaattttcatatttccaaaacacttataactagacttgagcagcagtcactacaatgtttatcacaggtattttatatataactaaaattaaatttcataaaacttacccttagtatttccctccctccctccctccctccctccctcccttcctcccctcctcccttccttcctttgctggtcatgatacattaaagagattttatgatctactgaagggctgacaaaaaccactaatgcatccctatccaaaatttgaaaaacaaaatttatctggtctagagtgtaaataaacatgttatctgttaatcaaatttctgtatttccaaaacccttataaccagacttgagcatcagtcactacaatgtttatcacaggtacttttggaaaagtgctttgcttcataataattaccctatcagaaggcctcaatttataaagcatttagttacttagtgcttatgacgtaaatgtcacagttcaagtacttgatggagaaaaatattaaatgaagtgcacttgttttgaagataatttcatttagcatctccaaagcaggggataattaagttactctgtcatacaaaatgatggaggctttaaataagtaacagctggttaccccaatgatggagcaactgcagggcagcctttggcaaggacagctgtgcaaactcagcccacgtggtacgcaaatagacctacattatgactaaggaaatagctgaaatggaatgacatctagaaaagcaaaaaaacaacaagactgggatcccttagcatgcatttcaatagcattaagatatagaaatattaataagaagtgctcatctatcatttctgtagtcaaatgtgtttctcacgtctagacgaatttaaagttagtcattgcagggcaatgagcacattcataagaaagtaccctcatttttaaatgtaactactacttaaattactttacttactactacttttacttactactactttactccaagcaagaaattaaattcaatttattcatattttaacattagtacagtgattttttttaaagttatgctaaatctttattccaaaagtttttgtttctttaaaacctcttccacggaaatcaaatttgtaacagtgaccttaaaatgtgagagctggccttcgtaaaacaaacgtgctattaaaaatattaaataactgaccccatttttggaaagctgggtaaggctgtgctagcatggatctatcgttaaacgttttttgtttttttttttgaaaactttttattgtcactcgatctgcatgtaaacaaggaggaaaaagtgagtctgacttatgtacttgattttgtttaccagaattttgcttaagtcatactatggacctttctgacttgaaatcattttcgagttggttatcagactaactctcctaactagtatttgtattaattatttttaagcaagcatttattatcattgattatgcaagcattattgagcaagcaaatgcaaatgcaataagcatttttaagcattaactatgtgttaagcacaaggtctctgtcctgaagaagcttactagccactagacaaaatggacacagaatcaagaaatgtcataataatatggggtaacacatgacccagatttggagttcagctaacagtttcccaagggaaatgagtgcaatcaaggtcttaatagacaaatcatacataggcagcaacaacaacaacaaaaaaaaagggggtggggggcatgaaaggctttccaggggaggaaaatagcacaagctaaggcatgagggcactaaatagcacagtggggtgtgtcctcgatccccataagtaattgcaatatgtgaaatgatgagtggtgtctggggatgaaagctagaggatcttcataggggcctttatggaagtgttaaggaatgctaaagagcttggcctttgaagggatttaaagaagaattaaaatcagacctctctattatagtatagacactgggtacaagggagacaaaactgaagactaaaaaatcttcagtggttgcccctctgccaaattagcagttgttaaccttttcggcctgagaactaaaactacagtcctaagctcctggaccctcccttggccaaagggaccccagagaaaccttaaagaactgagttcctggccaagacagaatggggacatgcctcattatactccctcctttttgcagtttaaacacaattgaccagcattaatgataaactagagatgataaccaacagagcgaactcttttcatggcaataagataacaaattataaacatgacctaaggccatgcaaggcaagcattaagtcacgtacctctacacttgaagaataaactctattataactgccacaaggttttcctttttctagtaggtaaacaagccctggcctctagataagcaatataattgcagctcattcatcagacactgaccagttgaaccccccgtccaacaaaccatagctacatagctctgattgactaagagactaatttcagtaactttctcgtggtaagagaccaccaaccactgggctcagtctggcctgctctcagaggctgcacatttgaatgccttcatgctcctgcctcaccttttgacatataagacctaattgtaatgcatttaaatgtcgtttccactccaaaatgaacatgggacacatgtaacatacatgtttgttcagtatgcatgtgtcaggactccctttgtgaatatccataagacctcctcaaacctgttgaatatgtttacttggccaaccttgtcagcatatatccctgttccactctcccctccctcaaagtgccttctggtttcgcctgaaggttacacttcccagcctgtcagaatcaccatcttgaaggctggaaccattcgtaagctacatatatagatctcacaatttttaaaaatcttgatagggctcatgacccctttaaaatcttacaaaatatcgaggatacctcagtgctttgttttttgtggattacgtctgttgatatttaccatatttgaaattaaaactgagaaatatttaaacaattatgtatttatttataataacaaaggtaagcccattatatgtttaacaaggaatacattttatgaaaattacaactcaatgctggttatgactcaataaagagatcttgtgatttactgaagggcttacaaagattactaatgtgtccctatgcaaaactggaaaaacaaaatttgactagtccagagtacagataaccacaatgtgttagctgttaatcaaatgttcatatttccaaaacacttataaccagacttgagcatcagtcaccacaaattttatcagaggtactacagactagtgctctgtttcaacagtaattaccatatcaatttatcaacctcaaattataaagcattttaagttacttagtgtgcatacttagtgttcttttcaaagcaaagtgttattgaggagtggcttctttttttacatttttgcaaatatctttagttagtggcttaatagaagacaactaaattctcatattttcttctagatttaatctataagttgttttggtaaaggtttataatgaaaaccccgcttcagacacgcaatatggttgaaaaattgagacgtattttaatttttctaagagatggggtctgcaatgttgtctaggctagattcaaactcctgggctcaagcggtccctgttctcaacctcccaagtagcagggactacaggcatgtgccaccacacgagacggaagtaatattttaataactttttctgataattatagatttatttattttgatactaccctattacttgactggggtagtttctggaaggttaatggcagtgtagaagccaaaacaatgtcaatgacctttccctatactattatattaaaatccattggtcaattttgcactttaaatggatctttcatctatgcatctacttttttcatgatgatttcctaatatcatacatttctcatttggtaaacattcgtacactgagctgacagattttactatagaatataaaaaatacacttgttaatatcgtcaccaatctcaccaaaaaaagtatttaagaacggaaatgctatcaagctcatggtgatggaatacattttccaaaattctactttttgcttgaaagctcacattttatcattggcaacaaatactgtcagtttgtttctttgaagtgacaagcttactccactcattttcaaggaaatatccaccatatgtccaagtttgaataaacataattatctgtcagtcattccttcaactaaaaatggcattccatgaaaaaagcaactagatcagctttcaacctaacctcataagagcttttccttgaagcaaccatcatactttaaggattagaagttcttctttctcatcatgtagaaacctggtaaactgagatttaataaacttcataattttccttgctttatcaatagcattcagctgtaactggacagaaaaaaaaacaaaaaacaggaagttcatggtagcgaagaacagaatgactaataactgttttggtggtagtgccaacattcatattaacacactagcaattctgcccaccagtacttttgtgccagcagtgtagatgtcaactcagtgaaaaagacaaatgatggtttagtattatgatgaaaatagggttcatcgttcttcacagtccctgaaaatgtctttgggtatcctggatgtgttcaggtcacactcaggaaaatgttatgctaaaagcctcaagtctaaattcttatacctaacatccatccacaatcttgttccactctattgataaccttgagtaaaacagattttttcacttttgtaaaacacacctttttcccctctcatcttctaatttcacattcttcccaatatttacaatatataaatcattcaatcttccaggagccagtccaattcatcgccattccagatctctgaactattttctatactattggatatgtactcacttatatactatttatgatttttctttgggaattagaattatcttccaaactagattgtcagacttccagaggtgaagatttttagttcttctgactttgctatagtattctgcacagttatgcatatgataatgatgataatatcttgaattttataaatcttaattttttagtgtaggtcacaaatacacatgtgcccctattgtatttgtagggaaaacatttaatattataaattatgttatcatgtcttctactttgggtaactaatatatatcaaatatatacttaatatattatagaatatcaatttataaagcagtgtataatttcaagcatacaaatatgacaatgcagccgtatatagtggaaaaaacctaggctaggaaatagaagatctaaatttaactgtccacatagtatagacttaaagaagcacatggatttagagaagccacaaaacatatttgagtcccaatgtctgcaacagtgaaatgcttatccccgttctgatatttaaatgacgtattttatgagaaagtttttttttgaaacaatgtagtaatcaaatgcaatcttttggcatagctattaccctgagtcctgcacattaactgcaaatcaatatcagctattaacataactacatgcacagcatgacaattaaaagaactaaagacacacaatggagacatctttgagaattaaatccaagtaccttgaggtatgcagtacttgtcatagaggatgatttgaatattggcaaagtactatgtgtgcacagatttcatatataatccacataaagcaaagacgccttattacccggtattagtagtctaaatctgaaaggtgtaaagaaaaacaagactttgaagacgtattacagatttatacaggataccacaaagaaagatcttgtaaaaaatctttagacttttctttttccctttaaggttttaccctcatccacagcaaccttaatttctctgaaagttatgtgtcataattacttttatgtgttaacttaactagacttaagggatgcccagatagctggtaaaacattatttcttggtgtgtgagtgagtgtgtttcctgaagagatgagcatgcaaagcagtagacagaataaagaagatctgtcttcaccaacttaggtggacagcatccaatccagtgagggcccaaatagaaccaagacgcaaaggaagaacaaattcctccccctcccccaccagagccaagacatcagagtttctggttcttgggcctttgaactctgagaccagttactcccaacccccctgtagttttcaggccttcagcctccaactgggagtgacaccattgcccactggctttcctggttctcaagcttgcagagagcagatggtgagacttctcagtttccataactgcatatgcaaattcccatactaaatctcctcttacatatctatatctgcggcctactggttctgtttctgtggagaattctggctaatacattacccttaccaacatttgggtcttgtttatttcatctttctcctcttatccaagttctctaatatgaccacctcttcatttcagacaagcccttggtaagggcacattccctgcatgctgacaactgctgttctcttaaaaatggtagcatattctgctgaataaagccttccatcttgtttataaaatcttgaagccttaacagtggaaagactagccttagagagctttggcaatcaataatcacagcatcttgacaaaaaagggtattaataagcatgtgtcatttcttttaaaattaggttagaagaaatagatccttagagaacaagaactatgccaatggacaaacgttctagcctcctattattcagatggatatatagaggaggtggtctccatgtttcagaggtcttaggagagtggaggccccatggactctagacacacccttacacacctctgctgcctcccctgtttcagtcacaatgtttcctcacagattcttcctcccaaataaactgcctgcatgcatgtctatgtctcagacttctgctttcaggaaaactcagacaatcaccgtcttttatgcagcttacactacattgtagacttttcatataggtgatctctaattctagaataatcctagtagcctcccattttaaaaattggaaaaggtaatttaaagaggttaagtaatatgtccaaggcatagtaaattctttacagaatcctgaatgtgagtattattttcgaaccattcaactccaaacttatactctttctccttttatggtaattttgtcaataatagccaaaatgaattgaaaaccttctatatgatgtaccattggaaagaatgtttcaagtgatcagtgaagtttgttgaatctataattaccctatccaccatgatgtctgaggttgaatgtttccaaccaaactggcttatcttgaaatttcaaaaataagcactgttctacaaccgttactagcatcttatggctttcatgaagttatatactatttcacagaaacatgattttcctctccatagaccctagacaattttctcaatgtagcccatcttcttttattttaatgaaacttaatccaggactattacaaatgttcaaaaacaaaagcgttttaaaatagtgtgtctattatcttcattttacagggaactacaatgaaatggatattgtttttgtcatttacattttcataaaaactttatgtgctttttcaaagaacttcagtttaagaaaaagattattcacaaatttacagtgcttgcattttataagtatgcaaatgtaaatgtacagaacttaacaaattttacaaattttcataccgttagaagtaatggggcctcatacaaacaacaatgaatgggaaacaaagaccatgtgaattctcctgattcttttcttatagcttctgtgaacctttagccaatttattttatctttcttagccacaggtgtcatgtttgtaaaaccatgttaacaataggaaaggctgttgaaagaataaatgagataatatttggaaataactttagcaatataagaaaataatgaatctgtggatgtggaaaggatctcactgtttcctgtctagccttcaataaatttcagaatattttaatcattcatacagatcatatatatttccacaagacctgtttcctcatttatttgtttgaatcagtatctaaataggaaagtggacttcagagaagaataataaaaaagccatcccttctttcattgcatagtatcaattatgctcaattcccacaagccttaaaaattcaatgattacataattaacatttctgaataacttttatttttctttgaggcagggtctcagtctgtcacctaggctggagtacggtggtgcgatctcagcttactgcaacctcctgggctcaaatgatcctcctgctttagcctcccaagtagctgggactataggcatgcaccaccatgcctggataatttttgtatcttttttagagacggggtttcgccacgttgcccaggctggtctcaaactcctggactcaagtgattcacctgcctcagcctcacaaattgctgggattacaggtgtgagccactgcacctggcctataaggaactgtttatgtgctaggaactgtactaagatttttacattatcttaatttaatcccaacacaatcaatgagtacagtgttattattcacactatatacatgaagaactttaagatagaaaggaaattactgacttacacaagggcatggtcacagggtgattgttaaagctggcctccatctcaggttttctgtctctgaaactttgttcctactaattcacctcaagccagttctttattaatatagttgggtcacagtaactatctggtaacatttaactaaatagaattgttttcataagaattaagattcaacccatattttgaacttaggtatttttattattttggaatcactgagttaacagataaagatgtaaatagctttatagataggtattccttatatatagatttcaaaattaagtaattctgtcagatggacctcttttccttggcagaggtgatagacaatcaaaatggtaacataagcagaaatcacaagtcgacacatgatatatgcatttgaatattgcctggaaagcctctccaagtccattaaattatttttcctagggtgaatgtaaaacatatcagtatgggcaccagcacatgtgcgaagggaagaaagcattgggaaagtttgtttgtgtattgattttgttggataaagttgagaatttttgtttgttgagctttgttttgttgagctttgtttgtttttattagagaacagagtggataaaacattttcatctagtaaaactgctccactatggaatcccctttccctttttatggttaataatcttaattgatcttaatctattcaaagtggaaaatagagggtagaaagcatccagctttaagaaagcagggctatgttacaaaatgcaacagcaggactaacagcaggagagactggggtcactgtccagatacagagcacagagtatctcacatgtggtgagagagggcagagttagagcgaagaagcagagcagaggacagtgaccatgaggcttaggcggttctggctcgaagaaattgagtgaagtttctctcagacagagaagagagtagcatgtaccaaaagattaatagggatgtgctaatggagcaatgatcatctttcccggaagaacagattttaacacaagatgggactgagctgttgaaaattctatggcaaccactatgtgagaagaaaatgagtagctgtatgcaatagcacaggtctacagctgcgctacctttgactaacgcagcctccctaagtagaacatgtgaagctttgctccatcagtgactagctctgtgaccttgacagagtccctgacctctatcagggtgctttttcattttctaagttggaataataatggctaccctagagttttcaactaccaactctatatgcagttctccctaatctgtcttttacccagacatctatatggttccctctggaagggggagtaatttatctgatcagtaagattagacaaaggcactaggaatgcgtaactcagccctgccaagtttatgtttttgggatcagctggctgtagaaggctgtcatgaggagcagcttccctggcatgactggcaggggaagtcacagctctgcggagctgcttcctctctctgataatgagtctcaagaatcacactcatggccactggggaagcatggggtattaggaagccagagttcagctctctaatccaagctctactttccatcacatatttaccagtaatgaagatgaccattttctcattcatttatacctccatattaattgtgcaattggtttagagtctgtagggagacagcagcatgactgtaattctcacacactaacaactcttctgatgcaagtagtgtaaattgtcaccattttttaaagttgcaatatcaccattagctcaaatagatgcacacactacttactattatgtaaacaaaacatcatttcaaacaatcttagagaatgtctgcaaaccacacgcaggttgtcagtcatacacttaattctaatgattttcaggtagctttaggagccctatcatctatgacatgataaagacatccaaaaattcaagtcttgatgttaatcatttatatttttatctctttaaataaacaaaaacagtaaaatatgagcccagagaagaagcatagtaactgattgcaagcacttagaaaatgcttgaggaagacaggtaaatctttgacactctacttattttctttttatttcaaagagctcctagtacatttctgcatacattacacacacacacaaagacagaaagtaacaaaacacttcaagtcttcaaaaatagaattgtacatttgaatgccatagccactgccactgttaaaaatgcagaatttcaaattgcacttttcttgaaaatacattgatactctgctggcttagtttactaaaatcacaaaatacaacgcctaagagtgtacaaaatacattccctttgaagaaaactgaacattggaaaatactatatacttggttaaaatagatgactgctcgtgaatatgttcaattaagttcaaagcaaaataatttcctaagatctcttattaatggactttataataccaaaaacattaaattaaaaatcaattaaacaaataaaatgcaacccttacatattaaataactgtttaatctttcaagtggatatgacctattaataatagaagcatttgcaaactgtgcaacagttctggtacagagccaggtccaaggctaagaggtcaggaaaaaaataagaatatgacagtcccatggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgaggtaagtagactaaaatccattaattgggggatgctactgagaagactgcaatgatgacagtacagcaatcagaaaagatgtgacacatccagaaggatctcaaggccttttatcatttttattctaattttgatattgagctgaacttggagtagaaaccaactacccaggaacttaaatgtagaattctaattgggatttccagtttgggtaagggagtatatgaatacacagtgcctgctgagtaacaagttttaaattattatttttcatctggtcctcatcattaggggtatcaaaagttttgtttgtaaagacagcaactatctggttaaattcttatactgagaacgaatgtgtaaagatcagctcagcctactcatgtgacaattgttaatgaatccattaactcatatctttctgcttcttaagcacatatttaaatatgcataaatgtgtgtgtgtttgggtaatgagaaaaatttgttggcaaggtggctaacgaaaatatccaatctcactaggcatacgtgcatgctgataaaattgtttgcacagtaactgttggtagattcaaacaactacttcagagtagaagctcaaagccaaatacttcaaaactgaagggactgaattcagtggtcttctaactggattccacagggctccagagtcctgagctacttgatgaatgttagggtgggggtagtaaataggactctgactctctgagctctgtttcttctattttacacttagagtttcagagagattttattttggaaataatttttgctactaaaaacaaaaggaatgcagaaaggaaaggacagagagaaagggaggaaggaaggaagaaagggagacagtgtggaaggaaggatggatatacggaagaaaggaaggaggtaggagggaaggaaagaaggaaagggaagaaacgaaagagaatctgcagattttatagattagataaatgaggtctacataccttaagtgacatttcacacattcctgacacaggtagaactaaaactcagtcttccttattcttctatgacaagaagtattgatggctccatttgtgcttttagaagagaagttctcagatttttttgagccaaaggtttcaatagttccactactgtgaaaccaagacacatctgtcacttgcacttagatgctaacagacttttctgaacgaggaaatgttcactggaaccatgttttttgccatcgttttttactagaatatctaatttgtcaacctctccctttgaaggtaaaatcatccagaggtcagttgcacttaaactatgattatcactcaataactcggtggctttggacaagttcttccctgtctaatcagttgcagaactagtaggatggttgtaggagaaattggggtgatgtagttaaatcacttgagtgtttctcaattgatttctcacattgttcctcacaaaaaagcctttttagacattattttcctaatctcccccccacaggtgaaatttaaacagcatacatgcactgtatacctctttatgtactgaatgcatatctgtgctttattcataataagagaatgagttttggattttttttttttttttgctgctgctgtgcaaataaccaattttaatccctttgggggcaataatgttatcattgagaaggtatgaaataggctaatatttaataccatacacaaatagcaagggttgggcatagtgattatgagccaatttcagcgtgtggatagaatgcagagtaccagagagccaacatccctccaaaataaaagatgcagcagattacagaaagatgatgggggcacacatgagaaatactactaattattacagtaatgtgtactgtactatgctttcaactttacatttgccaattcattaattttcttaaaagccttaaaaactatttaaatatgaggaaacttgggagcaacaacagtggatggagggccatccttcaaacctgggtatgtctgtctccaaaattcagggtattttcattagcactctgacatctaacttggcattttaagctgcaactgcctgaagttactaatttctaaagagggattcactggctattcttgtcaaatgactggctgtgtatgtagatatattcgaaataatattagatggtcccagttggaactgccctgcctggacattctccttggcctgttgatgtccttgccccatttctgtcattataacaacccaataattggtttaacctcttaaaattattctagatggaatggtttttatcccctatgaatacattacaatctttctgtaaatggtaaatgtaaaacttaagggctgcattgcaacgttgggttaaacccgtatgtactgatgtataaatgtgagtcttaaatgataggcagtagtaacctatgatgctgagagtgccctattataaaacggagggagaaatgggcatcagtagatcagccatgaaagacaagcattaaagggcatttgtcagtagagtgtaggtggggacctcttgcttcttgaatggaacataaagtgcaagggaataattggagtgcaacagaaatacatttttagatgagggctagaaaatcaagcctaagacaaagaaatcccttgaccctgaaatatctcctagagaagaaaaggatggattctggaaacttaaggaactcagacacaagtctccaagggttagataatttcatgatgagaggtggggtctgaagccataaaaattcttggaaattaccaaaagacataggagagctgtgtatacggagggacagctttgcatattgaagctgcaagtactttaagaaactcaattgttctgatgtatatttgtacctagaaaactgtttcttataaagaaaggaaaaaagaaacatcttgactgctcatgcatgataaactgtgtgggatcaagtaaaggaagatagtattaagggccaaagagaggcataagctctttctcaggaccataaaagcaagggtattagcctttgacccatgaccattagtgggggcctcagaagattctgctttctgcaagagtacctggtttccagggtaccattttaatagaccatagcatgggaagccccttgctggcataccatcatagacaactgaaaacggctctacagaaaacactcactcacacaggaggcagtaagtctccagaaaagtggggggacatgtactgttggctgtctctattgcttttgtctgattaatgagctggcagttgatggtaaatattttatagcataatttacttcttcactttttccaccttacttctgccctgtgctttaccaatatattcaagcttcattggcagtacctgtaaaagacaagctctaatggacataatgtagctaatgtgtcaaattaggactttcattatgtgaaatttgattatgggtcataaattacgtatttatcttgcattaactgatgaaggtaacttgttaattagatgaaatcaaagttattgacctatagtgaatctcttctacatttattgttggcataaaataaaatatcatgacaagaatacaaatgcatatttattttgttactagatatgtaacattttttaaaaattcctgggagaacagatgtgaaatttgggagaatctatgagagatttactcagaattcatatttattatcttttccgtttatgaagttgttgtctctcaacaaacctctccaaatttgaatctctccaaatccactcttctatatactctgtttgtggtgctgggggaagagtgtctgcaaactacatttttttttttattttcttaaggttctattttatttttaattaacaaaccacaatgagatgtcaccttctacctgttagattagctattatcaaaagatgaaagagcttaaatgttggcaaggatgtgtagaaaaggaaacccttctatactcactgttggtgatattgtaaattagtaaaaccattttggaaaatagtatagaggttcctccaaaaaaaaaaaaactagaattatcgtatgatccaacaatcttactactaggtatagacccaaagaaaatgacatcggtatgatgaagggatgtctgcactcccgtgttcattaaagcattattcacaatagtcaacctaagtgttgtttccatttgagtatttctacacagtgaaatactattcggcctttaaaaaaaagggaatgtctgttatttgtgacaacatggatgagctgggagatatgttaagttaaatgagccaggcacagagagaaaaatatcatctgatctcacttatgcgtggaatttaaaaacgtcatagaagacaatctaaagaactcatagaagtagagagtagaatggtggttaccagaggctggggggaggtgggtggatggggaaaaaggaaatgttggtcaattagattggagacataagttctagtgatttactgcacagcaaggtaattatagttaataacactgtattctatatatacaattactttgttaattaaaaataaaactaaaaacaacaattgtatatatttatggggcgtgatgttttgatatgtgcgtatatacatatatacgtagaaagatcaaatcaggctaattaacatatttatcacctcaagtacttatgatttctttatgatgaagacatttaaagtccactctttcagccattttgaaatgtacaatacattcttattaactatagtcaccttgctgtacaatagaacaccagaacctagtcctcctgtcttactgaaattttgtgccctttcatcaacatttccccttttcctgtcctctctcccctgccccctcaacctctggtaaccaccattctactctctatataaattccacttttgtaagttccatctgcaggtttcttcttgttagttggatttctgctttgttcttcgaatagaaggtgctagagggagatggaagacaggaggagagaagggatttttcccttccagagtcccagcaacaacccttaacccaacagcaacttttgcttctggtcttcaattcctgtcatcctcctaaagggtttcatgtacctccccataagaactggcacagttggcagcattcttcctcagaggactaagctctacctctggtacttagaggaaagatcagagatcagaacaatatgtttggaaaagaacagtaggaaggaaaacaatgcatgaaaaatattcagttaaaatattcagtaagtttaatatgtaaaaaatactcagcacggtgtttggcatgtagtaataaatgtgaataagtgtgaccaattattatacagcagaggctcagcttctgttagtcatctatagaggttttccttacatagcttttaatgcattatgatatacattaggaggtaatgtatcaaccaaaagggggtttgactttttaattgaataatgtcaaattaacatagtatgaatgtttgcttattttgtagaccattaagctatttgctatttgttatgctctcccttagtctttgtttatcaaatcacatgtttattttttctgaccctttataaactattttagaacagtcctttattcttataattttttagtgctttctaaaatgctgcttacatacaataataaatgtacttatttgaattatggtaagacttcatactcatatcatgtattttatgagtgtatttccaaaacttctgcatgaattacttacgttttacagcagaactagttacaaaagtaaatgctaatacttccattctacagatttttaaaaattaagtacagaagtggaaaatgattttttaaaaggcaaaggatagtcaaaggagcagggcttcattatggaggcacattgaacattggctacccaaaaatcaacttttcagttgattttttcaaccatcacattttctgaattttcaaacaaaaaatagttggaaggggaaacaaatgtgttcatcacatatcagactactcatatgatcccagctgagaagaaccaagactccaaaagatacctgcactgagactggttaaccatgtgaagccttagaagcactggcaaagtggcagtcagtgaagaagaaagaggaaaagacaatagaagaaaagggagaaggctgacaggtcagcaacagtggcagagataatatttcttagaaacaacagtgagtaaacaacattaaataagagcaaatacttgtcattggggatttgggaaaactttgaatcaggccggacaagttctagagacttagctaactcttcaagagatccaaatctcaagtcagagagcaggttcaggcagggtggcagttggtgtctgacagtataactatcaatgaaggctgctacaagaagggagaatgagtgtcaatggggtccaggaagagtcggggcaggtctgggcaggccaactgtcagcagtacagattttaatcagccagaaggacctgggtgtagtggcagggtgcctattacagaaatgatcaatgcctggtagatacaggtgctcatagaatgtttgcagggcttgataacttgatatgatttacttttttagagcaaaaaccagcagcaaggttggattgattacagttaccatatgacctgttgggattagatataaacttttggtcctaatggagaagaacctgtcattataaggctaagtgaggttgtctttaaatgtttgggatgcaaaggctagaaatgttcattctaagaatgaaacataaaaaagaaaaaaagacttgtaatttagtgatcacttgagaatggaagaaaatgacaaacagctacctgtcctttaatgttacaccatctctacagtgacaagctaagtacccacatatatggtggcatgtttgagaggtatgcaagggcagcacaatcaaaacaaatgtagtttagaagcctccctctaagatctgtttacaggaggaggggagaaagaagtttccaaatctacctgcttaaagtgttacagatagatccgattgcttagttctccctctaatccacaaaagtgtctgctatatacaaaaatatactaattttagagaaaaatatgaatatttgcatttgacttcaaaagaaagtttgctaaaatatttacagaagaggaaaacattggtttatgtactgagattgtttcagtaaaactctgcagatacctggtgttttaaaacaattatatagtacaaactagagcttctggttcttattccttatgatttattcttggtaaatgacttgagaatgcttttaattccaccttaatggttatttaaaacattttaaaaattagaggcataaaaatgctgctgactggatgtgtactttataatacataatttggggtgtccaatatggactcagagttaaaagagtagacataattattaaacatgatccacagacataggttgaagggacctttctgtttctatgggaacagtcctgtgctccatattccagctggttccagtggtgctgttaagcaaagactcttcctggatgtcagcacaggaatgatcatgagtctcaagcctttcatgaggacctcattcctatggcaagtgggattggttcactgctagggaatgagactcaaacaagatcaaccaaagtgatttccaggaatggagacagtatttatcttcctactagagtcactgaaacaggaggaaatgatctgggattgctagccttcatcttctcctgtcatcaagcagcagcatatctggatctgggggaatgaggctcacatgattaaaataaaataaaataaaaagcaaaagtacagcaaagagagggacaagatggagaaggcagtcatgccagagtacacaaatataagatgaatatgagttgtatctctggaaaagcctgatcagacatgagactgtttctgtaactaattagactagtatttctttcataaaccaaactttcgaaagcagaagatccaaattacttatattttatgaggattagtttgggattatcaaatattgacatgagcacaggactagaaggctaggaaaatctggcaagcctttttttcattgttgttagcaattgtttcattgttgttagcaaatctgttgttagcagatattgtggtactttattcataaatctggcatatttacaaaaaaaggtttaaaatcttttagcttaatgtgtacttcagaaatatgcattatatagtaaaattttaaaatagtctgtacattaaaaaattcttataaagttaacatccatgacagagatagttgccactcaccaaatagcagtgtgtattaggccctccttccccaggtctcatgtagacaggggagttgtgtagctaggtcacaccagtgacatctgagcagaagtggcatctatcacttacgggctgaggcattcaagagccactgtttgattctctagctctctgctttcaccttccagatggaagcatttctcattgcccattgatcacatgaaggatgtggctctggaaggtctcctaattcaccgcagtctttgcatgaattaaaacaaacaaaaaataacttctgttcttacgagccactgagaattaggggttgttctgttaccccttcactaacagtctatcttcactaatattttcctttttattgcccatctcatttttctcatggagtttggtttgataatatctgggtgagacactttcaaaagccattttggaaatgtacacgtgatttacagacactctattttcacagaatcatatgtctttataattatcaaatgttttataatgactgactagtcaagatgtgcatattacattttaacaagatacagccccttattaaatgtaaaagaaaacattttaaaattcactattagtttcctattctcatattaattcagtgtttcatctgttattataagtcaaaatgtccttccttgaaaacatggactttttctactgatttatttatttcctattttctacatttatggtgataatgtgtatgtatggtgccagtgtactgatgactttgctgatgacttttaattttttatgtatcaatagacatataaaatgagaacttaaaacctatctactgggtactatgcctattacctgagtggtgaaataatctgtctaccaaacccccatgacacacaatttacctatataacaaacctgcacatgtgcccctgaacccaaaataaaagtttttaaaaattacatctttaatcaatcaatgcaccagttatttttcaatttttctgctaaaatcacatatgctggtgataaaaataaatgaatatatgacattaattgattgcccctgaatattttttccagtaacatatttaccagtgtttacacaggataatcatgattgggtgccccaaattttacaacagtgctctggaaaagagcttcttgcccactaatttccaaataactaaatttttattactaactataatacaaaatatcaaaatcacaagttaacaagcatgaataactggtagtggagccaagttatagaggtttttcattccaagaaggaaaaatggagggcttcaattgcacagttggagtcattcttcagtttcaagtgttcaaagtggaatagtgaacagaagaagcaattcttgtcaccaattaggctacatattgacggatgcaagcaaaccttcactaggactaaaatggatttggtgtataagcagacttatagacatataaaaaccacaacagttctgcgttccttcttgcaacacccaaatttactttagtgtcttaattctgtaggcttataataaatctaaccactaattaacatgaacactaattagaatggccccaagttaataccttaagtatcttctcgaatagacagactttagctctttccatggatttcttacagaatgtataaattcataagtgttttgcccccatttacacatccccaatctaaaaatggtccttactcaatgaaggctaattcagacaagtggtggccagagaactcctcagaatctaggacaagaactgaggttccccaaactaaatggagcaagaaaggagcaattgctctgcaaactacttttacctgtacatagttgaaggtaaataaagtcctaacaaggaaaattgaggtaaacaaaccttaggtccagtctgccctttctagatgtctcctgccccgctttatataatttttagaagttttaatctgctttttaagaacagcttgttgaagtataattgtcaaataaaaactgcatatattcaaggtgtaaaacttgacatcttgatatagatatacgttttgaaatgatcaccgcaatttagctaattaacatatccatcacctaacatatttaatattttctcttttttattcctgtggtgagaacacttaagatctacgctcttagaaaatttcaagtatataataggtgttgctaactatattcaccatgctgtacattaggggtcaagaacttatcttgcataactgaaacttcgcatcttttgccctgtctccccattcctctcctcctcctagcccctgtcaaccaccatgctactctctgcttctttcagtctgactattttctattccacatataagtgagatcatacagtatttgtctttctgtgtctggcttatttcacttagcatagtatcctccaggttcatctaacattgttgcaaatggcaggcttttcttcttttttaaggctggataaaattccactgcgtatatgtgtatacacacgtatgattgtgtgtgtgtgtgtagacatacgtgtatctacacacacacacatatatatgtcacattttgtttatccactcatccatcagtgagcatttaggttttccctacatgactttatgatgcttctttcaaatgtactccctacaaaactcttaccttcacgatgtggacattagatctactgcctattctgactgcaaacttccagaagggactattctttcccagaaaaccccttcccacctctgaaaattatactcatcatttaagcctcaataatttattcaataaacatttcctccccagcaccttgagaggcccaggcgggcagatcacttgaggtcaggagtttgagaccagtctggccaacatggtaaaaccctttccccactaaaaatacaataatagccaggcatggtggtgcgcacctgtaaccccagctacttgagaggctgaagcacgagaatcacttgagcccaggaaacaaaggttgccgagagctgagatcacaccagtgcactctagcctgggcaacagagtaagactctgtctcaaaagaaaaaaaaaagaaaaagaaaaaaagaaacatttcttcaacctctctctgtgcttcctctgctaggcaacaggatatgtatgtaactgaaaggcaactcttcccttcaaggaaataacaatctaggggtgaagacacagatgcaaactgatatgtaaaataaaatgcagtaaattacataggcagggcatacaaaatatgtcacagatatgcaaggagagggcatatctaaagaggctctcaatgaagccttccaaatcacctacagccaaataagtggtcctcctacttttactttccgcaagtaattttctcgtggcaatatgctttcttgtggcaatctaaagaggctctcaatgaagccttccaaatcacctacagccaaataagtggtcctcctacttttactttccgcaagtaattttcttgtggcaatatgctttctgataaagaaatgatgtcagaagccagacagcatgtcttcaaatcccagctctgtcactcacctatctttgtgacctcaggcaaatcacctcctttctggagatgtcaatttatctatctcatttataaaattgaataaaaatagcacgtcttatggtgtcagtgtgaggatgaacttgtgtcatgaacagcagtgtctggcacttagtaattacttaacaaatattggctacaaatatatcatttttctcatctacaatcaattagagtttgttattagcataactatgacctgtaataaattataatttctttgggtgaatttatccatattgccaaattgcaaaaagtagagctttaataattgattctttactggtacttttttctgtctaaactcctgaagtcttctctttctctgaaatctaatttgtatttgcctttcactattggcaacattaaagtatcaacttccctttgatgaaggtccgcagcccagggcctgaatggaacatctgctcttattaacaattccttctttttcgagcttgtctattcttttagagcaacttggccctaaataccccctaacacctcatcttcaaccctaattccctgtatggccctcccccaagttttccatgacttcagtctgttcaacaacaactccatttctattagtccaatcatctctggggtctgggttctctctctccccatcccctctgttcatttcgaaaccctctatgtttccactgttttactcaaagtaatgagtaagtacctgcactggcaggacaagtatagaacgtcaacaagtgaagatgttcaataaaccctcatcatagagtattcattaattatgattgaagaagtaatctacacctccaacttcagcttctggcctaaattacatttttatacctttgtatattatatttttgtatattattatctcagtttgttttgtgttgctataatagaataccacagactgggtaatttatcaaaacacacacacactggcacacacacacacacacacgcaaacacacattgatttctcacagttctggggggctgaaaaatccaagatcaaagagctgttatcttgtaaaggccctcttgctgtgtcatcacatggtagaaagtagaatgacaaaagagagagcccattcctaaaagcccatttaaaaatgatattcctccattcatgaggatggaacctcatgacctaaacacctcccatgaggccccacatcccaatactgttactttggcaattaaatctcaacatgagttttggaggtgacaaacattccaaccatggcaacaataaatgaatgagatttgttttagtgcagtaaaattatttgttgtatttttcagtaatatttagagaaaagcttatttcagcagaagcaataaatgtgttataaatgatccttccaaacatttatacttataattgtcaagcacagccatctaataagagttgaaaggtaaattagttaggaaaactgggttgcctctcaaataaataatctagcatgtgttttgaagaatgaatgacgtatataaggaagagtttagaggaacttttcaatcctagaatggcataaaatatatgaagctctgtcacacttcataaatcagtactgttagtagatccatgtcagacagcaactgtgtttgcaagtaccaacgtaattataaatggagggcatcaccaggagtggttctacacagatctgacccaggtgatttacaaaaaggttgtctctccataacatatacttggatgcagtcacttacatttgctaattgctactgtttcctaattattcctgggagcaagagggacaaatgatgcccagaataaatttgaaaagcatattggaactctgaagacaggggcagaaaagtgaatattttaggataaacatttttaacacctttttcttccaaaaagtgttaaattttcaatatggttaaaatatcgaaataggtaggttattgctgcaagagaatggttggcttcatagctaatatcacatagtggaattttgacttctgggatgtggcttatgacaccagaaagacagacacttgaggcaataaaggtcattatttttgagattcagaaactatatatttgtccaggtaatggctgatacgcacataaataaattgaacgtggagaggagtgatgaataaaagcccacattcagttgtgaaataaattacaaattgagcacattatgaagacaaatacactgtagaaagcacattaaaacaaagtaataataaaagtattattacaaatcagtgaatgattactatatcccaggcacttgaaggtatctgattcaatgccccagtatccctttgaggtaggtaattatcacctccaattacacagattttttaaaatgaggcttaattgatttaaatcttgctaaaattctcagagctagcaaatgatagagataaaatttgaaatcaggaccatctgattgcacagttcatcatgatacctagacatttaggagaaaatattggagaaatgggcaggaaaagtcctaaatgacctcagacacctctacacataggacataggtaataaataaaataaaattgtgatgataacaggtgagaaatagaacttcatagatgcaaataagatctgaaaaataggacaattattcccattgttgtcattccggcaataccagaagaggaagctttaagcacatacacacacatgcacacatgatgtctattagaaagaaaggtaaaattgtctgcaagtccagatgacatgcacctgtagcaatactgagttccctctgggaaggatatgaatgaggtattcccaacatgatcacaaagttgcggcatgcttttaatctatagctgcacatttcttttggcagaaagaagactcttctaagttcttccctaaataatacagcaatattttatgagctttaaaaaagtatacaaatgacactggacactatccatggctcagcagaagtacactttaaagacacataggttttagcaaaaaaaaaaaaaaaatgaactcaatatgatttaagagttgatatggcttccaaataaaagatgatgtgatgtgatcgtagtattcattaagagatctatctaatctagttccctgagagaactgacctgtgctagtccaatatctcttggcatactctgcttcattcttgtcaaagatttcaagagggatttattgaacatttaaaatggaaaaaaccagaatatctgaaggacttttgaaggaaataagcatgtttaaagtgaaaataaatttcaaagaaccatggtggctaccctcaaatatgtaaagaattgattgattgccacgtggaagagggttagaattttttatggccaactatgttatacattagcttggaagataaagagcttctagttactggaggcatttaggcatcatctgaactgatgcattggttagcatcactttttagtgagtaattggactcagtgtcttttaagagctctctcagtgctgacactgtactctgcacatattccttcactgccctccatgtgacattggcacatatttgtgaaatattttgaccaaaattagaagtaagtctttagagataactagcttgagggcttgcaatagagctacatggagatttaatcagtggccttggactcattagcgccacatcctccaaacctggctcttacatagtcatggtcaaagtgtgttggtgaagcagacaggtaagaagccatctgaagatattcttacaattcatactcatctacatattgagaagtctgccttttctttttctctatggagatatctataagcaggtagtgggttgtagggagatcagtactgccagtagcagctatcccatggtcttcacgtagttgggagactcactaagacgaagctcagtgaaaatttcagggctgtgctgtttattatggtctgctatggtatgatcacccaccacttctggtttacacctatatcaaattccaacagctgctgagcctgagtaagtcataaatataatgaactttgacatgactgaaggaaagttaatttgaattatatcatctcagcaatacatctccttgagaattttagaataaaaacatcctcaacaaatctatagacaacatggcaattttatatacctcttgtggttttcaaatcattcttccctccaaggccaattgtgatgagggtgactctatgggttatgtcttttattccattgaaggcaagttatcataaggctagttaccagaggaaagttaccaccaaggagatgaagagcatgtgcttcaatgaatgactgtgttaacagtgtgttaatcagaacaagtactaggaaaagtgggaatttaaatgtggcacaaaggccaaggcatgcaccaatgtaaatttagaaaactgtcgagaaaatatgtatggttactgctggaaataattcttcagccaatttggtaaaactctaagtgttaaagtgatgagagatccaatgggaaatctctagagtttggctgtgagttataaagttcataagaatgccaaaaaggccaaagaaaaaataaaagtaaaataaattagttgcaaaatcatatgtggggttggatctaaaggaaagttgaacacatagaaaactgagttaaaacaaacttttaagtcctgaaaaggcagagaattagccggtgtaggaagctgagtctcaaaattaaggatcttgataactctatggaaacaaaaagttaagaaaggcattttctgcttatagattaataaccagtattggaggagagaaacatagcaattcagatctgtttcccttctcccccagcagagaggatgaaaattggccattgtgtatacctccccagactcactgtatacctccccagaggaagttagagaataagattgacctgatcaactggtatattcagctatggctggaaagagagagttcccaggcaatcccattattaactgtgctggtggctactttgtgcagattccctataggctcagaacagacctccatattattccctgatagtctgattcaaatgagatcccatatttcctggtaggagaacatggttaacaaggtgccgtatgccagtctgagccacactctcgacacctgacctctcaacaaatggtgctgcagcctcttgtggcctccccgttattgctcacaccatcaatccctctgtggtataaaacggaaccatccagtatgtgctccaaatcctaggctgtgactctgcctgatgcccccagcttgggatacaaactccacagacatcataatctacagctgaaacacaggtataagaggctttggacatttccaggctgcctcagcactccttcaaaagcaaaatcaaagaataagaaaatgtttatcctgaccatccaaaccatgcatataaggttgaatggaaagatttgggaatagtgctgagatgaatgacttggaattgctacacctgctggagtttattccactccaaaatgtctttattccatcaggaagggaactgccctggaaataggtgctgttactggggccatctcttaggcaggaaaaaattcagacaccaacaaaagccagattatagctcattgtctgtgacttgatagattgaagacagaccattattttcatggaccacaacaccaaaagctacaaatggcagagccaatatatccttttgtttcaaaatgtcaactataaaaagcctagagttttcctatcattaccacttttctggatacctgtatgtttcagacaatggaattattttctctgtaggcttttaaaaataagtctttaaaaattggtctaatatgttgtaccaaagtctgtcaattaagaaataaagctcttgtttttaaaaaaaaagagtcatggaaacaatttctaaaatccatatgctttaaaacctgcagtaagatcatattgtttagaatgaatgtgtgtggtcttcttacctgacccttcgggtattttttttttaagaatcccaggacaagcatgtgtagtgataaaaacagcaaacactacacggatatttcaccaaaggctggtgaaactcaggatagttaaactagatagctttcatttccatcactggctctacctaatgttagtatatttcttaaaccaggacttcttaggaagttcagtgggcactagcaaatctgcactatgcaactggaagaaacttgtatacatagccactttccagtcttggctaacaccatcagcacaatgtcagcttattttccacttccggttgctctactgtctgttatcatcatgttgacacagcatacatttcccttcattatcacctctctccttacttttatacttaggtaagtaggactgaagtcaagtgaaacctgttttttaggttatgaaataaagagagattagaaatactgagaacatgggtagtaagagaaggaggacttagagacctgtttgtctatattaattctccatcagcctaaatagattaaatactgattccaaattgattataatcagaggtgtatactaccaaacactgaattactctctcttcataaatgaaaactgcctacatgtagctttttatcggagttctttttaggtgtttcaagaacaaaattttaatcatcaggttctaaaaagaaacaaagtagagagaacagagtcagcctcatttgtgcaatcatgcatttgttcatttcttcaaataaaatgtcctgcttacctattatattgtcaagcacagtgctgggtacaggaaacacagagatgaggaaaataagtatcccagtgcctatggagatgagcatttagtgacttaaatagccccagcaagtccgcagatgctggagttgtggtccatctgtttttgtttctctcattgacttgcaattgggataccaacaagaaatctgatattactccatgtgaaggacgatgcatccaatttctatgtggttttataggagcctagttcaataaagctgtagtgaatgcttaaaatgaagcagtgggtatggcttaaacaatttggactttggagacattaggcttcaaaaccaaacttgcatttaaatccctgttttacaactcacaaattccatgaaactgttttactatcagaaaaatgggtgaatatttatgaaatgatctttgtataactgtggtcaaagtatgcattagcatgtgtattcttctctttctctaagcttttactcaacaccttgaggacagagaatgcaaaactatataagatcaggaatacaggaagataacacacggcaagaggaactttgaatatgactttaaaacattttacacccaagaaaatatcaatgcttataaaattaaataaaaactgtatatagagatgaataagaatatatatttagataatacattttagataaaaatgtatatctctaggcattgttcattaccattctcattgtactaattaaaattctaaatattatttggaggggttaatatttctgtatcaaccaaattctaagaattttttagtattacattgaatgtttgataggaatttatttctagagtttaaaaatgagctagcaaactcaacttgtattgtactagcaatagtacacttactaaattattataattacatattgcaatccttataatctatttgtttctttaaaattattatatgaaggtctcccatatttatcacacgagtatctgatataaatgtgtgtgttggggggtatgtaaaatatacaactttcatttgacttgtattttggattttgttcttttgtttttgcaatggctatatcttaatttcatcatatatcataattgaaattggtttgcaaattttcttcaaagttatatatcttcatttactatacacatgatcaaatgtgaattaggatgcttaatgcatagtatatcagcttaatatgccatgtttcaaattgtacattcatatcctttgaaaaatgtttaagattaaacacatttttaaaatcatcattattattataagataatcttaagggattgtatgtcatgtctaaaaacagtagaaaattatacaaaaagtcatctaaatcaataatgtacacagtatttacttactgtataagtttcctattgctgttataacaaaattaccagaaactcagcagcctaaaacaacacaaagtcactgccctgcagttttggagtcaaaacttggctccaaatgggtctcacttggctaaaatcaaattagcagcaagattgcattgcttttggaggccttagagcggaacctgtgttctcacctttttcatcttttagaggctgttttctgcattccttggctcatggccccttccatcttcaaagccagcaatgacaagttgagtctttctcaggtcgcactactgactcttctgcctccctcttccatatctgagacacaaccggataatttaggataacctccttattttaaggtcagttgattagcagccttgattccatctattactttaattcctttttgacatttaatatattatattcacaggttctggtgattagaatgttcacatctttgggaggcccttattctgcttaacacaactatttactgttgaattttatgccatctattcaaggaacactggtctactttatatattttattctaatttaagcaatatttgtatgattaatgtttttatgccttaaatgtatttgtagaattttattaaattcttatagcaagtatttcagtattccaactttttgtttgttgtttatgattcatcttatcaatctactctcatcaacctagaatacagttgctggataaaatacaggacatccagttacattttaatttcagataattatattttaggatgccactttgtatgacacatttacacaaaataattatccattgtttatctgaaattaaaatttaacataacatctgcatttctatttaataagtctagcaaccctatcctaggaaaccctgaacattgttcctctgtagaactgaaaaagaatttgtgggatcatctgttaagacctcttatggagaactgagacccaaatacaactgcagttgatgttggaatggtttcaaatagaagcagaaggtattttttttcagaattttaaatgactcaaaataaatatttggccaacagaaatcagaaagaagcatgctgctattgcatgaaattaaactaagcaagcatctatgatttcctgacagaaagtatgcttccagtaggatagcagcaagaaagagagccctttggtataatacctgattacatggcaccactttaaattagtgtaatattctaagaaagagaacatgggaggcaatttgagaaataagccatgatttaggaattcatagtataagtggaccaaatagaaaatactgttacttgtatatatcttactttatctaagatatttaagatatctcaaagttaatttcaactatggttgttttgctccagaaaataaattgtttatgctttttaatcaaatactgcaaatatatgaattcttttaaaaaaacacatatttaaagatttcttgacagactatgttattagagtgtggagaatagaaaaaaaagtcttataaacaaatcatgttataacatatctctttctacttagtcatattacggtcataaaaataattttactttaaatacaaaacaatttagtaattgatattaaataattgggctcaattccattaaatcacatgaaaatatgaaacattttgtgtctgtttagggccagttttacaccagaagagtacaatgcttataggtactatagttactgcagatttacataacaagaatataaacttaacatttctcaagtgaccaaatgcatcagcaaaaaagtagggacagcagagtttagagaatgccaaagggatttaggttggtcagtatggcaaatgaagactcgtcatctcacttaccaacaaacgagtaagaagaagcaggagtcttagtcaatactcaaaccaatcctgtgtgctgagcattgtttttatccccattttacagacacgagctgaggcttagagtgggaatatatgccacgtcacttagtacatgcccaaaccacaatttgtgtcaagcatccagtctctacatccatgcttataaacactataccatgctgcctccatgcaattaaactgaatgtgatttaattgctcaagttgttatgttaaacagtgtaaagtttgtaactatcacacattgtgatcagttaaaattgattatataaaatattatgtgtgttgtgaatatggcctttatttttcaaaataatcaaaacttatttcaacttgcactaatatcttcatagagctcctggataatggcataagagtttggggaattaagattctggagaaaagcacctgcttttgaaggtttcaagtctaagggaaataattattttagatagattgccccataggattttcaaccaaaggaagagaactcgtcacctatatggtttccatatttgaattaagtcttaaactatcatgaatttatttttaagaaaattacagcttttcttgttcccaattacaaaagtactttaaagtgttggctttttcttaggttccataggaagagtcaagagaaaaagacataaaagggaacttaactggttcttgtcaccaacactttacaatttgtcatgacaggactgcttagtagacacaatgtccttccctcttttttagccattgaggcagagcaatttatgatactacattaactggcagtatgaggaaaacgtggtagaagaggataaggaactcgctaatgtgaagcgaaataaaaaatgagtttctaataagagattactttacacaataacttttctggggtcacatcagtcttccagcttgtggcttatgtatttccataagaggaaaaacattttgaatgacaaacaagaagtaatgatgagtagaatgtgccacagaaaagttaggtaatgttcaactagcaaaatctgatatactgagaggtatctgctgtgggctatacttttatttttgcaaatagagagcaagaaatttataaattaatgtaaagtactgagtactgggcatcctttttctctttctgcctaagatagctcataaaacataaacatatggttatcaatagataccccatagggctcttgggaaaagtaattcggattctggatcatacgtttgtatcatgctatgttgatgtgaatgcaattgattaaggtttatgagaccaataatccaccttaagtatatttatcttctaaaatgcttcctgcattaatttgcatctctcactgaatatgcataataatcttcatgtgcatttgcttaaaaattaggtcatgcctctgagtagttgaccatttcttatgtagctggcatttttttttctaaaataagagcatcttagaattaaacagacccttagagactacctagtcaagttctcatcttacttgaggtaagaggacaagattcagagaagataacttccttaatcaagtccacagatatgttaatgagaaaagaatctcaatttcttgtctaccaggccaatcatttcctttacttttaactttaactcactttttagaacacattaactcagaattggcttaaaaatgtttatccctttttcttttctttttatcaatttcaacaaaaaccttgtacttgaaaactagttgcaaagcacttggattgtggggctggcaagaagtgagagttgggaagaatgcacaagaattatgatgatctcttcctgaggaatcgctgaatggaaatacaaccatagttgcataaataactgaagaacaacacagaacacaaatctggaaatgtaaaataatggacatccagatagagcacatatgtgtttagaacttgtattaatagggaagatttcatggattagttgatttcataagaaaattggtttcactgaaatgaagagtggtataacaaaatgaaagtggtattaataaagtttggaaagtttggatttgagctaatagtcaataggaattaattttactttaagaacccttaatagcaccactgagagtacacatagcaatttttactgagtaactaaattatccctttaaaaaagtctcttctacagaattcaagctccacgatggcaggccacttctggctcaaacagtgctgttagtattcagcagaatgacggtgttaaaacaaaaatggactgattgagtaactataaaagaagtggcagtctacggccataccaccctgaacgtgcctgatctcatctaaaagaagtgacaaagaagaagtgttgtgcaagaactttatggcaaaaatctggaagtcactttcgagtacagtgatcagtgcttatgtagctagcaatttttttctaaaataagcatcttaaaattaaacagattccacccagatgtggactagagatttgaccttggaagtgagaaggaaaaaaatagatctaggagaaatttcaaacaaacactataatttgttgacagagtctaaacagggtaaaaagaagagaagtcggtgtcaacttccaagtctggatctctgaaagacaaagataatgttgacatagaaaggaggaaataaaatagacactgagcataacagagaaacataaggtaggttttaagcctgagacctatggacaaaaggagatttgaccttggaaatgagaaggaaaaacatagatctaggagaaatttcaaacaaacactgtaatttgttgacagagtctaaacaggggaaaaaagaagagaagtctaaaaagaagtttaacttcttttctctaaacttctaaaaagaaggttttattattctaaaaagaagtttagagaaaagaaaatggtttaaatataaataacatgatttggcatgataggaaacattcaatgaatagtgaccattttaaacatgatacatttggggttttagatagcttaatttcacaatttgggttttggattgctttctgatcccagttttggattgttttagttcacatttttgaacacgtaaaagggcagagattaagaaagcagtgaggaaagcacgaatgcagcttttctagcaggagatatgtgaatgatgagaatgtcaagggaatagtgcctgggagaaagtccaaaatggggcaacttgaacagaaggaagatgagataaagaagacaaagaaacaaaaagattcaaagcaatgtggtttcccagagtgcaggggaggggaagatataaaatgaggacatatcattagcaatcaccaatctatgcctgcgctatacataaaaaatatataaaataataagagaggtggaaacaggtaatttgacggccttctttggagacatgtacgttataatcctatggtagtgactccctctactcattgccagtcttcttgccatcttctatacatattcttcttttgtatttcgaatgtaattatttcgtgctttttattgtcagttcttaacaataaataggcagtgtaaccaagtgttcgataaattgccatttgattggacattttagcatggggaaaatgttttgttgaagaaaggacagcactacagtgataagctgcctgctgatgtaaacactttaagggtttatgacaggctcactatctaccaatactattttcaattcaattcaatttgagtagatgaggattttagagaaagcagctgccaggagaaacatatgacatttaatcttatctgagaacatgaaatcttctgcagaagctataagtacatacgtgtgtgtaatttgagtcttagtgtatattcaaaaaggttatagaggaagctgtattctataggatttaagccaacagacaaaagaaaatacatttcttggtatttttcccaagatacacttgactgaacaaataacatagagagtctaaaattccaagtgaaaacattcaactgattgcaatttttgaactattttttttttcaaaatggtaaccttaattcctcttctaaaatcccacaaaaacctacaattagtgtggatgctatttgattggttgaaaactagtccctgttaacaggattcaaaacactgccaaaatacagaaccctgcggattaccttatggactcaatatattactttaaaaaatgattttaaagaaaaacaacagaataattgaaaattgactaattctgattttatatgcaaggcactcaaaattacacaaaactgagttgtggtaaagaaaaaaatatttagtgaatttggtcatgaccatgacaaatagtaaaaataaagattactctaaaatttgcccaagcacattgtaatataaaatccatttaactttcaaatttatataataaactgattatatatttaaattggatgcatcatttacaaataatttggcttttatttctaatgaatgtgccttttatttcaactatcaaaattcatttccacattatttagcagatttgtttactcaaaatcataatctaccagatactcatgctgtgtatctttacttttgcttttatccacacaaattgatttttacccaattttcactattttgagcccaaatattcttctccatacttgtctagatgcagtcattagccatttaaaaactggtttgctcttttagtccagaccagagagaaagctatgactcttccttgaagtccaattgggtagaaaccttgtagcagccccaaagaaggttgcacattacaagcacaatcacatgccataaactgcaaacatctcattttccattgtcttctgttcccaattcaacttgaaatgagtcctctcctttccacttccaccgccacatgtcaaacccccaatatttcttgcctggatttcctcaacaaacttgttattttattttttcttatccacatcccctgcaactcttcagactctccactggcagagaaatttcccaaaatataatggtactgagaacatattcatgctcaaaaaggttaaatatactcgaatccctagcaaatgaagtacaaacatggcataaatcccttcataaaatgactcccaattatctgactatccttgttttatagtaatcatataatttttcgcccacactggaaaatactttttcagtggaaaaggtgtgttattaacaaggaaaaaaggaatatgtggcctcccagttctccttgtggctatcttaaacttaaaacaggtttttggtcacaggttttacaaacaatgcccaactttcccttctctgaaagtgtaaacccactatttctattgtctaggaggctgtttgcatctgttcctttccctcttttaggcctttttaaattcccacttccttcatggacagtttcttcatccgttcaccatccctggtcccaagacgtcatactgtgaacttcacctccattatcttactctgccttgaccagtcacttctgtgcttggtattatccccctgacttgacccttaaaaatctgatgacttcttattcatttttgcatttttctgaataccaaacaaaggtttttgcataaagcaaacatttaataaatacttttgatgaaatgccatcatcagctataagctgacacttaaattgtggccattgaaaagtatttatttagcaattgtattaaacctaaagaagaggacgttcaaaaaggatttttgtcaaccaaagattttgagtcattttacaaattcaaaatcattcatccattcctgcatcaaagattttctttaaaaatttattatatatcaaaagcccctaatatgaaaatgtacctttatgttgtcttagaaaagtttttcttgagactttcatttaaattcttctgtatgcgatgatttatacttgaataatcttacatctcctgatcccattgtatagaattaatgagtttgaatgtttttttgttttgtttttcctgttgtgtaaagaatgtactcatatctcttgagttaccaattttagatagtatctattggctactcacagaaaaagatgagtgatttagtgtttgcacaagtcccctctctattgtcccttttcacagacctctcaattttttttttttttttgaaacagagtctcactctgtcacccaggctggagtgcagtgcgcataatctcagctcgctgcagcctccatctcccaggttcaagttattctcctgcctcaggcttcagagtaggtgggattacaggcacctgcaatcatgccaggctaatttttgtatttttagtggagatgcggtatcgccaggttggccaggctggtctagaactcttggcctcagcgatctgcccacctcgacctcccgaagtgctggcattacaggcatgagccaccatgcccggccagacccctcaatttttaaaatttatattactatttttgatttacagggtttgtataatatttacattactcacattagtagataatatttgtttgtataatatttacattacttacattagtagataaattaatacttctctattttgtttctagattccttctaacaacgtaatatcaattcaaaaagcaattactatattatggctactaaatattattcccttcagattcattcaggtagcataactggacttgcagaaaaggagtaagcataattattaaaatcctggtttttaaaggattatggatatatatgaatatattgtgaatatattaaccaccagggtctaatatatcctttctcgagttaaacaaaaagttaaaaaaaatccttctggatcatatgtgattgccactgccttactgtctcatatctgacatgcctttttttggataattcatatgtagatatgtaggcatcagattttctgggccatttacatttttagcctaacattgattgatagtttggttggctatagaattttaagtttaaaacacggttccttcaagaaagactttgctcaattctgtttagaattcaaggaggcacatgagatctgatgttcattctttgtaggtatctttttttcccttctaaaagttcctagaattttctgtcaattagtgaaaatttactaagatgtttggccctttccattttttcaattttaagaattttctttcttcagttgtgaaatcttccttctgttttgtttttgtatttaggttatttccattctttgtctctgtttcctcttctaggatgtttattagatatatattgggatcttgcatttatgctcaacatgtcttaatttttcctcatattttcctttttttcacttttctttctggttctgacttttattttgccctctagatctctgctctggttctatgtttcagcacatctgttcagctttttattttcacattcataattttagtttctgggatcatatgcttattccctgactgatattttccatagccacttgcatgtgtgtgtatgggtctgtgttcaatattttcttgattcactcttaaaatgctagttaaaattgttttttaagaacattttcttatatttcctgaattacctgtgggattttttttttgagtcagttaatgctgttttgtttcttttttagtgttttaaaattctgctctgggttttctgcagttaatcctgccatccttagctgttgatgtagaattataatgggaggaccaggttgcatgacaaagattactggtggggtctgttttctttgtttgagagggctgactatgaacttgtgagtttagtgattgttttacctggctcgcttctcttaaagatgcatggatattggcaagcaagcagcctggaacttaccccaggagaaacctgttctaagagttgagaaacttatattcttatcctaggtagagctgtatttcctattccccctggccatatctgaaataaaatcacttccaatcctgccctttctctttcagtgccttataggtacagaagtcctctgtcctcacataattcccatttttcagagttctttcttttaactggaactctttctacattaaggttggagcagaaaggggaagtgaggagcccagctggcccatatctcctgaaatgcagttctttaaatatttccctaatggtcactctgatgcctgcttcaggactttatgttgactttaggtttggaaattatttgggacttttatagtaagaaccacttatgcatcttgggttgtgcttcccttctttgaatttctccataaatcagacccaactggcttttactttctgagagtttctcagttttaccaaatgtttgttctaacaatataatggcttcctctcattctctctccctctctttctcctttccttctagtcttctttcttttttaaaatctcattatttttgtcatttacttgttaccttagatggaggacatacatgtgtctttgtgccagccattatcttgaaccagaaaccagattaaatttctttttacatatttcttttaattattcaaataaatctgtttcgaatttattttagatagcccggaatatatattaatacttggttaaatattttttccacactttaaggtaggtggtactaacccatatgataccacatttagatttttcttttacatttctcaacataaaaaatatatatatatgtggttacagccaaaaggaactgtttgcttgcaatctgttcttcctggcaccctgtatgttccatgagagataagcatctactgaagcataaaaagtgtcttacaaaatcatagtaagtaaatcagtcactacattctgtattatcaatagtcctgggtgtcattaaggttctgtctgtatagaaaagattaggtttgtgtatatgatattctcctaaagcattttaacataaagtcatggtcactgaaatctgaaaatattcacatttcagtcttaatcaaatctagtacctcaggatttttcaatcatattcagaaagttcaaccatttcgatgtgttagctctagctctaagttcccaggctgaatatccagtggtctagttgcataaattattgtaatttgggcagagaattcaaactgtttgtaaactcaatttcaattgaaaaataccacaatgtcactaataatcaacacttaaattaagtaatcttcagccccacagcttcctcagaacccccaaaagtaggatgtgtaatctaaaaagattcattgagcaaatatttatttgtgctatcaaagaagatggcttcccccaaaagaattcctccaaatgttaaagttggtaattttctgcaggattaatatgtagcacaatcagaaaaaacaaaaacaaaaacttatataaggcagcattccctaggagagccacttggcagtcctgcctgcatgtgccctacatgagaattccatgcttcctctgaatcttcacaagcatatcatttaaattaagagcataaatgaggccacataaatgctttcttttccagtttttttaaaatttacttcccccttccagagcagattgcaacagtctggtataattgatcttgtccacaaaaaatcgaccgtaatacattaaatagttctgtaatgtggcaccgttaaaaaggatctgcttcaaatgactgtgaactgacaaggaaagaaaatgttatatagttggctgggcgcggtggctcacgcctgtaatcccagcactttgggaggccgaggcgggtggatcatttgaggtcaggagtttgagaccagcctggccaatatggtgaaaccccatctctactaaaaatacaaaattagctgggcatagtggtgcacatctgtaatcctagctacttgagaggctgaggcaagagaatcgcttgaacctgggaggcagatgttgcagtgagccaagatggcgccactgcactccagcctgggcaacagagcgagacttcatctcaaaaagaaaagaaaagaaaagaaaatggtatatagtttaccaacaggtagcctaagatagttatatgcagtgattaacgattacaaacatacaatgtggatactgataatcatttttactgccctcctttaaggaaatggagaaatgtcaggagacaaggtacagctgaaaattttcctccagtttgatctattctgcaaatctcttccatccttgtccaggttattgacactatttccgcaggattttcaggctgttcttttctcatctggactattccttagagcaggaattttattactaatctccaaactacctctcgaatattagaattattcacattccaaattataatacaaagatttcagcaactgctctctgatgatattttttttcttccagtattgtctgttaaatatttgaaggcaggtacacactgcctcaggaacaactctgtcctctctccaaatgctccagattcttctctccctcacagccctctttaactgctgtaatctgtaagatctactcttcgggcaagcctctatgtttaagaaaacactttcaggccgggtgcagtggctcatgcctgtaatccagcattttgggaggctaaggcgggcggatcatgaggtcaagagattgagaccatcctggccaacatggtgaaaccccgtctctattaaaaatacaaaaattagctgggagtggtggcgtgtgcctgtagtcccagttacttgggaggctgaggcagaagaatcacttgaaccctgaaggcagaggttgcagtgagccgaggtagtgccactgtactccagcctggtgacagagcagagcaagactccatctcaaaaaacaacgacaacaacaacaacaacaaaataagaaaacactttcagttgggggtctgctcagatatggtctaaatggcaggtgaaattgagacaattacttggataaatcaaatcacatcctcctacgcaattcattcgaatatattcagtcattaaacaaatattttttaaagaacctattacagactcaatattatgctgagtgctgaagagaaaatggtgagcaaaatcaaataaagtccttgccctcatgggtaacagcctaatggtgatgatagccaacatttattcactgcctattatgtgcatgaaacacttttcatgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaatttgtattgtccagggggaactcattaccacctatagatacatagccacttgcccatgttttctcagctatttagcagacacaggatttgaacccaagatttcacattcaggagcttatgctctttcttactccactggcacacctgtgtacccctacactcttctgcccctaaggtagataaatagagaaaaagaacaagaggggtgatatggcaaaagtatctcaatagttgcatcaattctcctttgctttgtgaattctggatgaaacaaaggacaactataataattcttgcttgctcttctctttaaacatgtagtagtcctatttgagaataagtgataatgacaactttttagaaaaaaatctacatgacccatcattaaatgggaaaccatttttttcagaaaaaaaaaattgttataatggagattacaataagatgcctacagaagattcccattgtgctatagtctaacttaaatcacaaatacgcatttatattattatatcattaatattagctcattgaataggcatttattgagaatggactataagaagagctatatgttaagagacatattcattcagacagacattgcttattgtccacaacaacgatgacttttaaaagtaagaagaggaagtaaagtaaaggggcaggagtgagtagagggaggagtctaaggtgacaaccagctttctgacttaagctgctatgcatcctgaggccactggaagaaaatctggtttgagatttattggaggttttttcttttcttttctttttttgcctttttgagttttattttcttttccactttgagggtgttttgttttgtttccatcggatgctctagaagaggcagagtgctcattggaggttgacagtgtcataacccttgtctgattatctcgattttatgagcccaattaaggatgataaaatatgtgttttagagatttctgccatccttacagccccttaccatccctaaggatacttctcctgactattaatcacattttaatttttttctcttttcagtacaattatgtgagtttgtgttattgcatggccatgcctcagtggtctacccttccttcacaccacttttctatagggaaaccaaaggtgcatttataccataatttagttgaattcagcagtagttacaaatgatgttattaaaatctattgggaaaaatgattcatcttgattcattcaaaatgattcattcaaaaacagaggacaaaggaatgtggggaagttaaatgatatatcattgaataaaggcacttcagaaagctctctgtcttcataactgctacaagtgtcctttataacttcattttacccaaatgttttccaaaacatctgtctaaacttttcaactaagtttagttgttattcttgcttcttgtaatttcagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccgggtgagtatgttctctatgagcccactgcatgtcttccacctgtgggtataaaaaattaatgagccttccatttttcccccatttataatatcctaatcctagccacgggtttgtaatgaatcacagaatgctgacagtacaaatacagtttaccataataagagtctcgttttttttcccctgatattgactttatgaaagtgttaagtgactggatccaatatatcattcacctcatcaacttgatgagtgtcattagtttccatttacctcctcattgctgaccaatgtgacatctggagagagatttattggtcaaaacagttttaaaactaaaaaaaataaaatacaaaaaaataagaagaagccccgtagaaagatgctttagagttaatcacaaatataaatgccagaatccctgaaacactgggctaggatataaacatatataaaagatgatccatgtctttctaccatacttagggaaattcaaatcacactgcatcaattttgaaaggaaatggcaaaatgagttaatctctgactttcctcatgtgttcatggagataactatattaatgtgttttgcccctgtttaggcttgaaatatcctttttttcttcagtcttgcatttccatgttgtgcaaaacaccatgctgaatgagataacttgatggtaatgttttttttactgaacgaaagtggccctatggtgatttaaagcagggaaattagtacaaatgagattttccccactttgcttagtatcgcttcagggccttaaaatccaaccttatgctttcaggttaaatcatagaataactctatcgagatacaagcagttcgtgaaagagacagcaccaatcattgatctcttacctttaatttgcttttcttattagacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcctgtggcccgctgccactttgaatagggctagtctgtgtaaacaatagtatattccagaaatgatgatacgtctcttctgaggccaggtcataaaaggcattttggtttcggccttgctctctgctggataattcactcgagtggaagcactccagtgtcactgatgcaggacagacgagccccaaagtgggaccaagcctgccagaattcttggctccacccaggaaagaattcaagggcaagctgatggtggttagaagaaaacagctttattgaagcagcaattatagctccatgactgttcctgcagagcaggagcagcaggcagagagcagcagctcagggcagttctgcaattgtgtttatacctactttcaattgcatgcagagtaaggggtggattatgcagaaatttctaggaaaaaggtaataactactaggttgcaggtcgctgccatggaaagaggctgtaactgccatggcaatggtgggcatgtcttacgggaagctgcttctgtcctgtccctgttttagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtgcttacatttttaaattttcaatcttttcagaaaagtcaactaggagtactgttttataaactctttaaaaagaatataatttttagagaataattttcttctgtatagttttaataactcctgaagaaaggattacaagaatgattacaagaatgttgaacaagtaaaatccccattataattaataattttcagtcttcattacagaactctcaatctaatatctctaatacaatgtttttcctaaatatcaagtggtatttttttaatgtgcttaccatatacaggatgtgggaaaattttaaatacattgtttacagataactgatacttagtcataccattcttaacacatttcctcttgctctacatgtaataattttgttaattattattaattaataattattttgttgactagtttgacacctcgatattcaaaactcaatatttctgacttaagtaatggaagactgcatgtgcaattacttccagagacactaatgattatttttaaaccattactcattaaatttcatataaatgcatacaatctgcatgggtacttaaaattttaaactttagtgccatattttgcatatcacatgattcacacatgaatgagtacatgttgcacagttaatctgataacagaatataaaattatgtaattatatgcattatatgtgtctctctatatatatatttcttaatattctgcatttcctttgagtcatgtacagctttaagtgaccacaaagaaaacaatatttatctcttcttcaaagtggcccgtgtcctttgaaaaatctaatatgcttgagatgattcccaagctgaaatcctgtttttttgtgatgttccagatctatataacctttaaaagtgcgaagacttctcctattttaaagacaatttaaaataaaattaaggaaaaaatttcatttacattaacaccaaaaataaaatacttagtgataaacttagtaaaagaagcacatgacttatccaggaaaaactacaaaacatcattgaaaaaaagtgaaaaaaaaagtataaatagttgaaaagaaatcctgtgtttatgaatcagatgatttactattgctaagatagcaatatttcccacattgatctgcatacatattcaacacaatcccagtcaaaatctcagctggctccttcactgaaattgatcatctgatcctaaaatttatatggaaatataagggacccagaatagccaaaattttgaaagcaaagaataaagatggagtattcacatttcctcattttaaaacttattacaaagaatgtcataatcaagacaacatagtacaggcataataataaacaaattagtggcatagactagagagtccagaaataaacctcatacacatttataatataaacgtgtatgttcacgttatttttgacaagatacaaagaaaattcaataaagaattttttttttcaaaaaatgatgccaaaataactggatatccatatgcaaaataatgaagttatacacctacctcacactgtatataaaaattaactcaaaaaggatccaagacacaatgcaacaactaaaacttaaaaactcatagaagaaaacaggagtaaatctctgtgaccttgtgttaggcagtgttttttagacatgacaccaaaagcagaagcaacaacaacaaaaaaaataaattgcacttcatctatgttaaataattgtgtgggtcaagagacaccaccaagattgttagaagacaacccacaggataggcaaaaatatgttcaagtcattattatctctaataagggatttgtatccagaatatattttttaaaaactgttaaaattcaacagttaaaagaccaataatccaattacaaatgagccaataaattgaatagacatgtcccaaagaagatatacaaattgtcaatagtgcatgaaaatatacctaacattattagctatcagggaaatctaaatcaaaaccagtgcaccaactaggactattataataaaaaataaagacaatagcaagtgttgataaagatgtggatgaagacatttggaattctttgcattgctgtggcaatgtaaaatggtactgtagctttggaaaatttgacaattccttagaaagctaaacatagggttttgatatgacctagcaattccacttctaggtatataccaaagatagttaaaaacatatgttcccacaaaaatttgtgtataaatgttcataacaggattattcataataccccccaaaaccagaaacaacccaaatgaccagtaactgatgaaaggataaaaaatgtggtatatctatattacttagcaatcaaaaggaatagtgtattgacacctactacaaaatggatggaccttgaaaacattacactaagaaatgaaagcagctaatcacaaaatactaatattgcatgtttttattttatatataacatccagaataggcaaatccattgaattccaggagctagggggaaggaaatagagaatgaccactaaagggtatgggatttcttggatgatgatgaaaatgaactaaacttagatattggtgatggatgtgcaacactgtgaatatacgaagaaccactgaattgcatactttgaaagagatcatttttggcgtgtaagttatctctataaagctgttatttaaaaaatgtggagactatttaagtagatattttcaagtggttttaagactcagtcctataatgctgtacaaaaacatagtccatgcccattttgtttaaggcacaaagttcaatgtgagaattcaacaagaccaagacatggttcttgccctccagacacaacgtagatggggagagaaaaaaacaaaggccaatcacagctcacagtgagtctcccttacagaaggatgaggaaatggaactgctagaggagcacacagcaggaccacgaagcccagggttcatggatgtgcagacagcagtctggaggttgcacaggagacaaggcacagaagaggagctcaacagcacatcaggcaaaaaacaaaattactaatatatagtttcaaaaagccttgacaaactggaggaactaaaagtattaagaatagcaggaaggtagataaaagcagtggatggagtagcaagaaacaggccaggaaagagggtacatgtgagatcatgaagggccttgtgagccattgagaggagtttggatgccatcctgaaggtagttgggatcttccatagggatatagccaggataaagatgatgagtcacgttttagaatctctggactgtagcgtagaaagaagactgcaggagtccaagactagagagaagtcaatcacgctgaggctgttgcggaattccagatgaaagatgatgacaggaatctgaggaatggcaatggccatgggaaaaatgtgagtattctatcagctgcttcttcaaggaccatctaaatttgttagatacagattatcaggtacaaaggtacatacaagaaagattcctggagctaagagctacttgagatcgtagcattctaatcactaaatacttcgttagtgctaaggaattctgttatgggttgaattgtgtacctcccaaaattcatatgttgaagtcttatccctcaatatctcagaatgtgactgtatttggagacagaatctttaaagaggtaattaaagtaaaataagattactagggtgggacattatccaatataactgatgtttttacaagaagacagaattaggacacaggcatgaatagagggaaggccatggaatggcacaaggagaaaaccatctaaaagtcaaggagagaggcctcagagaaaaacaactatgccaacatcttggacttctggcctccagaactatgagaaaataaatttctgttatttaagccacccagtctgtggtactttgttatggcaaccctagaaaactaatttaggctctaaagggtcggcatttgtattactaaagcatagtcaaaagatacctcatttgtcagctaataaacgtggatttttactagggactgtacatacagaaaggaataaaacagtttcttctttcatagaatcacagtccagggaacagaaagtcaattaatcagtaatgattataaaaattacaagtgatgttaaagagtcatgcaaaggatactaggggaacatagagctggggcacttcagcatcagcacaggggtaaaaagtttctcaggggaggtgagactgccttgaaagataaaatggaactggagaagacaaagaaaggcatttcaggttggatgaatcctataagcaaatgtacactgtaatcactgtaagcaatatggcatgattagaacatggtgtgtatcaatacaagacagtcagtgaccatataacgaagggctttgtaagcagcatctagtttccagactttattctttaaagctgtggtgagtaattaaaggacttttaggcaaatatatgacatgatagtattattttttaattttagagaaatcactgtggtgacagatcagagggaggatggcagagaagcaagaatatgaattagagaaatattgccataatgtcaggcaaagcaagactttgtgaattatgtctaagtggtggtgatgaagaagataggatagatttgagatacagtaaagacaacagagatcatggtagagtaagggcaaaagatgaatgaaaagatgggatctagttttctgatttgacatccatccttagtgtttcacttctttccactgcatacataaatccaataaaccagcctacatggacatctatgcatgatcttgtccctgtctaactcccaggcaatgcgcaaccatcatttagcaatcctccttagtccttttagtgttcttccatggacttttacagtacatgattatgtatttgtttgattttatttttattttaaaaagtgggctttaaattttaggttatattcctaagaatcacttaagggtttacttaaaatgcatatttctcgttcttagagattacaactcataggtttgagaaagaaccctatgttggcatgtttaaaagaatccctccttcctctagtgattctgacacatgcaagtaatgaactgtactttgctaagccactaattaaaagtttattttcctaagaagagtagaagtcaggtctgattttccaccactgtgttccagatcctaacatcatgactaagacctaataggcatcaataactatttttgaatgaatgaagaaagactaaaatgccatgtgaataggtagtggtatccttcactgaaaaggggcgtacaagggaatgactggttttgaaaggccgatcatgacttagttcatgggtttgtgagccaagtgtgcctagaggtaaagatttcaaaggcacaggtatatgcaaggcaattgaggtcatgaatatttatgagagagctctctcccacagacatgatgaaaaatacaaagagaagatggcacaaatggatcactggaaagagtcaatttaagaagcacactcaggaagaccagtggaaaacgatgtaaaaacatgatcaaatggtaactagggaagaatctagtccacagtgcaagaggccaatcaaatagttaatttcaggaatgatgaagtagttggcaatgtatgaagacagtaatatttcataaccataggatttgaaaatttaggggccttggttaccttcatgagataagttttctgtgaagtctctcttatctactttgctccagacaggtagatatgttcctcctctgtatttcatcctcctccaagacatatttttattgtaacactttggcattatatggtgattatctgttgatgtgtttatttccccaccagactgacagcacattaatctcaaggaccacccaacccctatataagacttaggacttagtaggagttccatgtttgataaatatataacttgattaataaatagaacatgtgataaactagtctatgactagaaatgtataacttctctctatttagtgttttgagtaggcctggctttaggcagtaggcagatgggagtactaaacttatcgtttcctaaatctgtgtggtctctagattatgtcatccgcagcttcagagaagctaattttgaggagactaagtaccctgaccgcatacctcacaaggatgtttggaagacctaacaaattaatattttgaaagtttatttattattattattattattttgagacagagtctcactctgttgcccaggctggaatgaggtgacacgatctcagctcactgcaacctccgcctcccgggttcagacgattctcctgcctcagcctcccgagtagctgggactaaggtgcacgccaccacgccctgctaatttttgtatttttagtagagacggggtttcaccatattggtcaggctggtctcaaactcctgacctcatgatccgcccgcctcggcctcccaaagtgctgggattacagacatgagccaccgcacctggccttcaaagtattttatgaacagatgatgtggaagacagaaactctgcaggttcctttattaggactgagaggagcactggagaaaagatatccacgctctacccatcattaaatacagctggtctgtctaaaaattatatcagaagcaaaaagtcaaaagccaccatctctggatttcatccagatctgctattacttgtttttatcgtccgacaatctcagctcttaataatggtttctgatatttgttacatgaagtgccccatctttcactcaagttctatgcagaaaaagccacgtaaaagagtgccttctccccttaactctgagtccacggatggtggcatcttgagtgtgcatgttggcgtatgtattgtggatgcggtggtttaagggaagggtgcaggaagtcagacctgtaatattttgggtaaatgggatgtaataaccttattataaggcttcaccccaacacagtgcatatgcaaatatgcagggcacatatggtatttgttgcaagactattgaagtagaataatcttttcccttaaattttaacttatgataattctaatttggatatcacagagtgaccatttttaattgaagccattgagttatgtttttgttactatgttcatgtttatattatagatggccaaatttagagtttcaaataatttccttcaaaaaaatattttcaggtaggattacttcatctgaatgtttaccataaaaattactattttagctattttaatgtgatatttttgtgaatagtatttaaaagtactatagtattcatgtttttaaacttaaaagtcagctaaattttaaaatatgacttaaatgttatacataaataattacattgaatctatatggtcagtactttataataactaaatctaattaaattgatccttcattgctaataagtagaagttaataatactaaaatgagctcagaactagtactccctaatggcaattctgcaaattttcagaatatttcatttaattatgtacatttcttttttccatgtactaatttgattcctgcatgcagaaactaagataattcattttaaattattctgtgatattttgaacaacataggagatgttctgttcagtgcaaaacacttacccatttcagtgttagcccatatgactcaacgttcatttaatgcaatctatagagggttacaggaacacgtgtcttcagaatgttaaagatagccaaagaggtttggaatgaatattttcagtggcaagctattttatattagtaaacaaacaaaacataaagatgataataatagtaataataataacatttattgaggacatactatgtgtcagattgttctaatcacttaacatttagtgcttataacaaccccgtgagttaagtattttcctcatattttgtttaaagaaatacagaacagtagttgatatgcatcacatcacacagctattaaatgatgtccaatagattcgagtccagggtgactactgaatcacattttactgtctctcctcaatgctcccggggcagtgcatgaccaataataggtagccaaaatgttttgaaaaccaactctattaggaacatcccatccagaaaagggagcagaggagataggagacagtgaagtcagcataaggcatttaaaataatcgtccaagtgaagggaatatggccctagtcaggggaggccttagacaggagcaggggatgaatgagtcaggccaggcaatcagttcactgagaatagaaaagaaagggtaagtttaaaacagatttagaaagaagcagcaaaataatttggtagtaatttatttaaaggattggttctcacaggacacttagaataaggtaaatgtttgtttcatggtttgagaatgctacatcctagtgattccttttccctcataatcattacagtaagatactctctccagctaggattattctagtcattacattccatatgaggcatcataatcattttggtatgaatttagcatgttttagtcaaagtaaccctaaatggaactcttgctacaaagtaaatcaaggggttttttggatgcaaggcacctggcacagttggtactgggataccatcgtgaaattagttttaccaagtaaaaatctgaatcctgagttttgagttttccagttcttttttcccacctaggtcatggaatactattagccagccttacacaattaacaagggatctgaagattcatctttgggaatttttagatttagcaacataaaagatcaaaatgttatgatattaggtgatttttcaatgaagttctctgtcaacagactcatccaagtgcaaagagttttaaatcagcgttatagtgcacccttacatataaatggaagtccaaagatcactgggcatttaaagaaattttctgccatgcaaaatcaacattaaacaaatagagagaaaagtaatttggggaaaatagtctttttccccaatgcatggagagggaggcatctaaagttattataactccagagatttttttaaaaatagatgcatgaaataggaaatttctattaaaaaattcagaaagcataaaagaataaattaactataattattatgtttaataatatatctgatacattatcattcattattattcataataaattataattctggataataattataattgattataatctcagaaatgaagactcaatagaataatttgaaggtaaagctgagataatctcccagaaatttaagcaaaaagacatacagaaataaatgaagcaaaaaagttaattaaagataatttcagcatgcccaataattataagaagaattcatggaaaagcaaatagggagttggaatcattaaacaaaaatatcaaaatttttccagaatgaaagtatatgaaattctagattaaaacattctactgagattccagcacaacatataaaaatatacaaacattagtttatatcttgcagaaatgtcagaatcccgagaacaaatagatcataaaagattctggagaacgaaagaaacaaaatgaaaaaaaaaacctagttgatgtgctgaacctaaataagaaaataagtgaaggaagagggggagttggctacaggaaataggagatacgccacaaaaaagatgtgaatccaccacaaaaagatgcgaagaatatcctcagaacggcagtcaagggagatcctaggatgcaagctgtgctgtccacctagacaggtaccagtctaaattggagaagccggagagactctctaagaacatgaactttaacatcacacactggggcctgtcgtggggtggagggatgaggagggatagcattaggagaaatgcctaatgtagatggcgagttgatgggtgaagcaaaccaacatggcacatgtatacatatgtaacaaacctgcacattgtgcacatgtaacctagaacttaaagtataataataaaaaaaaaaaggacataaactggttaactatccaaatatcctctggtagaaagtttgggagaaatcgtccttaagtatataaaaaacaaactttaattatataaaaaccaaaacagaaacactaagtatttaaacagataactttaaaaattacggttactagctataaggacaacaaaaaaaatttccaagaaaataaaagtaatcaaagcataacaggtgacacagttatgagcagcatctatatgcccatgataatgtaaggtatggtgtagctacattgggaagatgataggagaggaagtgtaaataacagggttaaaatagatataaaggagataattcctcatttcctatggtgagaagtcaatataaacaaacatagcagaaaagtaagaagtagaaagtgtgagcaagttattcaggagagaagagtaaaacacatcaaggacccattaatttaaaaatttgactgtagttgactttgggcatctgaaactaggggcagaagtactaggggctgccatcttcgaaacgagcttagtgggaccaatggactttcaaaatcataagtataaataaatttaataagcattttaaagaagagcaagttgaaatgaaaagttaagaaacctaactgaaaaggaagacagataagaaacaaagtagggagagctaaaagtgaaatgtcaaatttaaatccacatagaaaacaatgaagtacagggtagagtttgtataaaatcaaatcattaatgtagaaaccacataaagcttcttcctcaaaccactgaagaaaacaatacagacatggaaaatataatggaaaatatggaagaaaagagaagacagaggctattgagagaattatagatgattaacatttctgatggggaaatccaaacagctgttatagaaaaataaaatcaaagatatgaggaaagattttttttttctgaagaaacatctgtgcaaatagattgaaagtcaaaatcaatggaaagaactgacaaaacataagattattttggtggggaattacaagttaaagaaaagcccaataaaattcaagcaaggacccccacccctgacaaaatcatctagtaaaaatcttttaaaaagatagtctcaagttttgatgcagccttctcattatcttttacttctaaatggtcctgattgcacttttgacgtgacttactgaaaagttattatttaatttctaaatggttgtagtttatgtttatacatatatttctagttattctgccacaatacaaatgcagaataaaaagaagcgtaatactttttaggagaaactcttatgatcacataattaataatatgacaaggtttattttacatttgaggactagagagaaactctcagatatacaatcattcagaaaatataacatttaaagacactttactgggaaaaattacctgaatatgtaatgcaataaactacaaattcaaacttgagaagtccaataaaggagccataatgtaaaagaaatgactgtgattgctgaaacatgtgagaaacctacaaaaatgtgagtaaagttcattataaaacaggattacattatcaacaatagttatgaaggatatataatgtaaatgtaagaatataataagaataatctagatccaagcacccaggtctcaatgaaaatataacttgcatgttgttttatgggcaacaaagcaaacagcaataaaaaaaaaactgttagaaaaatgacaaattgacaagttccagagtagagtgaaaatgttttttgtttttttgtttttttgtttttttttccgagacggtctccctctgtccccaggctggagtgcagtggagtgatctcggttcactgcaacctctgcctcccgggttcaagcaattctcctgcctcagtcccccgagcaactgggactacaggcacacgccaccacgcctggctaatttttgtatttttagtagagatgggtctcaccatgttggccaggatggtctcaatctcttgacctcatgatccacccgcctcagcctcccaaagtgctgggattacaggcataagccaccgcacccggccgaaaaagtatttttaaaaatgaatcataaatttcttaatagattaaaagtttttttaaagaaaactttgtttaggccacattttctgataactttgtagaaaaactagaaataaataaaattataaacatataatgcaaccacttagaaattaaacaataactctttccaattagtcaggtcaaaagtgcaattaagaccatttagaaataaaagataatgagaaagctgcatcaaaactcaagtgttacacacaaatctgtacttataacaaaaatttgtattattcaatgttttattttaaaatagaaaataataaaaataaatgaacttagtattaattatagagggtaggcacaaatgatacataatactataagaagtagagggaataattaataataaaagacttagaaacagaataatggtgaattaattaaaaagaaaatccaagaacagtttctatggaatagccagttgaaattacagatacctggcaagtctaattgagggagaaaaaaaagagaggaaaaaactcaaatacacagcctggactctgacatacagatgtaattataaatacaaaaaaggaaaataataaaataccatatttattaaataaaataataatataacataatataatattgctgtattgctttttaaacatccctggtctcccatgccttgaaaataccatctgtgacatagttgtattctttaactgctgcattctttttctttcttcaccatacctttagaagcaatgttttatgtcccctgtaccatcttccccatgcaaaatagcttttacaatctattcattttaaaggctcacgagaaaggtatcagcattcaaatctaatggcctcttttctatctacctcttttttgaagccctccttacttgagatctgaacactatcactattatttctctcttgtcatgaatgctggttcactattcttgttgatagttcccctatgactgcccatggttttatccttaatattttttgacttgtctttgtcagaggtcccaactattccttggccttaaacatcattgctgtacttcaatcctgatcttgttacttatgaactagaacatttccaatgtcctgctgaccaagcgctgtgagatagaactaaagtatgagacataaagctcatcatgtctacaaatggattcaccatttggcctaaacattttcttcttgattctccaatttttttcagctcagttttatgccctgtattggcaaccatacgtaatttttttttttatccatccatggttttttctggccctgctggaaccatttatcataatgccattccttgactaccacaaagggaacgtagctagctttctttctcttctaatccatcttgcacatagaaatcggggacagataaaaatactcttaacattctctttgtttacttgtttacttctctaatgaaaatttacaacttctcacaggttacaaagcaaaataaacattagtaacctgactttatgccctcaaacactctttcccaatctaccttttgagcatcacataaaatgcccatatgaaaattatatgcttcactcaatttttgtattcatcttcttttacatgtctctatttactcttgttttgcctctgctttgaagaccattcttccattcctagctgtcaacacactactatttcttcaagaattatttcaaatgcctcgtccgttaatttgtccccgatcacttgaatcataagtggtccatccctcctctcacatcatgcaattttgttggtatcatttgtatgataatttcattatgctcctatattataatgaactcctctattagttttaactattctttaagtcaggaaccatgcctaatatgtaccttaaaaatgccttatactttggctccatattattttacttaagctagcatttgcacaaaaaaggtgctaataatatttttaatgtatgtacaatcttgagataatataatccaactttcaatttttgtaagtattaggaaataatagcataaacataataaagcaaatatgtgctatcattctttgggcacttttgagaattatacaatacaagctaatactccaaaatccatttctatatactttctcttcattgtacaaactttccaggattgaatatccagttaacctaactctgaaatataaaatagaatgtataatggcaaaattcctaagtatttactatgtgttatttgttggccaaagcattttagctaattacatttatttaaaatggttatacatgttattggtctggtttatctttaaataggaaaatctatcttttgtcattataaatttccagtttccaatgataaaatcattctacataacttgaaagccatattgacaaggcactttgaaaattttcatctttaaataaacattaggttttcaaattaggtcaggatttaagtctcttatttataacttactaaatgtatttccctgagcctcaatttccccatctgagaaaataaatcagtaaaaccttacttcaaatgatttttcagtattgaatggatgaatccatataaagaacctagaacagggtaggcataatagtcatagttagcaataatcatcatcatcaacaaccaccaccaatccctcctcctgttcactcacctacttattctgcctaacaccatagctgctgctattcttcttcctaaaataaatgtgatgtatcccctacttcctgcttaaattggatagagattctattttctatttcccattttaacatctctataataaacaacagataaattatttttaaaaaatcccaaatgtactcttctttgtataaaatttattccagaaaatgtacagctctggtgtaccattgctataatttcattaccatgtaactgatacatttcatgtgacatattctgttgggttattttaattaaataagcacaatgttgaagctctaatttttttcacttttaaaatggaatgaaatattaaaatgccagctttgtgaccttgtcttctccaaaacaatattttgtttgaccaaaagtagttctgaaaggtgaattcgtcacatgaatgaataaaactcaatgtaatactctgcttggggtggattataacctgtctccgtctcccaatgcataacatgaaccctctagtacatctaatacatctagttttgaatatattaagaatatcacatggtagtaatctgaacttagactcagatattgaatgcttagaggctaacctaatacccaattgtattgattacaatacaaaatatggtttcactgcactcatctcaagagatttgttaggtgatgatgtttgtaaaaatggatatacagctggaaagcaattcaatgatagcttatcaatcaaaatataagcgtacacttaaacataagaggaaagctgaaggcattttggatttccagtggcagggcagttagtttcattactcaccaaattgcaaaagatacaaaatgggatttgctcccaatgttcatggtactcttttgtactttattttatttttcattttcaatgcctatcttctgcaagtacatatttaataatgtatcattgtttcatatttggaaaaatatattccaatcttttctcaaagaaatgaaatttaaaatgaattaagtgcttcctaaaattgtttaagctattagtttcagtgtaaaggaacagaaaatggcacatctttaattactaaatgtgtaaatacagacataagatttttttaaattgtagataaaaataaaaacaaaaagataagttttagagaaaccaactcaataataaatcaagcaaaagggtaataagggaggccaggtgcagtggctcatgcctgtaatcccagcactttgggaggctgaggtgggcagacagcttgagctaagaagtttgagaccagccaagataacatagcaagacccaatttctacaaataataataataataataataataattagcctgatgtggtagcacatgcctgtagttccagctactcaggaagctgaggtggaaggattgcttgagcccaggaggttgaggctgcagtgagttatgatcgtgccactgcactccagcctgagtgacagaatgaaaccctatttcaaaaaaactaaaattaaaaagagtcacaaggaagaaaagaacaaaaggcaaagcacatggtatataacaaaaactagaaatagtctgcttagaggaagaaatgagatagaaagtatagttaaacaaaattatttttataaaagttttcagaaatagtttttcttaaattttctgtttttgtttccagtctttctttttattgtcatatatgttatttttagggcactaaattacataactttgtttctaatatattactaacatcatatggttaagatttatcattcttaaagaacttcctgttttgtttggcaaataataggataaatgtaagaagaaaagagtaagttggaatttgagattccaatttgtggcacagaaattcctctttttagaatggaaatgatggatgtgttgcctataactcaaaatgaaaatgtgagagcagtaagaataaattatgatgttaaaactcaaagaaacacttaaaaacaaaacaaagaacataaataaaattatttagaacagaaacaccaatagaacaaaacagacgcaatttatctttttgatagattcatagaaagcttaatctggtgcatgtgaataggggagagtaaggtacaatttatagtcgatcccatgacacggtactaagttaggttgcagagtgctcatagctggatgtgaagaagcaaactacgtaaatgatgaaaggagattcctattaattgctcaggccaagagactatcttcatagcctgggctaaggggtaggcagaataaccaacagtgtatggttaaatttatcttgcgtcactaccagacaatgctaagaacagctataaactagaatccctgtcttgtcacacagaaatatgatccaaacataaatcagatccattaattattggaaatgaacaattaccacaaatacctgcatttactatatttgttatatttcatattcttattaatttgtccagttattgtttataattgttcttatatcaaattatttttaaagcaaaacaatttattacgagggtttctgctatttgacacttcagatcagtaaatgaagcacctactagcagtttgttactgttgttcaaactttatagctctgtttagctcagttttctattcagtgtttgtttacttgtacagatgcaaatgctcactttattcttcctaaaatatgtgtggaatacaaatgctctcagattgaatccctctttgaaccacacatttgaatattttctgcttaatatttgctaatgcccatgaaaagaaatttgattgactgtaaaaggacatatcaaggaaaactcatatctcagaatactaaaatgaagtacaatgactatctctacaaagcaccaaaaacatccagttgaaatgtgaacatattcccaactctgaaaaaccaaaagcagcttgagcactttcttacccttacttccccaaataataaattatcttggggttggatacatatagttgaagaattatccccttgtttaaagttacttgaatgagagacaaaatacttcgtatccatgaaatgaaataactcatgaaagcagctgcatgtttgaataatttcagttctcaaagtcagtcaagcctttaaaactagttattgttttgtgtttttcatattagtacctactattgtaaatcctcaaaccaaggctcagggatgacactactagagtgacaatggagaagcagttctcctctttaaaaaaaaaaaaaaaaaaaaaaaagtgggccaggtgtggtagctcatgtctgcaatctcagcactttgggaggccgaggtgggtggatcacctgaggtcaggagttcaagaccagcctggccaacatggtgaaaccccgtctctactaaaaatacaaaaattagccaggtgtggtggcagacgcctgtaatcacagctactcgggaggctgaggcaggagaattgcttgaacgcaggaggcagaggttgcagtgagctgagattgcaccactgcacttcagcctgggtgacagagcaagactccgtcttgaaaaaaagaaaaaaatgtgtccacaattttgattagaaaactttcctctttttcacgagagaacctccagtcttgtaaatgtcagtcatggttcagattatttattttaaaaagatgtaatcaaaagactccaaatgtatgtatttttgttccaaaaatgcattttgcctctaaagagaatgtcagttctattccattgtctttagtttctttccctaatcagatataaatgaaagacttattcattggtgtccattggtgtctttagttttatttgtaattcataaaactacttgaaagaaatatggatatactattaagtattgttttcaagtaaagggccaaggaacagcacaaagaagaaacagaaagaaaaagataagatagagccctattcttgctctgaaaaatgagctgcctgtggggaagctgctcccctaaagaagggatcagggatatcttcctgtgatattcactggaatactgtctcccaacagacactggcaagtgcagaagacctcacactgccttgctggcgattttctcctcaatagagtatatttaagaagaaaactttgaaatcttaaaagagagcaaaggcagcggtattagggtaagactggataatgctctggatccattaccataaggatagcaaataacaaagaaaagtaaaatgtatctgacagagacgggctcaggtgctcagttaccaccttggaatcactcttggtccatccttactgtctctgtacatttttctcgcacaccagcacagggcacttctttgctgcttctgtttccatcttgccaggatccatcttcacttttgtgacaatcttcctttcagttttagtaaaacaaccacaagtggcgatcgtaagaaatttctggaaattccccattgttgctgtacaacacttcctattataaaattcactgtgagtaaagaattaaaatatgaaattctagctaataccaatgtaatgagtagctctaaaaaagttttaatgttttcttagtaagatctttttattcattcattgtcatatcttattcatctttgcatgctcagaatttgggcaaactgtaaaaatagaaatatggcaacatatgtgtatgacaaagtacgtatatatgtatgtgtatattgacaaagtatgtgtatatgtatgtatattatatatatacactatatatatgtgcttgctaggcacatggtgaataccaaaaagtaatataaagatgtactttaagtttgttttaaactataaattataaaggaattctggtttcacaaaataataaatcagaagagaataatttttagaattaaaattaacataaattcatactaacatatggcatctgttactggatttgaagaattttcacagatcacatttataaggtacatttcaacaaatttataattcactgtcataaagcaacttgagtaagctcagggttaaaaaggtggaagggtaggatcaaaattctaggtagcatttatgatttgtggtaggttagcagagagttaagtacatgtaagtaccacagtgaagagcaaaaatggctaatagcttacaactgtgtaccaagtatagttcagagttctttttatgtatttctttattaatcttaaaacatccctattgatatcataattgtacaattgaagaaaattacacaaagtgagaaaatctaatttgccaagggccatgtgtatatacatgtatatatacacataaagtaagtggcaaagctgtcctcaatctaggtagcttaaccacaaagccaccctctcaacctctgtatgcctctgtatgctgtttccaggaccttccagatgccaaaatccatggattctgaagtcttttatataagatggtgtaatatttgcttataacctacatgcatcctactgtatacttgaaatcatctctaggttaattacaatgcctcatacaatgtaaattctacgaagatagtttttatactgcattttttagggaataatgatgagaaaaaaaagtctttacatgtttagcacagacacaaccattccttttttttctgaatattttcaacctgtggttgactgaatccacagatgtggaacctgcagataccaagggctgactgtacctaaatggcctgtacaaagagcaataagtcatcattcaatatcaaaagtggtaaggaatcaggaaaacaaagatacattgcaaagaccaaagtagtgaatctaaccaaagaccaggaatagtttaggaatcaggaattcaagaatcaagctaggtggagcaatagcagctacaattagtgaagagagagacgggtactgatgcaaagcaccctcacatgtgtttttccagagcaaatcatggcttataagtggtgtgagtaatgtgcatagggaaatgggctccagatggctggaaagtcagaacaagtttgatactgatcttgaaggaagtgtcagctactggtaatcttttgcttttttttttttttttttttaaggcagacctttgctctacggcccaggctggagtgcagtggtgcgatctcggctcactgcaacctccgcctcctgggttcaagtgattctcatgcctcagcctcattctcatcccagcctgtaatctaggagctgggattacaggcatgtaccaccacaccaggccaatttttgcatttttagtagagacagggtttcatcatgttactccgactggtctcaaactactgacctcaagtgatccacccacctcggcctctcaaagtgctgggattacaggcatacgccaccacactgagccagctactggtaattttgacactagttggtaagctgttagcgctctccaactttaacaaacagattcaaacctcgtctcaattactgttgtgctggataattcttgaatagatcacattgtcttgtgcaacagttccttctaaaacacctttgagatggcttaacaacttatactgggaaaaaagtggtggacagtgtgtttagaatcagaactaaaaaatgctcaattgattctgtaagtccttccacctgtaaatctgagtatgaattggaactttcaggaatccacctggtatgaatgtaaactattactttaaattggaactgaaaatttcaattgtaggctcgatgtaagaatagtgagtttactgcctttgaaactcacccatgtctccatttgcaactggatatattttctctttgaaattctcttcaatcactctccagtcctgaatagcagcatcagtaattgtgtcaacagacatgatcattttatgatctgagaaagctggactgacaaatgcatcgccacttgaaatctaacctaaagatagaaacctgcattgtagagcagaaggctaagctgtacttacataacagcagcaacacttacaacctgtgctgcctttgctttattttttaaaggcatgaccgattttctatttcagatgacagaatattaaaatgttgggcagtgatgttttcaaatccacataatttttagtctatatcagtgataatataagtcactgattttttaaccggaagtcaggttagcagcaagatttctaattataactcattgctaatatttcatatggcttataaaacctatgaataacattgatttatgtaatggaaactcagaaaagaatagagaaaattatataaaaattactgtattcttggatcagaaattctagaaagatgtttgtttatattttgagatttcaagcagcaggggggaatgcttttagtcagccttctattgttatctataaaagagtgaataaataaataaaaatctctgcatagagatgaaatgaaccagcaaaataccaaaggaaactaacaccacagataagatttactgatcaaaattcactgtttttgtgtaggaacacagcatggtaaataggccttatataataaatacattattttctataacagatttctccaagaagacccaaaatgctataaagcagcactgcaataattctataaatatcattttgaagtactagcattccaatttcaagaaataattaaacaattctgaagttgatgacatttaggaatgggataaggacagtattgctattcaatagaaatgaatcaaatgcatatttatcaagttggctaaataggaatgctaagaaaatatacacataaatgataatcctttaagtaatttcattattatagcagcccatgaaatcatgtgagctttttcaatcctctctttaatttgaacttattgtaaacatttgacgttcaatactagaaatcagatcttttatctaagacttgattagtcagctttacttccttgtgacagacacactacatggtctactaatcctatcagctgtccacacattgaaatatatattcctgctcaaatctttatttcactcaggttaaccataattgccattattggcaccttttgtcttgtacttcctcagaaaaaacagctacgaaagtagtaaaataggccaggcgcagtggctcacacctgtagtcccagcactttgggaggccaaggtgggcggatcacgaggtcaggagtttgagaccagcctggccaatatggtgaaaccgcatctccactaaaaatataaaaattagccgggcgtggtggctcgtgcctgtggtcctagctacttaggaggctgaggcagaagaattgcttgaacccagggcggaggttgcagtgagtcaagatcatgccaccacactccagcctgggcaacagagtgagactctgtttcaaaaaaaaaaggtagtaaaataaaaaccaatccaggatgctataccatattattaccaaaacaataacacaatggtctgatcaacagcagcagctatagattctccctcatttaaacttgaattatcttttattttatttatttttttattatttatttatttaattattattatactttaagttttagggtacatgtgcacaacgtgcaggtttgttacatatgtatacatgtgccatgttggtgtgctgcacccattaactggtcatttagcattaggtatatctcctaatgttatccctcccccctccccccaccccacaacagtccccagtgtgtgatgttccccttcctgtgtccatgtgttctcattgttcaattcccacctatgagtgagaacatgcggtgtttggtttttttgtccttgcgatagttcgctgagaatgagttcatgtcctttgtagagacatggatgaaactggaaaccattttatttatttaaaaattatatttattcatttctttcattttaagatgggaatgtgaatatagggcattttcttttaagattaataaataacatctaattgacacagtcttagaaaacattattcccctataccctgatatctgaaaatataattcagagggtgaatataaaaaattagacatgataaaaccataaactgctaagctggatgggtcattaaaaagagtgaactaaagtggagagagataaagtgtcttgctgtccaaagctttatgtaggagtatttggggaaaacactagataaagataaatcacaaaagatttacttgcatcaaaggcatcaccaaaaccttgtaattttctgtgataataggaatgtgtacactcccagtttatttcaaactgtttggtatgggtaacagaatggctggttggcttcccagttagtttttgagtcttaattaacaagggagtcctgggatcaggaatgtctattatattgaggttcaaagaaatgcaatactaagtgtttattgttgaagaaatgctcagttaatgtaaattaaataagaagtttcaatgtggaatataatctaagaatctaaatttaaacatgaaattcaggtacaatttattttaaaaataagcgaaggttgcccggcgtggtggctcacgcctgtaatcccagcactttgggaggccaaagggggcagatcacctgaggttgggagttcgagaccagcctgaccaacatggagaaaccctgttgctactgaaacatacaaaaaagttagccggtgtggtggcatatgcctgtaatcccagctacttgggaggctgaggcaggagaaccgcttgaacccaggaggcagatattgcggtgagccgagaccataccactgcactccagcctgggcaacaagagcaaaactccatctcaaataaataaataagcaaaggttttaaataaacaagctctaaatgtcaaaaagatgacccaaagatttactaaagaaatatatggttaactaattattataacaaatgtatccaagctgtttccgtactgcccattgtacaatatgtggatatgatgtttgaaagcttagaagcctgttataatgaacgtagtaatcgcatgccccttagcacttacgtgtgcttcctcatgttacactgcacttaggcatctggccttgtataatacacaggcataacattctacccctcggtgatttacggcatcaacagtaattttaaattcttgatattttgaaacattcttcttaagttctcttttataatatcaaaacttctacttgccctgtggtttttttttaaaaaaaaaacatatttaatcaaaaatattcattatttctcatgtcaacagtgcaaatactaagaaattgtagtgtaacagaatgttgagtaggatttttcctttacctggaaatccaggtaaatcctaaagctgaaaggtctgggaagagcttcccaaaaactacctttactttacattctaagaggagtcagagagccatcctgaaggccaaccaagacatgccagaggcagccctacttgagcaagttcccatccactcttcctcttaaatctcattttttagggagaaaactgagagggaagggctcaagggcatcaagctgtggcttgtcagcctctgggaaagagccatgtttaggggagtggctttggctctttccctcaaaaggacagttctccaactgaaccacttgtggagactgctggtagctgcataaaaagatatcctaggtggatatttgctgaccaacaaaacctacaggtatacttggggctaccacaacagagaaggatggtaagatagtttattttagaacttcctgatgcatgaaatttattgatttctcacatgtgtgaaagtgtacattaacagagaaagtgcttatcgctagaaatttctaaaggctgcagaatttctggagaactctaaaccagtggtataaaaattataatagagtttcatcaggtccaaggcaaaaagttagggtgatggttatggttatatttaggtctagtagatggctaccagaaccctttggagatgaggaagagaaattagcagtttgggtggtcccacctccatgtgaaaaagaaatgaaagtcagatgatgggcaggtgccctagtcttttctagcagccactgggcaatgagacatctttcctagcaaaagtgttttaattgggggttttgatcaatagcaagggccaagagatgataggcctgctgttttctgaagggctcctcatcaaagaagatgctagttgaagctgaactcaactcaaggaagcaaagcacactactgatttggaaaccacctgtcagccatggttaccagcatatggaaccagactgaaccagagtgaagtcaaagatatttccccattgcaactgatgccaatgaaataaaataaattataagagattgctaaaagcaattatattcagataaaccagataatctaaaagaaatggaaaaaaaacactagaaaaaacttaccaagactgaatcattaagaaatatgaagtctgaacatacctttaattagtgtggagattaaaccagtaataaaaaatgtccctacaaagaaaagtgcaggaccagatggcttaactgctgaattacaccaaatatttaaagatttaatgccaacccttctcaaactattccaaaaaaactgaagaggagagaacacttccaaactaattttttgaggccagcattaccctcataccaaagccaaatacaacaaaggaaaagaaagctaaaagccaatattcctgatgagtatagaagcaaaattctcaacaaaatacaagcaaatcaaatccaatagcacattaaaaggatcatacaccatggccaattgggatttatccctgagttgcaaggatggcaacatatgaaaatcaattaatcattaataaaggataaaaattccataatcatccaaatagaagcagaaaggcatttgatgaaattcaaccacaattccatataaaaactgacaagaaactaggactagaaggaaaatacctcaacataataaagaccacatatgaaaagcctacaggtaacatcacactcagtggtgaaaagttgaaagatcgggacaaaggcaaggatgcctactcttagcacttctattcaacgtggtaatggaagtcccagccagggcaattagacaagaaaagaaagtaaaaggtatccaaattggaaagaagcaaaattgtccctgtttgcagatgacatcattttatgtatagaaaactctaaagactcaattattaaaaaaacaaaacaaaacactgttagaacaaacaaattcaatagagttaaatgatacaaaatcaacataaaaatcaattgtattgctatgtattaatgacaaactatctgaaaaaattgggaaaacagtctcacttacaatagcatcacaaataataaaaatacctagaaataagcctaaggagatgaaagacttatatactgaaaattaaagaatattgatgaaagaaattaaagacacaaacaaatggaaagacatcctgtatttatggattagaaggcttaatattgtgaaaatgccagactactcaaagtgatctacagattctatgcaatccctatcaaaatcccaaagaaatttcatagaagtagaaaaaatcctaaaatttatattaaactataaaagaacccaaatagcaaagcaattttgagcaagaagaacacagcaggaggcatctcccttcctgatttcaaaatatattacaaagctacaaaaatcaaaatgataaggtactggtataaatacagacatataagccaatagaacagaatagagaccccagaaataaatctgtgaatatttggtcaaatgatcttcagtgaggatgccaagaatatacaatggggaaaggacagtcttttcaacaaatagtgttgggaaaactagatatccacatgcacaggaataaaactggcacttttattattgccatatgcaaaaatcaagtcaaaatggattaaagaactaaatgtaagacctgaaattataatattgctagaaaaaaataggagaaaatctccatgacattcatctaggcaatgatttgatgaatttgacatccaaagcattggcgaagaaaacaaaaataaacaagaggcactacatcaaccaaaaatcttctgcagagcaaagaaagcagtaaaatgacaatctatgaaatcagaaaacatacttgaaagtgatatatctgagaatgagttagttttcaaaattggtaagaaacttctacaactcaatagcaaaaaaactaacccaacttaaaatataggcagaatagttgaatacacatttatccaaagaagatctacaaatggacaatagctatgagaacaaatgctcaacattatttcctgatgatttgcataatcaggaaaatgcaaatcaaaatcacaatgaggtatcacctcacacctgtcagaatgactattatcaaaaaaacaaccaatgttggcaagcatatggagaaactggaacccttgcacactgttggtggaaatgaggaatggtgtagtcgctatggaatacagcatggaggttcctcaaaaggtaaaaatagaactaccccatgacccagcagtctcccttctgagtatttatccaaaagaattgaaatcagggtctcaaagagatattagtattcctatcttcaccacagtactgttcacaagagtcaagatgtggaaacaatctaaatgtttattggcagatgaacggaaaagaaaatgagatgcataaataccatgaaatattatttatcttttttaaagaggaaattccgcaatatgtgacaacataaacaaaccttaaggatattagctaaaggaaataagccagtaacagaaagacaaatactgcatgatctcactcctatgtggaatctaaagaagttggtctcatagaagttaagtttagaatggtggttaccacttatatgagtcgaatcatataataatcaaattcatagaatgagagtgggatggatgttgccagggaatgggggcaggaataaatgagaaattactcatcaacattttaaagtttcaattgagcaagatgaataagctctagagacctactggacaacattgtagctatagtcaacaataatgtattgtgcacttaaaaatttgttaaggggataaaaaatgatgagttcatgtcctttgtagggacatagatgaagctggaaaccatcattctcagcaaactatcacaaggacaaaaaaaccaaacaccgcattttctcactcataggtgggaattgaacaatgagaacacatggacacaggaaggggaacatcacacaccggggactgttgtggggtagggggaggggggagggatagcattaggagatatacctaatgtaaatgataagttaatgggtgcagcacacaaacatggcacatgcatacatatgtaacaaacctgcacgttgtgcacatgtaccctaaaacttaaataataaaaaatttgttaagagggtagatttcatgttaagtgtttttaattataatacaacagttttttaattgtgtatgcttttagtggtaaataaattagctctctggtgcaaaaaataaaataaaataaaaagatatttccccattactgataagcctccggttaggtaagaacttggtctcatgtataaatcctcattgctcccacccagctataaagagacaaaaataagatgttatatccagaaagagactatcaaccctggacccaccatcatccttgcccatgagtcctcattcatactttgattggacaaaataacatctctagtttacagtggaggatgtaaggggtaagcttcagagaggatatgaggattgctgtcctaaatgatggtgaattaattttaatagccaaaaattatcagaaagctatggaatctgcactcaactcttctacaggacagaaaaggaagaaataatatcttgtttatatctccaacaaattaaaattatttggtaaactagttaaaattataaaaagaaaagacatttgcctactgttttatattagttttagtgaggggctcaaagttggaaagaaaaacagaacagagataatgaggcaaagaaggaaggaagcttcaggagtgtgtatgtgcctcctctttacttagaccttcccaacatgaattcaatattctgtttaaagtgaacattcaagatatcaaacatatccatagttacgttaacagaaagaaaaatatatattccaaaactaaaatatttccacataagccattactttcatattttaaaactctattaacacaggtaattcggaactgatgtaagtctttaaaactaagttatttagggttacctgattagcatacaaaacatctgggtttctaggttacatttctccaagaaaactgcagagctcctccctctctctccctctgtctctcacctctgcagactattatttaaacttcatataattgggagttgagaagattttttaaatgactgactttgaagtaaatgattattcctaaatttatatgcagatcattaaactgataaaaagtactacaaaaatttatgttgtccttcattttcattataaatgaccacattaaagtttaaaaatattgatcaagctacaaaataaagggaatgattcttccataagattttgataatcttaaaattaaatcaaaacaaagggtgctgctagagcctatttggtgacttcagcattgtgacaattgtttgtagctctttaataagttggaaatcatttcaaagggatttgggatctagccaagatgaaacgtactgagcaactataaaatcactatcaaggttgatactactgcaaggaaaatcaaaaagaaaaaacaatcaggatacataatcctgaataaataaaccagagaagaacaatgcctttgtcaatcacctgctaaacagcagtgattcagccccatactctgaagacttttcaaaattccactctattatacttcttcaaattgttttctttccatttatgccccaaagtttagctgctccaatgaacacacaaaagatccacaactatctaacaagaaaaattttgtttctcctctcaaatcagtgggccatctaaagactgggtagtttcttactctagttttgttttgtattttacataatgtagtcacaagccaatgtttctctaatttgttccttaaaatgaagctggcaaaagtgccacataactattgtttgcacagaggtactttccaacctgggtatttaatgaccatgacaggctccatgtatccacatgtttgttcccccaagacatactgaacttcttcaaaaagaaacaaaaatgctgaaagtgaattttatttttaattatattctactacaggaagaaaacgacactttgtgtccacatcagagctgccagtcaaatactgacacaccagtaattctctagcagtgttagcacagagtcactaaaattggaatgaaaccacatggagaactcagggaggaagcgttctgtaggaactgttcatcagttttgctgtgacaatagaaggggccaagtggtttctctcagtaatgtgtggtaaagcgtgtcttttcccacatcctgccagcaatataaattatccaaaaatgcagtctcatccatttagaaagaaaatctactctattatcagctgcaaggtgttagaactctaagctgaatacagaaaggcaaattacaggcacctaagtcaatcctaggtctgccagtttttcacatctaaacaatatcattcttagacatcatcctttttaaattccagtccttaaaaatgcttggagttatcaacgagggcttgaagaacaacttatccccataagatgtaattttctttctccatagtcacctgaattgagtctattatttatccacatggatttcatgaccagaacattctgattttcactgtaactcttccctggctccagattacatcaagttttctaatttccttgattcttaaactaacttgatattttcttttgttgtctattgcctttttcttttccctagctacttccttctcatcttgtttattttcaatcaatactttgccctatgcccactctctatattacatattcatatgttctggccttctgtaatttcatttgtaatttcagttcacctgtacttccccactgggagacagtgtagaacagtgttggatgaaaaatccttgcataagtgagcatgaagtgggatatgggtcctagacatctgtcaggtaggatacttcttaaattataactttagggctcaaagcattaagccactccagctgcaatagcctacttcattgtatgaatataaaataaactagacattagaaattcaaaatatctcctgtactcctagacagcaatccacccactgacaagaagtctctaaagaagtttttataagtggtaacaatgaataattttgcactagtcccatcacccatttattggaaggttgaagacttattgaaaaacatcttcctttacctgtatgccactgacactaaattataaaactactaaaaatttcaggagcattctctggcattccccccattacccctacccataggaattaccatgacacttcccctggctactccagctcaggaaaaccagacttgggaaagagcaacaacacaatccaagactctttctgaaaataggtgtctagttgattcacatcttctttcataaataccccaaaaagttgagatccccaaaccttggcttttcagaacatatattcagaatgtcagcagaatgagttgtgatgatattcaaataccatttctgtgatgtttgtcactttttttctaaatctaattgtctgcataaccaacaggcaactaccctcttcataaatgaggcaacattgcatgaggtcactttcaaaccacactgacacagctggcctaggacctggctcatgacttgctgttcatcgctccagagcccttctcagtctaagtatgcaagagagaataaagtcattagagatcatgtaattatacaaaatgtaaaggaaatcattactaatacaagaaatttttaataaatatcagaaatataaagtagaagtccataggttgatagataaaaataagtagaaaattcacaaactgaaatatactgcaagacagcttcaattacaatctattttcccaaagggaaccccatggagacacagcacacagagataggaagtaatttagattttatgagatttaaatgagattaaatactgtactgaaaataaagagtctaactacagagccattgatgatctatatacaggacaaggatgggagacccatcccactcaactggcatttacccctgggcaagaaaccagagggctcttctttaagaaaatgaacaaaattctgggaatagtaagatttctagtgtgtgtgctggcccttcccataggaacaaatatcctctttgcctgccaacaagtatttcccactctcctttgatctgcatagagtctgaatccctgggctgccttccccttcagatcagaaatctagggcaaaaacaagtcaatcgtttttcatagcagcagaggagaccaattccaaatatacaggattttttttttttttttgagatggagtctcaccctgtcacccaggctggaatgcaatggcatgatctcggctcactgcaacctctgcctcctgggtaaaagtgatactcctgcctcagcctcccgagtagctgggattacagatgcatgccaccatgcctggttaattttttctatctttagtacagatggggtttcaccatgttgggccaggctggtctcgaactcctgacctcgtgatcctcctgcctcgacctcccaaagtgctgggattacaggcataagccaccacacctggccccaggaatgtcttaaaccatgtaccaccacatagcaggagaggacagaagataaaacgaaactctctggtcttggaagacactgaattattccaaagaaggaaaatgaacttttaaaagttataagtaatatagagactagagaggaaaatacaaccatacatacaaacataaaggataaaattgagaacatgtagaatgcataaagcaaaaagataaatatgagagacagtgttagcaagataaaggatcatcccacagagtattatttggttaagagaattccaaaaaataaagaccagagaagatttgtatggtataatatctataaaataatacaaagaaatattccaatgctgatagatagacatgaatgtctacatgacaacatccgatggctgctctgcacagggaatgctggaggatgccaagttacccctagtttcctacaaaggtatttgacttattattgacaatactaggtactaaaaataacaaagtaatacctttaaagttctgatggaaaattttctattattgtttccaaatccaacaaaactatcaattgaaatgtaagccagaataaagctatctataagacattttctgaggtaacttccttcctttgcacctatcctgggaatttcttttaggatgcactccaaacatgcagaagtaaactaagaaggaggaaaacctggaatccatgaaatgatattccatcccagaatggtagagaaaggagagaaagagggtagtttcatggtaaactaaaaagcaaccagcaaagctgaaaacaaggagacacagaggtacagaagtgacatcctaagggggttgaatgaagacccacaaagataatgaagacagagaaagacacagagagaatgcataaccacaaacggtgcaagaaaaactaaaagaatgatgattggaaacaacattaaaattttttaaatctaaatataaagcaagtaaaaatgcattagaacgttaagcgatagactgaatataagagaagacaattcaggtgaccttgatgccagcaacatcctcttttaaatggccccaggtttatggtgtcagatattttgaagtgggaaatggaatcttagtccagaacttaaataatgtttacacagtcatcataatgtaaatgtttgttttctcctattagagtcaacccaggaacaaagaaaaagaaaattttattattctcacaggatagaatgccagtgttcacaatgggatgatgtaaaagtgtggctcaaaacaaacaaacaaaaaataagttgtatatgtgagaagaaatagtagagcaaagtatatatattttagcattttttaatgaaacagggagtcaagatatatgtcaaaaagctgtaaccaaaaatagaggattaagtatacttttctggggccacaaaatttactagaagaaaaatcagaatctcaaaaatatacaaagcaagctttggggagggaagagggtataaaagacagcaaaagtaaacaaattcttacctttatttcattttatttattttttaattttttttttttgagacagagtctcactctatcactgagactagaattcagtggcattatctcggctcattgcaacgtccgcctcccgggttcaagtgattctccttcctcagcctctcaagtagcttggactacagggagtgtgccaccatgcctggctaatttttgaatttttagtagagacagggtttcaccatgttgctcaggctggtctcaaactcctgagagtcaggtgatccatccaccttggcttcccaaagtgctgggattacaggcatgagccaccatgcccatcctcaaattccaacctttcttatcacattctcagaaaataacctaatagatgaagaagttgaggtataatacttgtagttattaacaaaaatactgcaaacaattcaaaaaggttgcctctctaaggaggtccaaaggtctggagaagtgaaatcagatattcttgcttttgacttaaagcaatcttctaaaataaaaacttcaaaagaaattaagaagtaaaacttaaaacaccattttaaatgacactgttaccatcacccacctaccctggagaagaaatgcacatttctggcttcagccaatgaggcttgttcaatgttccaacactgaaccatagctattggtttaataaatataccattacatcaaaaccattactatagttactggcagaacattgaactcctcatcaatgtgggagataagcaactccactgattttggctggaatataatacagctcttagataaccttagagagttccagcatgactgactgcaggcttggcaagcagtccagtaagtctgtaaacagagactaaagggatattaaaaaagaatgtgatgaatttggaaaaccatgtattcatcataacacattccaatgctggatgtgtcatctctaaggagttagggattttcccacctattatacggtcagtgatgaagctacatcttcaggactgaggtttgaaatcttactacctgaatcttcagatgtgttttccaactctctcttcactttgctttttttctacagagttaagtctttgagtgctttgtgatctgaaatcccccaaggcaactaacattccacttctttttcattttctttttaattagacactcacagaatacactgtactattttttttagaaacaggctccttttaattttttttagactgttttgcagactggccccaagactacatctactatctgataccattgatcgacctgactgttaaggtgtggactcagcacttcctgtgaagaggttccctgatgaatactgactctattaggcaagggtagtataacatgactcacagtcttctgtcagccctattgaattccaagctctgtctcagaactggctcgaattctctggtgattccttttccctcagttaactttgagcaaccatatactataagggtagacaacagatcctctagggcaggggttcccagcccccaggccatagactggtaccggtttgtggcctgttaggaactgggctgcgtagcaggaggtgagcagcacaagcattactgcctgagttctgcctcctgtcagatcggcacaggcatcagattctcataggagtgtgagccctattgtgaactgagcatgcaagggatctaggatgcatacttgttatgagaatctaatgcctgatgatatgtcactgtctcccatcacccccagatggaactctgtagttgcaggaaaataagctcagggctcccactgattctacattatggtgagttgtataattatttcattatatattacaatgtattataataataatagaaataaagcacataataaatgtaatgcacttaaatcatcctgaaaccatccctctcaccccaagtccatggaaaaactgtcttctatgaaaccagtccctggtcccaaaaatgttggggaccgctgctatagggaataaaataaaatctgctacttgactcatgagttgtatctttgaacttaaggtaagaaaaaaaatttaaccaaaccaacataattgaataatcagatgtcaatgtggaactcagaaacattatccttgtttacatacacactgttttttgaaattgtaagcctgtgatactctcgcatttgtgagatgccaacccctaaaaaaaaattgtatttcctaaggcagtataatgagttttgctttctttcttatatttgtgtctctcttattttgagaacttaacttccaagtgcaatttttggtcttgaacccaaatatatttctctcatcacccaattattagctctcatccactcttctcccagaatggttactaacaagaaacatgatggaggctgatggaggcaaccactgtgtaatgcaaacagctttagtattggtcaaatgctatagctggagagtcatgagtaagccctttctagtctctgagctttggtttcctcatctgtaaatatgtttaacatctgcaaagtcaatgccccatgtagacagggcccagcattatgtaatatttaaaaactaaattctcaccaacattttgagaagtgattaaaatatttcttgatgtcactcacaaatggcaaaagaagactcaattcacagcacagagcaaacaaaaagtcattttccccaactttttgtattgttctgttttggttttttgttttgttttttgaggcagggtctcactctgtcacccaggttggagtgcagcgatgtgatctccacccactgcaacctccacctcctggcctcaagtgatcctcccacctcagtcccccaagtaactggaactacatgcacaagccaccatgcccagataatttttgtattttttgtagagacagggtttcaccatgttgcccagtctgatctcaaactcctgaggtgaagcgattcatccatctcggcctcccaaagtgcttggattagaggcataaaccaccacacccggcccccagcttttaatatctctaatacttgcaactatccttaaatctctttcttctgttaaacctctacagaaatcctctatcagcccacactgactgactctcatctctttttctctcttcccacctttttggtattttcattttctattccttaaaatgtcagtgaggatcctgagctcctgagttttattcctcaaaatgtcaatgagctccagtctgactgcaaaggtgggtatttctctcttcactatcaaagtctaattataaaccagacttacacttacagcccccattgactctgttgtatcctttctaggtcagtgaggtggtcttcttgtcttcttcaaaagcacaggttgtgcaagcttttgactccaggaaaacatcctaaagccaaaccatgtaatcattcatttcactaccaacccaatggctccaaagcttatcgtagctgtcctgtttcagtgggaaattttatccataactcacagtcctatttttccaaacttggccatcaattccttaaattcttaggagtactggtggtttctaagtctaaccataggataaaaccacagtcaggagagcagaggtttaggttatcacccaatctaggcatgggtgccacatctccttcctccatcctgaatggtatctcgtttcttaacatagctgacatcttgggagataaagttgaaaagccaatttccaatctgcagttacctaaaggaacttcctagaagtcttgatttagtgtaatcatttaacactaactttaaaaataatccatttagtaatccaataccaaatagtagattatcaccccaaagggctactcttaatctcagagtagtaacaaaatttccctctaactttagtataatatttcaaggacaacgaaatacaaatttctgtgaaatttccaaagtgtaaaacactatgaagttctactctaatatatgtcctagatgatgatttactccaaaaaaaaaaagtagatgtgacattttacattccagtactgtaaccacagaaaactcagctgcctcatggaactataacataatgtctaaacatcaaaaactaattcgaaagcaacttaagtattaattgaaatttctcagcaatgccaaaagataaatctctatgtaacccaatgcaatttcttaaaagcctttttgtaccctcttgagcatgctttctccgtggaaggcctctcaattcaaagcattttttttctctctctctcctcgcctcttttaatgtgtatctttctcattttgcagctgccccaaagactctctttcttctttcataactcttaaaatctcccaccaaacccaacccatgcttctttctctattccctccttttcatctcctaatctattcatttccttctcttatgtttttagtgtaaatcaatcaaactgatttcaatgattcctgactctccctctcattcatcagtctgattatgggcagcaaagatgtttctttttaaagagaagactaaagtgagaaactcttactagtcttatatccatatttttcctgttacatataaaaagcaatacccatcataatgggttgattggaaactctatgaaattatgtatttacatatatttctgacatgtaggttttttaaagaatttttggttaaagtaataaaaatagtaagatggaaaacaggatacaatttgtcctctctggatacagctgttcagtctccctatcccatttccacttagcatcctaaagatcgaatggaaataacagaaaagagaaggataaaagatggcagaaaggagattagtagtttatgtgaggaaggagcaagtggtgtggagaagaatacagtttgacttagtgtgtctgctagctccatgagctgagctgtgcatttgccaggtggtgaggagggcagaggcagccacaaagctcccgaacagctgttcctttctcttcttccactcaacatttagagagtctgggcagtttaggggcagccactaagggagcagcagcagatggctgtcatgctgcagaggtgtactctagaaggatgaggggctccagttacaaaaagcagctatcttttatgtgctttaaagatatgtgctaaagtctacttgaaggctgtataaaggcacattaataaaaatcaccatttttaatttggtctttaattcagttctctaattttagtagtattttacattagatattagctatcggacaattattaaacttaaagaggaaaaaaaaagaacttaaaaaagacctatttttctcttcccatcctggcctcatccatttgaagcaagggtgacaaccttgttgtcataaccctacaaggaaatttttcacatttaacccacatttactgagaatctactctgtgtgccagtaatagtaccagactttttcatggccattatcttacgtaaagtaggtatgaaatggtatttttctaagtagaggtaaaggattctactcctcccactaaaaatacaaaataaaagaaaaagaaagacacaaaagttagagaaaacaaaatattagaagtttggttctgtttaaatgtatgcaaatccaattaggactaaatttacacttcaaaatatgtcaaaaattctctaacaggaaaaaaggacaaagttgaattttgttttctgttcttttcatgtgactttttgtgactggtattctttatacaaaatgactatggctcccataaataataaccaacaattctatagtattttgaagttttcaaagtattttcacataaaaaaattcttttgatctttaaaaactttctataaactaagaatctctatataataggaactttcgattcacatatgaggaaagatttcagtgcagtaacatgctgactggaatcagcctcaacactggaatagtgacatttaataagtccatggcaggcaatagacctgacaagtaggctttgctctgatgcaggcagaacatgtcatcattgtccaactagttttataaagtttttatgagaagggaaaaagtagttggtattctaggaaaaggaatttttacttgcctttcttctagatcgcaccaggagtgtccataatttgtcaactgaaataaagctcagccccagtgtcttctaaatttgtccactaactcattcacctatgcaaaattgtggcatttaaggaattagtaaaaactaattaacttaaataagatatttatttaatactctgttaatcaatgttatagaaaaggttactaagtaaattttgaaatgatatatctcccttaaaaggtccctaaattccttaaaatgagatcagataaatattaaggaaatattacagaataaatcaggatatttggtaaaaagaaaacgtgcttatcccatatgaaaaaaaaaagttgtggttagaacaaattagtatttttaaatttttttcagtaagttataaattaaatacatgcctattcactaataattcaaatggccaaagagcactgttaaatgatggttttctctgagggccatctttttatagacattgatacagttaatcttcctaatgtccagctggcatcaggttatttccttagagtagtgactgataatagttatcggataaaagccatgttccaagttgaaatccaaactccaaaattttctttttaaataggacttctatgatttctcttcttagtccctctgtttttcatgaaaattccaagactccctctttttgcctttgtgcaatccattctctacccctggtatttcctatcttcatgtcccttgtccagaatagtctagatccatctagcttaaatgtgatcttcttcttaaggctttcttctttttcctaaaatctctttcttctgcattctcgtctacttaagattgatcatgagctccaccatctcctggtctcccatatccaatcagtcatcaacttctgcctgatttccatttatcggtattcctgaaagcacgaacattggcatcagatatatatgcttttgaattttagctatgtctccactagctgaatgaacttaaataagcaacttattgttaatcatagtttcctcttctataaaatggtcattcaaagagtacctaattcacagaattatagtaaagatcaaacgagttaataaatatgtaattcaacttagatggaaaattcaatggaagccaacatttctcaaagtaggtttaaggaatattggttccataaatattcttcaaataaaaaggaattcgtagttaaaacaacttattaaaaagtatacctaatacccacttctctgtcagtcatgaagtatattagcacattaaagtctccaagaggtcttaaaaaaatagaaaaaaaaacaattatcctaacattccctaaacttatttgaccaggaagcctttttatgcatatatagtagctacttaaaagcctgcagaaccagtgttctgaggaaggctttgagaaaatgcttacctggacaagaaccacagctatcatcttgaaagttatttcagccttaggttttcaatttttagaaaaaaataaaaaataaaaaataaaaacattgtgaaagagaccatctcctaatgttcagagtcattagaaattctcagaaaatgaataaaattctgccctttgggaagatatgcccaaaagggtagcagaatggtattagctttccaaggccaattacttcttaacaatctcttaaaggatatgaaaaagttctatttttcatggaatgcccagtaattgcttatccagctggtagcagatgcaaaacttcatctcaggaggaaagcttaacgtacaaatttgtgaagacctgataaagagtgagaagaactctcaggagtctcaggaaatgaataagttcatgcctgtgatgaagacagaattgagacgtgatcactatacctgaggtctaatacatctaccttcaaacataaaactgtttactctatacaaataaaagggcaatacaggtacacctcacattacggtgcttttttttattgtacttcactgatagcatgtttttttgcaagttgaatgccgagcaagtctctcagcaccatttttcaaacagcatgtacccacttcatgtctctgtgtcacattttggtaattcttatatttcaagctttttcattattattatatctgttttggtgatctgtggtccgtgatctgttttgttactattgtaattgttttggagtgcaacagaactacacctatataagtcaacacagataactgataaatgttgtgtgttctgactgctcaatgaaccccctgttcccccatctctatacctctctttgggccttgatattccctaagaaacagtaatattgaaattaggccaactaccaacactacaatggcttctaattgttcaagtgaaagacatatctaactttaaatcacaagctagaaatgataatatttagtgaggaaggtatatcaaaagctgagacagataaaaattaggcctcttccaccaaatagttaaccaagttgtaaatgcaaagaaaagttattgaagaaaataaaaagttctactccagggaacacataaataataagaaagtaaaacagccttattgctgatatggagaaagttttagtggtctggatagaagaacaaaccatccacaacattcccttaaaccaaagcctaatccaaagcaaggtcctaattcttttaagtctatgaaagctggcagaggtgaagaagctgcataagaaaagctcgaagacagcagaggtttgttcatgagatttaaggaacaaagcaacctctataacataaaagggcaaggtgatgtagcaagtactcatatgggagctaaagcaagttatccaggcaatctagataagataatgaatgaaggtgtctacaacaatcaatagattttaaatggagaagaaacagccttctattggaagaaggggccatctaagacttccattgctagaaagaagtcaatgcctggcttcaagcttcaaaggagaatctgactctcttattagggcctaatgaagcaggtgactttaaatcgaatccaatgctcattgaacattctgaaaaacctagggccctttagaattatgctaaatctagttggcctgtgttgcataaatggaagtacaaagcctgttacccaggttctcactcaggctttgtagtttcatgtatgttggtttacaacatggtttactgaatattttaaacatatcattgggatgaacttctcataaaaaaagattccctttaaaatattactggtctttgacaaggtacttagtcaccccaaagctccagtggagatatatagagagatcaatgttgttttcatgcctgaatatacaacatccaatctgtaggccaaatatcaaggagtaatattgaatttcatgtcttattacttaagaaatgcacttcttgccaggagtggtggctcatgcctgtagtcccagcactttgggaggctaaggcgggtggatgacctgaggtcaggagtttgagaccagcctggccaacatggtgaaaccccatctctactaaaaatacaaaaattagctgagtgtggtcatgcgcgcctgtagtcccagctacttggaaggctgaggcaggaaaattgcttgaacccgggaaaggaggttgcagcaagccaagattgtaccattgcactcccagcccgggtgacaggagtgaaactctgtctcacacacacacacataaaataataaaaataaaaaaataagaaagaaaagaaaagtaatacatttcttaatgctgtagctgccatactgattcctctgacaggtctggagaaaatacattgaaaacttcctggaaaggcttcaccattctagatgccattgagaacattcaagattcattaaaagaggtcaaaatataaatattaacaagagtttggaagaagttgattccactctcatggatgactttgaggtgtttaatcttcagtggaggaagtaactgtagaagtgatagaaataccaagagaactagattagaattggagcctgaagatgtgactgaattgctacaatctcatgataaaacttgaacagatgagtaactgcttcctatgaatgagcaaaaaaagtggtttcttgagacagaatctactcctgctgacgatttggtgaacattgttgaaatgacaacaaaggatttcaaatattacataaacacagttgataaagcagcaatacagtttgagattcattccaatttcaaagtaagttctacagtaggtaaaatgttaccaaacagtatcatatgctgcagataaatctttcacgaaagagtccatttatatggcaaactcaatgttgtcttattttttaaaattgccacagcctccccaaccttcagcaactgtcaccctaattattagcagccatcaacacagaggcaagaccctctaccaacaaaaagattatgactcagtgaagactcagataattagcactttttaacaattattatttcaaaattaagatacgtgtttttttagatatattgccatggcacacttaatagactagagtatactgtaaagataactttttttttattttttgagacagagtctcacaccataacccaggctggagtgcagtggtgcaatctgggctcattgcaactccatctcctgggttcaagccattctcctgcctcagcctcctgagtacctagaattacaggcacacgccaccatgcccgactaattttggtatttttagtggagacagggactcaccttaatgtgcatgtctgacactaacctgtaatatctctgaggtatgcctataaatgtttgttgaccgattgtctcaatgttacaagctgaatgtaaccaaattttagatggcacagcagaaattccgaaatcatttaattttcttttcatgagaagcaaaataagactaccttacatttatagctcatttgtggtctgctcttctataaaccataaaaactcctaactttacaaacatagaacttaactcttctttcatcttcatcaaaaagtgcttttcaaacaattagcatttcccaaataacgtttgtcgtttccgcttaggcctgttttagtctacctaatagaataaatttagcttccctgtagcagagccctatttttaaaagcatcttttaatacatgctgctgtgagagcaaaaaaaaaaatcatagtcattttgaataatttttacatgtttattaaaacaatggtaagcaaaataagtggttattatatgctctcatgttagtcttagtattcataagctaaaagcactcatccttctttaaaataaataacccaattgaaaataaaatgttattaatcatataaagaagatctctgaattcttaaacactgtgaattcttaaacactgtgagtatagcatcgcttctatttatacaaataaatgaaaccacaaacttattagagtaccttttaactataaaaataaatagataagcagaaaaatacattctaacctaattttcaatatctgaaataaataattagagaatatataaggaagaaattttggtgaataactgtagcaaattcctaattctatgaatatggaaattgaggcactacatattaaacaataaggcataaacccatctgagtattagtgagaattaaaaacacatctcctaatttccagttatgcttttcgtatcatcacaatcttcataaggtttgtccattaagttcatttgtgccttaaacaacacgaaatccacccgttacacattttatggatactatttataaaaatcagccaattcttcaataaactaacattagaaacaggataattagttgcctgagtttaaaaaattgaacgcaaatcaataaacataatcccgcatataaacagaatcaacaacaaaaaccacatgattatctcaatagacacagaaaatgcctttgaaaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactccttttcaacatagtgttggaagttatggccagggtaatcaggcaggagaaagaaataaagggtattcaattaggaaaagaggaagtcaaattgtccctgtttgtagatgacatgattgtgtatttagaaaaccccattgtctcagcccaaaatctccttaagctgataagcaacctcagcaaagtctcaggatacaaaatcaatgtgcaaaaatcacaagcattctcatataccaataacagacaaacagagagccaaatcatgaatggactcccattcacaactgcttcaaagagaataaaatacctaggaatccaacttacaagggatgtgaaggaactcttcaaggagaactacaaaccactgctcaacgaaaaaaaagtggatacaaacaaatggaagaacattccatgctcatggataggaaaaatcaatatcatgaaaatggccatactgcccaaggtaatttatagatttaatgccatctccatcaagctaccaatgactttcttcacagaattggaaaaaatactttaaagttcatatgaaccaaaaaagagcctgcattgccaagacaatcctaagccaaaagaacaaagctggaggcatcatgctacctgacttcaaactatactacaaggctatagtaaccaaaacagcatggtactggtaccaaaacagagatacagaccaatggaacagaacagagccctcagaaataataaccacacatctacaaccatctgatctttgacaaacctgacaaaaacaagaaatggggaaaggattccctatttaataaatggtgctgggaaaactggatagccatatgtagaaagctcaaactggatcccttccttataccttatacaaaaattaaatcaagatggattaaaggttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagggcttctgcacagcaaaagaaactaccatcagagtgaacaggcaacctacagaataggagaaaatttttgcaatctactcatctgacaaagggctaatatccagaatctacaaagaactcaaacaaatttacaaaaaaaaaccaagcccatcaaaaactgggtgaaggatatgaacagatacatctcaaaagaacacatttatgcagcccacagacacaggaaaaaatgctcatcatcactggtcatcagagaaatgcaaatcaaaaccacaatgagataccatctcacaccagttagaaaggcaatcattaaaaagtcaggaaacaacaggtgatggagaggatgtggagaaataggaacacctttacactgttggtgggactgtaaactagttcaaccattgtggaagtcagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaatccaaatgtccatcaatgatagactggattaagaaaatgtggcacatatacaccatggaatactatgcagccataaaaaaggatgagttcatgttctttgtagggacagggatgaagctggaaaccatcattttcagcaaactatcgcagggacaaaaaaaccaaacaccgcatattctcactcataggtgggaattgaacaatgagaacacttggacacaggaaggggaacatgacacaccgggcctgtcatgggatgggcggggggagggatagccttaggagatatacctaatgtaaatgacgagttaatgggtgcagcacaccaacatggcacatgtatacatatataacaaacctgcatgttgtgcacatgtgccctagaacttaaagtatcataaaaaaaagaaaaaaaagtaatgtgaagtatgaaaaataatatctgaagagtttactaaatttatgtaattaaaaatcccaagattaaaaaaaaaaaaagaaaaagaaagaacagtcactaagtttaaagtatgttcttagtaggggatttatatagcatatgacaactgcggtctcctctgattcccttcagaaaaatctcacaaagatgttgggtcagcagtctcaaggacaatgtaatggcttcatctagaactcatatctgatttttgaatctaatgaaataacctgaatgtaaaaaaacatatgtacccatggctctgacagctagaaaagcagtcaaatgagaactagttacaggcaagtctagaagagtattagaataacttaagaaagacagagcagagacaattttaatgaagtcttggatactcagtaagagtttggttctagtgccatagacagtataatgttgatagaaagttgaaaagtgttttgatttgcctttctctgatgattacctgttggtgggggtataaattatttcacccagtgtgaaaagcagtttgcagaattctcaaagaactaagagttgaactaccattcgacccagcaatctcattactggacatatgcccaaaggaaaataaatcattctaccaaaaagacatatgcactcatatgcatatcacagagctattcacaaaagcaaagacgtgacatcaacccagatgcccatcagtggtgaactggataaagaaaatgtgacacataggatttatgggggaaaatggcagatgggaggcaggactaaattgcagctcccactcagacaggcagagcagcatgtggagatacatcatgaacttttcctgaaagaactactggaggaacataccaggaaagccaaaagaatccacagaccctttgaaggaagcagattgctcctgcaggacccaggagacagcccaaatactatgagtgcccaaagtatgaaagtgggaaagggtgaacacacaccctcactggggaactcgaaggtccaggttatgggagaaggatttgaccctacctagaactgagacaatttagagagccaagtgaaatacaggagtagaggaagtgccagaagagccctgtgggctctctcggtccccagggaagccatttctgactttgtctcacagggatccttggggagggttgccagtggaactgggaaaagaccacagataaaaagaaacctcaagctgaactttgtaacaattccaaccaaacatgcaaaatttcttggacagaacttgggggagagagtgaatccagagtgcagacacaggcaggcaaggaggtatgaaacctgaaagtcctgcttgctttctcagctgggaggctggtagcctggggcaagttcttagccctgcttgcccactgcctaaaaacaaactcagtgctattgcggggaggcacagtgagagtgagactggccttttggattgcatgggagccgggtgaggcctgtaactgtcggctgtcccccacttccctggcaacctacatgacacagcagaggcagccataatcctactggtaacgtaactccattgacccgggaaccacaaacccatcccccacagcagctgcagcaagccctgcccaaggagaatcagctcagacatgtctaaccctgccccaacttgatggtatttctctacccaccctggtagctgaagacaaagatcagattctcttgggagttctagggctccagccactgcctgatcttccctatactaccacggctcatgctctcttgaaagtgccacctcctggcaagaggccaatcagcacaaaactagtgcaataaacaacaataatacaactacgggccctcacagaatgcatttcactcccctgccacctccactggagcaggtgctgctatccatgactaagagacagaaagatggttcacatcacagaactctgtgcagacaccccctagtaggtaagtactacatcaagggagcaccccatgggacaaaacagtctgaacagaagcccttgagccccagatcttccctctgacatagcctacacaaatgtaaaagaaccagaaaatcacttctggtaatgacaaaacaaggttgtttagcaccctcaaaatatcacactagctcaccagtaatggatccaaagcatgaagaaagtcttgatatgccagaaaaagaattcagaaggccaattattaagctaattaaggaggcagcagagaaaggtgaagtccaatttcatgaaataaaaaaaaaaaatgatagacggtataagggaaaaatcttcagtgaaattgatagcataaataaaaatatcacaatttctggaaatcaaggacacatttatagaaaagcaaaatgcactgaaagtctcagcaatagaattgaacaagcagaagaaagaacttcagagctcaaagacaaggtttttgaaataatccaattcaacaaagacaaagaaaaaaagaatttaaaaaaatgaacaaagcctgcaagaagtttgggattatgttaaatgaccaaacctaagaataattggtattcctgaagaaatctaaaggtttggaaaacatatatgggagaataatcgaggaaaacttccccagtcttgatagagatctagacattcaaatacaagaagctcaaagaacacctgggaaattcatcataaaaagattatcacctatacacattgtcatcaggttgtctacagttaagatgaaggaagaatcttaaaagctgtgaggcaaaagtgccatgtaacctgtaaaggaaaacctatcagattaacagcagttttctcagcagaaaccctccacactagaagagattggggccctatcttcagcctacttaaacaaaacaattatcagccaataattttgtatccagtgaaactaagcttaataaataaaggaaagatacaatatttttcaacaaacaaatgctgagagaatataccactaccaagccagcactgtaagaactactaaaaggtgctctaaatcttgaaacaaatccttgaaattcatcaaaacagaacatccttaaagcataaatttcacaggaccaataaaacaacaacaccataaattttttttttaaaaaaaggtatttaggcaacaaatagcacaatgaatagcacctcacatctcaataccaacattgaatgtaaatgacttaaaaactccacttaagagatacagaatggcagaatggataataattcaccaactaagtatctgctgccttcaagagactcacctaaaacataagaactcacataagcttaagataaagaggtggaaaaagacattccatgtaaatggaaaccaaaagagagcagatagtcattcttacatcagacaaaacaaactttaaagcaacagcagttaaaaaagacaaagagggacataatacaatgataagaggccttgtataacagaaaagtatcacaatcctaaatatatatacacctaacactggagcttccaaatttataaaatgattactactagacctaagaaatgagatagacagcaacacattaatagtgggggacttcaatactccactgacagcattagagaggtcatcaagacagaaagtcaacaaagaaacaatggatttaaactataccctagaacaaatggacttaacagatatttacagaacattcaaagataaatttaaaaatttcttgagacaaacaaaaatgaacatacaacatacccaaacctgtgggatacaacagaaacagttccaagaggaaagttcatagcaataaatgcttgcatcaaaaaagaccagtctaaggtaaacaacctaactttgtaccttaaggaactagaaaaataagaacaaactaagctcaaagttagtagaaggaaggaaaaaaaaaagatcatcacagaaataaataaaatagatattagaaactcactagaaaagatcaacaaaactaagagttggtttctggaaaagattaacaaatttgacaaaacttaaagagacacagataaataaaatcataaatgaaaaaggagacattacaactgatacatcagaaacacaaaagattgtgagggtacaatgaacaattacgtgcaaacaaatagaaaaactcagaaaaaaatgggtaaattccttgatgtatacaacttaccaagaccagactattaaaaaatagaaaatcttagcagaccaataatgaataaacacataaacagaccaataatgagtaaggagattgaatcaataatataaagtctcccatcaaaaaaaaaaaagcccagaacctgatggcttcattgctgaattctatcaaaaacttaaagaatgactcatatcaattatttaaaaccttaaaaaattgaagagggaatacttccaaattcattttacaagatcagcatcaccctgataccaaagccagataaaaacactacaaaaaaaaagaaaaacctcaagccaatatccctgatgaacactgatgtaaaacatcttcaacaaaatattggcaaacagaattcaaaggcacgtgaaaaagatcttcagcattatcaaatgggattcatcttagggatacaaggatggttcaacatatgtaaattaataaatgtgatacatcacattaactgaagggagaacaaaaaacgtatgatcatttcaatagatgcagataaaaaatatttgacaacattcaacatactttcatgataaaaactctcaacaattaggtataaaaactctcaacaattaggtataaaaagcatgtacatcaacataataaaggccatatatgacaaacccgtagctaacatcaaactcactggggaaaagttggacgctttttctctaagatctagaagaagacaagagtggccactcttgccacttcttctattcagtacatactggaggtcatagtcaaagcaataggcaagagaaagcaaatgaatctaaattagaaaagaagagataaattgtccttgtttgtagatgacatgctgttatttataacaaacactaaaaaactactagaactaatatccaaattcagtaatgttacattacacacaatcaacatacaaaaatcagagaacaatctgaaaaagtcaagaaagtgatcccctttatataactacaaaaaataaaacatttgtgaataaacttaacgaggagttagaagatctatacattgaaaattatgaaatactggtgaaaaaatttgaaaggatagaaataaatgaaaagatatcctgtgttcacagattgaaaaagttgatattgttaaaatgtccatactacaccaagcaatctacaattcaatgcaatccctatcaaaatgcaagtgccattcttcacagaactagaaaaaacaattttaaaatttgtatgaaactacaacagactttgaatagccaacacaatctggagtgaaaagaacaaagctgcatcatgttacctaactttaaaatgtacaacaaagctatagttactacaacagcatagtactgacatgaaaacaaatgtaccaatggaacagaatagagagccctgaaataaatccatacatttacagcaaactgattcaacaaaggtaccaagaacatacaatggggaaatcacagtcttttcaataactgatgttgggaaaactggatatctaccatgcagaagaataaatttaggtaattttctcacatcatatgaaaattaacttaaaatggattaaatacttaaatataagacccaaaactatgaaactgctataagaaaacataggtgaaaatctccatgacataggtctaagtaatgactttttggatgtgactccaaaagcacagaaaacaaaagcaaaaataaatgaggggactatacaaaactaaaaagcttctgcacagtaaaggaaacaatcaacaagagtgaagagacatcctacagaatgggagaaaatatctgtacattatacatctggctaaaggttttatccaaaatatatgatactcaaacagctcattagcaagaaaacaaataacctggtaaaaattgggcaaaggacctgaatagatgcttttcaaaagaagacatacaaatagacaataggtatatgaaaaaacgcccaacatcacaaatcattaggaaaatgcaaattaaaaccataatgaggtatcacttcacacatgataggatggctgttatcaaaaagagaaaaagtattagtgaggatatggagaaaatggaattttgcaagctgttggtgggaatgtaaattagtgcagccattatggaaaataatatgaagattcctcaaaaaattaaaaatagaaataccatatgatctggccatctcctactcgatatatatccaggggaagtgaaatcagtatgttgaagatatatctgtgctatcatgttcattgtagcattattcatgatagtcaagatgtagaatcaacctaagtgtccatcagtggatgaatggataaggaaaatgtggtgtatatacataatggaatactgtttatccataaaaataatgaaatactgtcatctgtgaaaacttgcatgaagctagaggacattatgttgagtaaaataagccaggtacagaaagataaataccatattatctcactcatatatggaatctagaaagatgcagagagtagaatcatggttaacaagggcttgggtcattgaaggatggcagaatttgtgagatattgggcaaaagatacaaaatttcacttaggaggaatatgttcaagagatctattgtacagcatagtgactatagataataatatattgtattcattaaaaatgctaaaagagtggatataaagtgttcttatcacaaaaatcatgactatgtgaggtaatgcttatgttagctagatttaagcattccacaacgtatatatacttcaaaacatcatgttgtacataataaatacataaattttatctgtccattaagaaatgatttagttcagttctgagacaagacatcactctaccctgctgttctctaaatacaattcaataaatgctcatggcaggtttcttcataactattttacaggtgtcctttaaagggtgggtggttaaacaaaccttggtacattcatcattagagtactagtcaacaataaaaagcaatgcagcaacttggatgaaattaaaaaaaaatatgctcagtaaaaaaagctaaatccaaaggcttacatactgtgtgatttgtttacacagctttgatgaaaattttatattactttatttttacttttattttaggttcagaggtacatgtgaagtttggtttgtggatttttgtttttttggtttttgttctttttgtttttgtttttgagaaaggatctcactgtgttacccaggttagagtgcagtgacatgatcgcagttcacggcaacctccccttccccagtagctgggactacaggcacacaccaccaccccagctaattctggtattttattttattttattttattttattttattttattttattttattttattttattattttattatttattttgtagagatggggttttgtcatgttgcccgggctggtctcaaactcccggactcaagtaatcagcctgtctgggcctcccaaagtgctaggattataggtgtgagccactgcacctggtccaggtttgttatacaggtaaagggtatgtcacaggggtttggtgtacatattattttgacaccaaggtaagaagcatagtacttaatagggtacccatgtttctgcaaaggacatgatctccttttttatatggccatgtagtattccatgatgtatacgtaccacattttctttattcagtctactgttgatgggcatttaggatgattccatgtctttcctattgtgaacagtgctgcagttaacatgaacatgcgtgtgtctttatgatagaatgatttatagtccggctggtcgcagtagctcatgcctgtaatcccaacatttgggcagccaaagcagccagatcatttcagctcacgagtttgagaccagcctggacaatatggtgaaaccatgtctttactaaagatacaaatatcagatgggtgtggtggcacaggctactcaggaggctgagccacaagaatcgcttgaacccaggaggcagaggttgcagtgagctgagatagcaccactgctctccagagtgggtaacagagtgagactctgaatcaaacaaaaaccccaaaaaccaaaactatattcctttgggtatatacgccagtaatgggattgctggggtgaatggtaatcctgttttaagttctttgagaaatctccaaactgatttccacaatggctaaactaatttacttttgcaccagcagtgtataaacattcccattttctccataacctcaccagcacctgctttttttgactttttaataatagctattctgactgatgtgaaatggcatctgattgtggttttgatctgcatttctctaatgattagtaaagttgaacgttttttcatatacttgttggctacatgtatgccttcttttgagaaatgtcttttcatgtcctttgcccacttattgatggggttgtataacattctagaaatgacaaaattatgtaaatagagaacacattagtggttgtcaggcattggggagtgaggcatatgggagagaaatcaatatggatataacaagacaacataaggaatccttgcgataacagaaatgttctgtatgtttactgtggtagcacatacgcagatataaatggttaacaaaatagcagagagctaaatacatagtataagcatatgcactcacacacacagaggaatacaagtaaaactagggagatctgaataagattgatagattatataaatgtcaatatcctagttgcgatactgtacaataattttgcaaaatgttatcattggaaaaaactatgtaaaagggacatggaatcttaattatttcctacaactgcaaatgtatctgcaattatctcacaataacatcaataaaaatgattttataacaaatgaaagcaatcaaatactagtaaaatttagtacatttctatgtccttgttgtatatttcatcatttaaatatacaacaaagcgaaataatctaaaaagaaaacattattttatacctcaaacccctgagattatacacaattgcatatttctgtaacttcatttgaaaatatggcatccataaccatattaacatactacggggagtttaggaggatcctagcttttggctctcctccctcagttaattattggaagctttgaggaaaggtgtcacgagaaatttttgattcagtcaataaacattaatttttcttttgtcttgcttttataaatcactggcctatctacaatgggaggctacatcttttaattaatatacaatacttttcagttcttagttgtaattatcttgtatgttttagatttcacataacgctgatgaaacccactgaacttttaaaagtactctaggatacaggattcacatgtaaatctaccacaataaaatgactttttaccagttattcctccatcccagagcttcattttatgtttataaccttattttaaccttatttattctacttgttatgttaaaattgtacttattttactcctcccaaggttaaaataaggattaaaatatcatttattttcatttttattactttattatctccataaaagtctagagtcactagcttcttttatccatctttggtgctggtataaaaacacatttcttgcttcacgttatgtctttaagcagcatcactttctttgattttccttttccaattaaaccactatctttgaactttttaattttcatggatacataatagttgtgcatatctgtggggtacatatgacattttgatacatgcacacaatatgtaatgataaaatcaggggatttaggatctccttcaaacatttatcatttctttgtgttgggaacattctgaatcttctcttccagctattttcaattatacaataaagtattgttaactatcatcatcctatagtgctattgaacactagaactccttccttctagctgactatatttttgtacccactacctagccttcttaattcccctcccccactcctccctgcctttgctaaccatcattctattcacaaaatatcacatgttctcagtcatatgtggtctaccttttttgtttcttctctatttctgttattttcagttattatttaaataactaattaaattcttgtggttttttcctattttttttataatgataggtttttaatgccctatttctccctgacaaacaactagacaccctgaatactagtagattgccctagaaacctgcctccaactggatctaataactgaattcagcttctcaagtcctaatcagattaaatcagatttggtatggcatagttttgtatattcttaaaatagtaacaagattacttcacctactctactgaacagcctagatgaatctatttgttattattattgggaaaatctaagttgagtatgaactaaaattcactaacaccctttattccttcttcctaatgtcctcacttatttatttgtcctactgtgataaatgtatcttagtaaggcctttcgaaatattttatgaattaaggctggaacaaagtagataaataggcaagagagaatctatcagaaaattaagtaaaatagaaaaaaaaaatcttaattacggctttgacttagctcacggactacctcttctccagctaatctgcactttgctgccaaagacattctcctgaagcttaaatgtgagcatctctctattgaaaaactcagtgtagctcaaaaatatcttaaaatgttctcatggtatatgaggtcttatagaatttaagttcaagctatctctcttcattccccacaatgttctctgataagatggtcctctgttctgggagctcagaatcatactcagtcccgtaaagaaactgagcctttatctaggtatgaaaacctagacaacgtcctcatctgtattattgtacttaacaacctgcattatgaagtccttgtgtaagcagaacagatctgcccattcaatggcagatgctcctcaaagacagttatcagaagtcactcagtaactctaaggccgtcttcagtatttgtaggtctgcaaatggcatgggcaagaataaaagccagtggtaatagtaacaacgtgccccacagaattttatctgggtcacatacatgcactcctcttgctcctgtgtgtaactttggactttccctcagattctatctggcctgattgcaaggatcttttaacgtgattatccattctggagtttgtccttgattaccttgacaatggctcctagctctacccttactacagtgtgctcctcggttatacattatctcagttatcatagggtcagctcacctttttggccttgtaaagataacagtgctttaaatttttggtttattaatttattcatgaacatttagtaagtcccatattatactaatcattgaagacataaagccaagtagaacaggttccttgcctccaattatcttgcttctctgagaacggaaggtaagagtcaggctgcatctatcaggcatctaactactatggtctttttgacccatttgtactgaaatgttttaaaccagatacaccaacacagttctctagttcctcagcctccagaccaagagagaatatgtttccttgtgaatgctgatcatactttgctaataatgaatgtgtgtttaaagttaaaaaagaataaaggaacacagctggatgtattagtatgggctcatgaaagagacatatccttggatgctgaacccgcatagtcctgttacttcatggatgacacaatgaactgaatctaagacacttctaaaccatcccagcctgcactagagcattggcaaactggaggtgctgttttacaaaatgaatatatgaatggatgaatggtggatggacgaatggatgctttttcaatggcctatatgttcttccaaatattttgaccattaaaagaatttaaagtctagtttgaatttcatctatgtcaagaaactatccagtgtccctagtttaaggtgatcattgattccttgaattcacattcaaaccactgaattcaaatagtttattatttaatctgtacctgtataattatgcaattattgtagttatgagtatatggttgctttaataaattagaaatccgttgatatctggaaatacagttgacccttggacaacatgggtttggagtgtatgggtctacttctacattggtttttttcaatcgaacacagacagaaaatattgtattggcagatgtgaaacctgcctataagaaggcctgatttttcatatgcatggcttctgactaggggaaatgatcatgcatagattttggtatatgtggggtcctgaaaccaattccccatatctacatagggatgactgtatatcttatactgatgccctgccatggactatcatcctgcctggcagggaacagtcactgaataaataatctgtacatgagtgtacttcctaatagataatcttggatcatccatctatgttcagtcaatatgtagaaaagatcagcatattattcatgacatattaaatacacacttattgagtacttattctgggcttggcaaggatgtggttaaaatttaatcaccttaacacttgctcaatgtgtgaataatatgactctaccaaatcatattgttatcttttatcttgttattttataaacagagatataagtaatgacctcaaaatgactttttgaaagaataaattagcatctaataaacaaatacacagctttaaaaatcatcttgttgcaaggaaaggaaacagaacaaagtattttcataatcaagtacaaagttaagaactagagtggcattttttttttattatactttaagttttagggtacatgtgcacattgtgcaggttagttacatatgtatacatgtgccatgctggtgcgctgcacccactaactcgtcatctagcattaggtatatctcccaatgctatccctctcccctccccccaccccaccacagtccccagagtgtgatattccccttcctgtgtccatgtgatctcattgttcaattcccacctatgagtgagaatatgcggtgtttggttttttgtacttgcgatagtttactgagaatgatgatttccaatttcatccatgtccctacaaacgacatgaactcatcattttttatggctgcatagtattccgtggtgtatatgcgccatattttcttaatccagtctatcgttgttggacatttgggttggttccaagtctttgctatggtgaataatgccgcaataaacatacgtgtgcatgtgtctttatagcagcatgatttatagtcatttgggtatatacccagtaatgggatggctgggtcaaatggtacttctagttctaaatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgcatattagccctttgtcagatgagtaggttgtgaaaattttctcccattttgtgggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtagcagtaccatgctgttttggttactgtagccttgtagtatagtttgaagtcaggtagcgtgatgcctccagctttgttcttttggcttaggattgacttggcgatgcgggctctttttcggttccatatgaactttaaagtagttttttccaattctgtgaagaaagtcattggtagcttgatggggatggcattgaatctgtaaattaccttgggcagtatggccattttcaccgtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagttggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctctataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtcactgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaatagagtggcatttaaagttctaacagaatatagagaaagggcccagggaattgactcacacttatgctatgtaggaaaaggagtgcatcatataatacttatttcatagggtgaatatgtgtgtgtacatatatatatgtatgtatgtatgtgtttgtgtatatatgtatcataggaaagagcattttcacatgtaagcaactttgcaaacagggaaacagaggcaaacagaaaatgcatgtttcctaactgtcaaagcaagcaaaggtcaagtcttctctcaaaccctgtttcaactctattcagtccattgttacttcaaaaccattttaatatttttcattatataaaagctgttcctctatgaaattaatgaaagtaatgatttttgcattaaaaaaaaacagttgtttatccagaataaaaacaaaatccctgagacaaatggggagactcaggaattttccctttttttaatccaagcaagccaaggaagccccagtatacatacatatagcatgtatatatttaactgatcatctataggaaaatacatacattcaattaaaataaatactatactataggtatgtggtaaagaccaatttaatggagcaaaattccatcagaaagtttgctcaagttttagtttttcccaaagcatttgaatcacagaggctacttttttaaatatcaaaacaaatactttgggcttattgtgtagacagacaagttatcatggtgcatatacctctctttacagctactccctattcagaacatcagaataaagacagaaagaagactgcaaatacagcttcagtttgatttcatactgaaatacccactataggtcctctatagtaggctggttgtactggcaaaacaaaacaaaaattattattatcacattcgttcaatacttaatatgtaccagtcaatgttctaggatttttgtacatgcaatttccttgatgatctcagaactctatcaagttggtagataaagaacctgagtctaagtcacatgcccaaggctggctatacagctcatgaatgaaaggtcagaattcaaacatcttctgtttgactttgagatctttttcttgatcaccatattacaatgcatctactattcataataatatctattatcccacttagatgagaaaactgaggctcaaagctcagtatcctgtcagaagtttttcttctatggagtcatccactgaaaattaaatcaggttcaaaattattaattcagtttctccttcaaatcacccttccaaattacactctgccactaataattgggcagattgggacacccttgtgaagtcactattctttgttatttatcatttatattcaacttatttccttgattataaaaagaataatatgttgaaaccaataaaaacatatgtttcattcctacagtaatcaagaaaaagtggatctggttggaaaaagcattaaaaaaagccccgagttatttttggcccatacagcatccccagtacacgttctccctgtggacacagagcagcatatggctgttcttttcacagttcaggctcttctgtttactctgaacctctaggttacaatatgttttgtaatcactaataaggaccacctgtctcttgagagattctgcctaataaaatagagagactcattgttcaaatccactctcaggtagacaatacatgcctcatgtgtgggccgagattactgagtagaaaacttaaacaaattatgctgattgtaattgccaaattaagaacatatgttagtttcataaaaagaaaaaagaaacagtaatgtttggaacaataaagataatgcttttgaggaaatgaaatacctaatatattttccaggaaaaagaaaaagaataatctacttatttaaaaaattcgttcaatccactaagagatattcaaggcaaatttactgcattccaatatgcctaaccatataccctctttgtacaaatttatactatggttgaattcagccagaaaaactggctctttgaaaacaagcagagttcaatccaataactgactgataaatgcttaccactgagaatgtgaaagctatcataaatctggtttaatagaacaagaagagatacagtatatggataagagtaaatcctcctgtcagtatcctcctttggccacagtgacaattcccaccagaggtcaggccagattagcaacctctctctaggctgccattgcaaacccatatatatataccttcatcagtgcacctgctccattgcgctagagtggttggtccgagtgtttgtctctccttctaatctgtgagttccctgagaacagggttcacatattcactatagtctcaacaccttttaacagagtatgagcacagactgaatttcccaaatctattcaaaaaataactgcctaggtgatgatatctattcacatggtagcacaggaaaataaatttatctcatataaagtttgttttttgagtgcagagggattttccaagtattaaggccaatgtcaaagacaggcagaaaggactggctgtggggacagtcagcattttaaatgcagagactgtctctgaactttctcacacaaactcaagtccctcttctaatgggaccttcgctttgcccagtagactcattatctatcaggtgtctcactgaccacatagaatattgagatactgaattaatcataagtaacatttatagatctcaggtgtaccaaacactgggcaaagggctttgttgtattacttcatttaatgcttattacaaccatataaggtgggtgctactgttttcattttagacatgataaaactgaggcaaataatttgtttagtgctttgccatagatctaagcaaaacattaacaagttggtagcttgccaagcactctactactccaccttcaagcaggtgactaatccaactcctaaggataaaagtcatttgatttgtcctgataatcctcagaattcaattcttaatttataacctctctccacagtgcaatttattgttttttcttctaagagatgcattttccatttcggtaaaacccgcaacgctatctagttataaatgatcataatcatgcatgagaaataattctcacaaattgttttgatacattttatgaacgataatacagtcataaacataaaactttcatgcactgttaaatgtacataaaagagcagcttgagattcaataggaagtttataactacattatgcgtatatggcgagatgtgtatatatgtgtacttgtgtgtaaaattatgttatgtaatggtgttgtatgttagtgtatatatttctcaaacactggattttgctgtgtaaatccctaatcatcagaatatattaatgataggcagtccgacattaataaaagtcagataaaaagctttcctatcttagaccttgtcaaaacatttctgtcttatttcatttcctataggtcctctttcaaaagggcttctgtcaaaaagctattgattatcaataacctgtggcattatcaaagttgtgtttcaataaatgtcaatatggattgcagaacaatggataagatttcatgaagcacctagaagtagtaaagtattgatatgtggccttacgtatcactacaatagttagaaacataagctgtctgtgcattattaaatgcatagctgcaataattatgaggaagaaaataaatcataatctccctagttttgtaatttctcatcgtctaattttctgagaacttgggtgactggtgctgcatagacatatcactttgggggacatatttggaaatacaaaacaaaaaaaaattgattaaaaatatcaaattgatgtcttctgattaggttcaaacatgagaaagcatgtatacactctcacagtattatggtagctctgagaatcaagaagaggagatgttttttgctagaggaaagagtgaattacacattaaaacaacagaacagaagaagaatattttcctagtttatttgaagcattttaaaaacatcctactgtctaccgttctttttttatgtatttttattattattattatactttaagttttagggtacatgtgcacaatgtgaaggttagttacatatgtatacacgtgccatgctagtgcgctgcacccactaactcgtcatctagcattaggtatatcacccaatgctatccctcccccctccccccaccccacaacagtccccagactgtgatgttccccttcctgtgtccatgtctactgttcttgtagttatttcctggccaccaaatttctgtgaaaagtcctacttttctgtggaagagatgctggatgaatgaactctaaacctcgactgagactacagaacgtgctccatacttctctatacttaaaaaagccagtgtgcactaatatggggcaaagggctgttaaaatgtgaaataattcttcacctggtggtaagtagatgctgccctccttgccctccccaccccagcatccacagccctgtgcactgatttcctgggcctcccttatccatcaagttcagaattggtttcctgttccagagccccttaggactgaagagtgatggtacctagcagctctccccaaatcccccaaagacctctgccctaagagagctcctctgagggagtgcccaccagcctgagacacctgatgaagttcctcctccgtactgccatccccacgtgctaaccccactgggtacccatcagactccagccgaaagaaacagaactctgggtgatggtgcggcacctggcaggcaaatgcccaggtgcttttgggcaccaatcccaggccttgggaacttgcttccggctgggctcttcaagtcgccctcacatggccacttgtggaaactgcagaattaatggacactggacctgaagagtgcctgcggtagacaaaaatagcaggtagctctaaaggctgttaagtaatctgaacatcacccttagatacatcaaccttccctggtgttgcaactgaaagaggcaatataaacacagagtatgattcacttctatcaaccagatatagccagaaggtctccccttgtgatgtggcaaaagtgatgtgccctttttttttttttttttttcttgagacggagtctcgctctgacgcccaggctagagtgcagtggcgcgacctcggctcactgcaagctccgcctcccgggttcacgccattctcctgcctcagcctcccaaatagctgggactacaagcacccaccaccacccctggctaattttttttgtatttttagtagagatggggtttcaccttgttagccagatgtgacctttttttaagcccaaatttataaatgagggcatattcagtcgattccacaccacctccaacacacagacatacaaaaaatgtacaaagattacaacaaatgactctttcataaaagggcaaaatttatctaagggtatagtcaactgcaggaaaaaaatcagatcattcattaaattcttacagatatcaggagatttctctaaagaggctgaagaatgtccataacatttttaaattgaagagagaatcaagtcatacattttctaagagtttatttatggggaaaacctattctagcaaaagttatacacttaaaaataaagcatccctcctggagagctatatacattaatatatgtttatgacgatacttgcttttagatgaagctgattggtccagtggccgatgactttgtactctgtgcttttgttggttatttgatactggaagatatcataacgtccaggagcatctccgttttcattaaaagtgacaggagtgccagcactgcctataaagatttagaaaacaatgttaataaagttttagtaagatagcccactgggtttatttttcttttagaaggaatggtagataaaaatatattgtgtgaagtaagtgatgcaaagattgcaatccatacaaggtcattcttgatagcataatatcttttacatgaaaaagaagcccagacatacacacacgagtaagacgtgctttattgtacatattagaaagtaaatgatgagtatccaagttaagcaatgcacataacagctaaataaataaaagttgataggctgaatattcaatactggctacatagtatgatagttaatagagaaaaatgtaaatgttttgaagcatgacagctattgtacaatacgaactacaaacagcaattcaaaatatggcaggagaactttctggccagaatcctgagttttgctttttccaaactctctaaagcagttagagagcaccgttcctgtgcctctgctacctctgcccaagagtatatcaatgtggtctactgttgggaacctctcaatgggtgaggcattgatctatgggaagtcccaactctgcccagatcatgattgttctcccccttcacagtgacaggtctaacagtggcagagcagcagggtgcaagaactgtagtcttttctaaactccattcctctcggaagttttcatcttttctcttaatagtttctgctcacttttattttccctcttattaacttttatgtaattacaggggaagagtagaaatggatcaccaccccaatgtcttcttgttccatctagcttcactatctatacagactttccttttctctaacagcttttaggcttctctacatttttttattattattattctttcctgtcttgaaaaattcacctgacaccaatcccttttcttggtgtctgtcttccctctgcaggccttttatctgactctcttctcacaggatattggatttaatttctaaactgtgctagagggtttccccttcttgttatctctgtctcatactgtattctccaaaagtatacataactaatagttatatacgtcaactgtacatattcccatcttataatgagcttcttattctatctgtagagttgtttacctaattaccagccatcacaaaattgtaaaatatttaacttatcaaacaaatcgatgactttatcaaaaaaacacagtaacctgtaaataaatgtaatcagagtcacataacaacaatgtgaatacttttccagtaattaatggacagatgtctaatattctgttttcttgattcttcctaaaaatctaaacatggtgtaagttctctgatgagactacagacatctggtatcatcaggaactgctgaggctgcaagagatggcaccgcatggaagaaagagctctgctcccggaactggaagttccatgtccaggctcactccattccccattgatttccacaacttgtgtatgtcccttttccttcacttaccacacagacttaacaataaatatgaataaattttgaagtcctaaaagagctgtaaatatgtacattattattactattattattaattcacatgagaaatgactttatatataaattgatagatgtacattactcagggaataaaataagagctctccaatcaagcagtactatcttagctactccttatatatggaagtagaacctatttgccaaacctgaccaaaacctttctcagctcctagtgacctcgagcaggttaacctcttaaatcctcagtttcttcacctgtaaaatgggagtaataatgatacttttctcatagagttgttgtgagaattaaataatcaacacttgtcaagtgcttagaacagtgcatggggataaattattcactgcacatttactttcagtacacaccaacacatagtaatagaaaggatgttgaaagttctctaagtgatggctagacaaaagattattgaaattcaaatgaggaagatatttctggctggaaaaacacgtatgttgagaatttcacattaacatgatcaacttctgacatttatatatcactttgaaatattttaattacatattctctcctcaataaagggatacttaattttctctacttaaaatctcccaagttgtcaactccttgactcaatgactccttatcttctacaacagcagttcccaatcttttttacaataacagtacctaagatgaaataatgtaatttgtataacacattaccatgaatataccctaagttatacataattcctaatgtgttagctgtttctatatccaagtcaagaaagcctctcaagagagctcattagagagccacattgtcacaaaatataataatttccaacttagatactttgaatatcattattaaaatcaagttacactaaatttgacattgtattaaggtgcaatattctaaagcagttataagtgtgggttctggagacagatcattgggttcaaacgcccctctgtcacttattgatgtggtgtcttgaatgcatttcttaatttccctatatctcacatttctcagttatatagtgggctaatagcaattcccacctcagagggatatataaggattaaatgaatcaatatatataaaacatttagtacatcatattacgtattaactataatttcttttgttgttttgtggaaatgttgtgtttgagagccactgtctatatgagaacatataaactcagtgagcgtataagttttcctgatgtcactctcactaatctctgatctctttcaacacaatgccacctatacctaaaattccggtccctaaattcattatgctctgtctcaccattctgtctttgctcaggctattttctctaatttcccattctctttcctccttacccctctctatataattccttcaagatgaggctcaagggtcatgcacttacagaagcttaatcttactccaaccctggggaaggtgcccaaccacctctttatgtcctaacatgcaatatcgaagcactcgcaacattccacagacttactatccattctgtacctgaccaaacatttattgcacagatacttttttagagcctattatgtgctcaacactgggtggaccctctgcaatcttcacaaaactatggtcttcttaagaaaggcaaaagtatctattatctttgtaagcactgcagcaaagacagtgttcagtactgagcaagtaatcaataaattataggaaagcatgaaagaggcatcccctaatgatcccaagcaaatccatgcttccctcttcatgacattatgaacttcatgtatattttctgtcatcttttatattcacaaacggagagaccaaataaatcctctcactttgttattaatgtgacattagaaaccacggggaaactttgacatatctgtgaatgggctctgagttaatcaccagtagctgaagtggtttttattactgatgacccttgcatcttgttttcctaatgcgatttctagtcttaaattaggcttgcagttgaattacttcaaccctttttcaggaagaactgattccattacatattgactcatttcaaatgactgccatggaactctggtcaatgtagaaagagcatcgttgagtagccataaggaactaactcattagctgtttaataattcctacaagtttgccatcttttaaaaatgtcattgtttgtactgaaactggccactctgagaaacagaattaagtggcgaattttttttttgtccacaaaaaaatttcaaatgacaaatgtctgttaatatagtcattaatttatcaaggtttaataacaacacaggtaagaaatataactttgacagagtggggttccaagatggccaaataagaacagctccagtctacagctcccagtgtgagcgacgcagaagacgggtgatttctgcatttccaactgaggtaccaggttcatctcactggggcttgtcggacagtgtggacaggacagtgggtgcagcccaccgagtgtgagccaaagcagggcgaggcatcgcctcacccggaaagtgcaaggggtcagggaattccctttcctagccaagggaatgggtgacagacggcacctggaaaatcaggtcactcccaccttaatactgcgcttttccaacggtcttagcaaacggcacaccaggagattatatcccacacctggctcagagggtcccatgcccacggagcctcactcattgctagcacagcagactgagatccaactgcaaggcagcagcgaggctgggggaggggcacacgccattgctgaggcttgagtaggtaaacaaagcagcccggattccctcaaactgggtggaacctactgcagctcaaggaggtctgcctgcctctgtagactccacctctgggggcagggcatagccaaacaaaaggcagcagacctctgcagacttaaatgtccctgtctgacagctttgaagagagtagtggttctcccagcacggagtttgagatctgagaacggacagactgccttctcaagtaggtccctgacctccaagtagcctaactgggaggcacctcccagtaggggcagactaacacctcacacggccgggtacccttctgagacgaaacttccagaggaacggtcaggcagcatcgtttgctgttcagcaatattcactactctgcagcctccactgctgatacccaagcaaacagggtctggagtggacctccagcaaactccaacagacctgcagctgagggtcctgactgttagaaggaaactaacagacagaaaggacatccacaccaaaaccacatctgtacatcaccatcatcaaagaccaaaggcagataaaaaccacaaagatggggaaaaaacagagctgaaaagctgaaaattctaaaaatcagagcacctctccccctccaaaggaacgcagctcctcaccagcaatggaacaaagctggatggagaatgactttgacaagctgagagaaggcttcagatgatcaaacttctctgagctaaaggaggaagttcgaacccaatgcaaagaagttaaaaaccttgaaaaaagattagacaaatggctaactagaataaccagtgtagagaagtccttaaatgacctgatggagctgaaaactatggcacgagaaatacgtgatgaatgcacaagcttcagtagctgatttgatcaactggaagaaagggtatcagtgattgaagatcaaatgaatgcaatgaagcgagaacagaagtttagagaaaaaagagtaaaaaggaaagaacaaagcctctaagaaatacgggactatgtgaaaagaccaaatctacgtctgattggtgtacctgaaagtgacagggagaatggaaccaagttggaaaacactctgcaggatattatccaggagaacttccccaacctagcaaggcaggacaacattcaaattcaggaaatacagagaacaccacaaagatactcctcgagaagagcaactccaagacacataattgtcagattcaccaaagttgaaatgagggaaaaaatgttaagggcagccagagagaaatgtagggttacccacaaagggaaaccaattagactaatagcagatctctcggcagaaactctacaagccagaagagagtgggggccaatattcaacattcttaaagaaaagaattttcaacccagaatttcatatccagccaaactaagcttcataagtgaaggagaaataaaatcctttagagacaagcaaatgctgagagattttgtcaccaccaggcctgccctacaagagctcctgaaggaagcactaaacatggaaaggaacaaccagtaccagccactgcaaaaacatgccaaattgtaaagaccatcaaggctaggaagaaacagcatcaactattaagcaaaataaccagctaacatcataatgacaggatcaaattcacatataacaatattaaccttaaatataaatgggctaaatgctccaattaaaagacacagactggcaaattggataaagagtcaagactgatcagagtgctgtattcaggagacccatctcacgtgcagagacacacataggctcaaaataaagggatggaggaagatctaccaagcaaatggaaaacaaaaaaaggcgggggttgcaatcctagtctctgatgaaacagactttaaaccaacaaagatcaaaagagacaaagaaggccattacataatggtaaagggatcaattcaacaagaagagctaactatcttaaatatatatgcacccaatacaggagcacccagattcataaagcaagtacttagagacctacaaagagacttagactcccacacaataataatgggagactttaacaccccactgtcaacattagacagatcaacgagacagaaagttaacaaggatatccaggaattgaactcagctctgcacaaagcagacctaatagacatctacagaactctccaccccaaatcaacagaatatacattcttctcagcaccacatcacacttattccaaaattgaccacatacttggaagtaaagcactcctcagcaaatgtaaaagaacagaaattataacaaactatctctcagaccacagtgcaatcaaactacaactcaggattaagaatctcactcaaaactgctcaactacatggaaactgaacaacctgctcctgaatgactactgggtacataacgaaatgaagtcagaaataaagacgttctttgaaaccaatgagaacaaagacacaacataacagaatctctgggacacatttaaagcagtgtgtagagggaaatttatagcacgaaatgcccacaagagaaagcaggacagatctaaaatcgacaccctaacatcacaattaaaagaactagagaagcaagagcaaacacattcaaaagctagcagaaggcaagaaataactaagatcagagcagaactgaaggagatagagacacaaaaaaactcttcaaaaaatcaatgaatccaggagctggtttttgaaaagatcaacaaaattgatagaccgctagcaagactaataaagaagaaaagagggaagaatcaaataaacgcaataaaaaatgataaaggggatatcaccaccaatcccacagaaatacaaactaccatcagagaatactataaacaccactgcggaaataaactagaaaatctagaagaaatggaaaaattcctcgacacatacaccctcccaagactaaaccaagaagaacttgaatccctgaacagaccaataacaggctctgaaattgaggcaataattaatagcctaccaaccaaaaaaagtccaggaccagacggattcagagccaaattctaccagaggtacaatgaggagctggtaccattccttctgaaaatattccaatcaatagaaaaagagggaatcctccctaactcattttatgaggccagcattatcctgataccaaagcctggcagagacacaaccaaaaaagacaattttagaccaatatccctgatgaacatcgctgtgaaaattctcaataaaatactggcaaaccaaatccagaagcacatcaaaaagtttatccaccatgatcaagttggcttcatcccagggatgcaaggctggttcaacatacgaaaatcaataaacgtaatccagcatataaacagaaccaaagacaaaagccacatgattatctcaatagatgaagaaaaggcctttgacaaaattcatctgcctttcatgctaaaaactctcagtaaattaggtattgatgggatgtatctcaaaataataagagctatttatgacaaacccacagccaatatcatactgaatgggcaaaaactggaagcattccctttgaaaactggcacaagacagagatgccctctctcaccactcctatgcaacatagtgttggaagttctggccagggcaatcaggcaggagaaagaaataaagggtattcaattaggaaaagaggaagtcaaattgtccctgtttgcagatgacatgattgtatatttagaaaaccccactgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccatttacaattgcttcaaagagaataaaatacctaggaatccaacttacaagggatgtgaaggaactcttcaaggagaactacaaaccactgctcaacaaaataaaagaggatacaaacaaatggaagaacattccatcctcatggatgggaagaaaatatcatgaaaatggccatactgcccaaggtaatttatagattcaatgccatccccatcaagctaccaatgactttcttcacagaattggaaaaaactactttaaggttaatatggaaccaaaaatagagccctcattgccaagacaatcctaagccaaaagaacaaagctggaggcatcacgctacctgacttcaaattatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctcaaactggatcccttccttacaccttatacaaaaattaattcaagatggattaaagacttaaatgttagacctaaaaccataaaaaccctagaagaaaacctgggcaataccattcacgacataggcatgggcatggacttcatgtctaaaacaccaaaagcaatggcaacaaaagtcaaaattgacaaatgggatctaattaaactaaggagcttctacacagcgaaagaaactaccatcagagtgaacaggcaacctacagaaggggagaaaatttttaccatctactcatctgacaaagggctaatatccacaatctacaaagaactcaaacaaatttacaagaaaaaaacaaccccatcaacaagtgcgcaaaggatatgaacagacacttctcaaaagaagacatttatgcagccaacagacacatgaaaaaatgctcatcatcactggccatcagagaaatgcaaatcaaaaccacaatgagataccatctgacaccagttagaatggcgatcattaaaaagtcaggaaacaacaggtgatggagaggatgtggagaaacaggaacacttttacactgttgttgggactgtaaactagttcaaccattgtggaagacagtgtggtgattcctcaaggatctagaactagaaacaccatttgacccagccatcccattactgggtatatacccaaaggattataaattatgctgctataaaggcacttgcacacgtatgtttattgcggcactattcacagtagcaaagacttggaactaacccaaatgtccatcagtgatagactggattaagaaaatgtggcacatatacaccacggagtactatgcagtcataaaaaatgatgagttcatgtcctttgtagggacatggatgaagctggaaatcatcgttctcagcaaactaccccaagaacaaaaaaccaaacaccgcatgttctcactcacaggtgggaattgaacagtgagaacacatggacacaggaaggggaacatcacacactggggcctgttgtggggtgagggaagtggggagggaaagcattaagagatataccgacaagttaatgggtacagcacaccaacatggcacatgtatacacatgtaacaaacctgcacgttgtgcacatgtaccctagaacttaaagtataataagaaaaaaggaaaaaaaagaaatgctatttacattaaaaaaagaaatataacaaatatatttgattaagcaatattcacacatattttacatgataaattatgctcacattttcctgttttatttctctccatcctatacgttaggtatttcagaaattttgatgtgtattaattttgtttttgaggagggtggtggaaagggtctccctctgtcactcaggctggaactcggtggtgtcatcttggctcactgcaacatctgcctcctaggatcgagggatcctccaaccttggcctcctgagtagctgggatcacaggcctgtgccaccatgcccagctaatttttgtaatttttggtagacatagggttttgcatgctgcccaggctggtcttgaactcctggggtcaagcaatcctccctccttggcctcccaaaatgccagaattacaggcatgaataaatgtgcccagccaaaagtggattaattttttaaaatggttttcacactgggtgcagtggctcatactttgggaatctgaggtaggaggatctcttcaggccaggagttcaagaccagcctgggcaacacagtgagacccccatctctaccaaaagataaattagccaggcatggtggcatgcacctgtactcctcattactcaggaggctggggtagaaacatcgcttgagaccaggagcttgaggttacagtgaactagaattgcgctactgcactccaactccaggtgacagagcaagatgctgtcttaaaacaaacttttccatccacatgtgctagtgcagaaatggaaacaaacaacatggagttgtgaggtaatgtttactcatcaggtgctacccttagatgtcacacatctccttgaatattttctgttcaataagaaatgtgtgaaaaagtatatttttattcgtaggcatctcaagcactccaacatggttttgtagggaaaatgatatattcaatgaaggttttttttttcaaatgttggctcttttgaatattgcgcaggggaagaatatgggcttgggatgcagggactagagtctgctttctggctctaccaattatccgtgtgatctgagtaagttaccctccttaagcctgttttctcatctgccaagcaggcataataaccccaaccttcctaaactgttgcatgagatgacagtgtatatgactggtacacaatagatgtgcaatgaacgcaaacactcatcatcttccattcctttggctgcacttatgcccccttagtatacattttcttgtttacaccatgcaaaacacaatgtaaaaataatgcattcacctttatgtgcaaaaattatacatctctttgttagtgcaatcctctcagttttttgtcaagtttattcttccctgctcccctcatgctaccaaaaccttattttcctgatcatcactgcctaaactattggaaaagcaggaaaaaaataagaaagctagaaatgaaatgggttaatttagtaatttttagcacccttaaataaagaataaatatgtgagatttgtcattgaccaaaatgccataggaagtagcaattttcaacagtgtctcaattattcatgctctctttccttatccaatttactttactaagtatttattacacttaaatagattcacatatttgaattaaaatcatatagttttattatttaggaacttgattactcttacatgtatcaattactcaccccagttctctgaagcctttagcatgtgacttactgtattctcctccaaccacatttctgttatctctttggtggtagtataatttactcaacactcaacatcctggctgcagagttagacttacttatttccaattaccttttttgtttgtttgtttgtctgtttgtttgatttgagatgaagtcttgtctctgtcctccaggctggagtgaagtggctccatctcggctcactgcaacctccgcctcccaggttcaagtgattctcctgtctaagcttcctgagtagctgggattacaggcatgtgccaccatgcctggccaatttttgtagttttagtagagacagggtttcaccatgttggcaaggctggtctttaactcctgacctcaggtgatccacccacctctgcctcccaaagtgctgggattacaggtgtgagacatcatgcctggccccaatcaccatttaaaaaaaaaaaatcattcacgcatcttgacacatactatcatagtcactctctggaaattgtcttgtctagtaaccatatcatctccaaaagtttcctctttggacaccaccttccatcctcactgcaacaattctatgatttcctacacttcccaattcattaatcaccctgttttgtcacactgcttcgctcccatgatagtgactcttctctcctattcctagacatgttctatgatctttctagggaataccctctattctcttgcgcttctctctgtccagtgaattgctctatcaaaatcacagtcattgtacaattaaattcaattgtacatcttctttgcctgcacccaagaagctgaacattgtttaataaaatgataaaattttattgtctgacaagaccaggactaggctgaggcaaatgagatgcccagggcatgactccgagagggaatctatctccctgaattttgcatgctaggtgcctcacttcctttaccttgtccctgctgtctggtcttactttaaattcataccctcagatttcacatggacaatcagcattgctctgcaatcctatcacactttcccagttggcccatttccccctcgcttctaggtaatatttgactgtttcatgacttattctcatccctcacatatccaacaccttccttcccctgtcattccggcttgcttcatacgtttccactgagaaaagacagcaatacaaaaacttcctcatcattccaccacaaaatctaccgcctacctgtatccacactcatattctcccatccctcctgatgcaacacatatcccaggtccaatcaaaggaatgtcctcccttggtgctggggccccatcactctcaccttccatgcactttcagttcagttatcttttctttcttttacataaacaaatttagacttttggcagaagtatccccatcaatttacaaatcagttctaatagctctcaagaagaaagcaactaaaatccgttactctatccccacagactcattcagctactgcttcatttttcactcccttcatggtaaaattgtgttcattttctccactttcttatttctcttttactctttgacacattttaagttaaaatttaacctcattcctccactgatgagtctcaaatttatatgtctagccctgaatgcagacttttccaattatctgtatctccacgttattgtttgataattatctcagacacaatgcttgattcttacatatttccaaacatgttcttcagacagtcatctccgcttagtaagcagcttactgtccaaccattcaatcaattcaaaacctaatttaatacccacatctatagcaacacacaggactaaatcttaatgtaaactaagttaataatgatgtatcatactgatccattagctttcatacatgtaccacattcatacaagatgttaacggttgggggagctatgtgtgtgtggaggggtgtaatatagaaattgtgctctatgttcagattttttgtaaatgtaaattattttcttaaaaagtctaaatttttttaatggtgacattaattttaatatactttatgtaaactaacatatgaaaaatatcacatcaaaatataatcaatatagaaatattgaggtactttatgcacttatttcctaagtcttcaaaatcttatgtatactttatactacagcttatcacaattcagattagccctgtttcaactgctcaacacccacatggttagtgctgaccagattaaaacaacacaggtctaaaaggcagataatttcagcagccactgctccctcgctccaacactccattcactggggatgaaggcccactgctgagcctttctcatctggcctcctcttcaactggactgaaccccccttcaatcatttcttccctaaatgtatgtggaccaaccaaagactgacgtatggctcagtggatgccagatctggagaccagatcctaaaataaaatctaaacttctccagaggtaaaaataaacaaggcccatatctaggccaggcatggtggcatacacctgtaattccagccacttaagaggctgagttgggaggatggcttgagcccgggaggtggaagctgcagtgagctgtgatagcaccactgcactccagcctgggtgacagagagagaacctgtccccaccccctgctcaaaaaagcttacatctaatgcatggacaggttctatcttcagaacgtatctagaatttgcccattctttttaccccctcttgcattaaccttgtcttggctactataacctctccctgaactcttagcaggtatcctgcattcacactgaacaacaacaatccactctctaccctacagtcagaatgtcaatgaaacacaaatcaaataatatccctcttcttgatatccttcaatggcttcccatttcacttagaataaaactcaaaggcttatcatggcctttaagtctcttatttatctgatcttgctcattttctgtactccttccaacctggtcttctttctgtttgcaagcacatgaaggttgctctctctcagggattttctgttttctcttcccagtgttcttcccgacttgatcttctgactggcttctttcattactcgtatcccacccaaaatatcaagagaggcttgtcggatcaccatatctaatttagcctgatttctatccctgtcattcactattacacacattattgccttcatagtacttttaaatatctaaaaatatttggtttgtttaactgatcgatataaatcgctggatgatatgcctgtgattgtggaaaatatttctatcacattctccaccatatatatagctcagactattggatgaggatccaaataaatattatctttttcctgggcacatagctaggctacccttttccagtcttccttgcacttaggcatggccaaattattagttcagacaatcaattgtgagcacacgtgatatgcactacataggagggcattaaaaccccctaagtggtcttctatggtcttttctcttcctagctggctagaatgaaaatgttatgctggacactttgagcatctgcatgttaaaaacgacagaacttacattaggctggattccagcgtgagtgcatgaatatccgtgctactaacctgttaatccaccattcctttagcataattgtgtgagtataaaacaaacttctattctgtttgagtcattacaggttgtcagtctatttcttccagcagacacccataacatccaaatatctagtgagttctcaatgaatagttattaaatgaataagtgaaatcatattaagtctggaaataaatgtttcacttcatgtcacattataaagcttcaagaatagtgtagagtgagtatcagacactggcatggattaataacttgtttcagattgtccttaagagttaatactcattacttcaatgtggatatatataatataaggtggacttgagaaagtgtaatcattcttcagaattgcactggataagtatccatgtttatttaccttggctaaaatacacaattcgtttccataaaaaccaaatatagaagtattaaaaatgtgtgcccaattttaggttgaaaatggctttaactgttttggtgtgttaaaaaaaaaaagacacgacaagaaatgtagttgaatagcatttctaattctctgaaccaactcttcttcttgatctatcaaaaaactgagataacagtaatttctcctgtggaaatgtcttcatgatccttggataaaatgtgctttaaggttgcaaagtgtcattgtcattaatgaatagcactatttgagaaacagaaatagaccctataattgcatttatagtactcaaataagctgattcaacttttaaaataggaaaagacccattattctgtgatatgcatctcagggaagcagatgaattaggaggtttaaataaaatctcttgtaagaaaagtaaccacagagactattaaaatatcaaatgtttggctaaaggaaataaataaaaaagaacatataataattaggcaagattaggtaatatatcttaaaatgaatgtgagaacaaaccaaaatacgttacaataccctgaatctaatatattttcattctgtaacagaaatcctcttttcatcttatgtacttgaagccctttattattttttctggggtacattaaatactttacatataaaaatgtgtatatatgacttccattataaaaaggactttgctttattaatcattgtatctctaatagtgatgattacatatatgagagaagtgtgtgtgtgtgtgtgtgtgtgtgtgtgtacatatggtccaaccttttcaaatttgctgtactaggaaaaggtctttcatcaactagtccattgtgttggtggaaaaagaaagattctctttccatctggatttacaagagtcacatttatcagtctttataatgatgctctcatggcttgtataagaatctcttttgtacccccaagtctaaaagttattagtttacattttttactaagagtttttaaattatgctgttgatattttcatttaatatacctgtagttgacatccctaccatagtaggtaagggatatgaggtagaaatacaatttcactttttttctatattggtagccattttttcagttctttttgttgaataataccctatttcctactggctggagcaatgcttctattttatatctaagatctgtaaatggatcttgttctggcctatcctgttgcattcaccatttgtccatccttgacacaataccaatggtcaatataaattactaaagttttataataagacaaagcagtatgacaagtttcctatttttctttcttagaagtgttctaccttctctttgctttatacttctccatataaaatgtagaacaatctggctggcatgttggctcatgcctgtaatcctagcatttggggaggctcaggcaggaggatcgcttgaccccaggagtttgaaaccagcctgggcaacaaagtgagaccttgtctcaattaaaatatttttaaaatgtagaaccgtcttaataatttccatgaacaacactgtatagattatcactggagaatttataaaatctgtaaatcaattgggaaagatttaatatctttatattgtcttcctaaccatgtgtattgcttgcttccattatttagaccttctcttataagtcttaaaacagttatataattttcttttcatagcacctaaccatttttgtacatttattcctagataatattatctgatactattgttaatgtttcttaaactacattatctattactttgctgttagtatacaaaatgcagctaactttttctgtatcagtcttatagctagctcagtggttgaggtgattttgtccctcacaggatatttggcacaatgtctggagatatttttgataatcccaactgggaaggtgatgttattggcaactagtggaagaggtcaaagatgctactaaacatcccacaaggcacaggacagtgtcctacagcagtaaattatccaaaatgtcagtagtttcatgtttcagaaaccgttgcaaattcttttattatacctaataattgatctctagattttttatttctatggaaagcatcaagttttctgcaaatatttatatttttatgtctcccttaacagttcttgtagcttaaatatttttttcttcttttcttattgtactatctaggaccttcagtacaatgctaataagaagtggcaatagtgaacacctttgcattttttttaactttaaaagaatgcctcccatattccccagttagtatcatattcatttaggccttttatgtgcacttttcatcagtttaagaaagtccctcatattctaaatgaactaatatttttattatgaatatattttaaatgttagcaatcttttttcctttaatctgttaccataatgaattatatttctatatttctaaatgttgcattatggaaacatggagtgaacacaacttgatttcaataatttgcatttttattcactattggattcgatctgctaatgttttgtttagaatgtttacattcatacttatgagtgagaaggatctgtaatttttgtttcttataatgttcttcttgtttgggtatcaggttatactgacctcaaagaataaatgggaaagtagtccctctttttcttttctttttttttgttcgagacacagcctcgctctgtcgcccaggctggagtgcagtggcgtgatctcagctcactgcgacctccacctcccaggtagttcaagagattctcctgcctcagcctcctgagtagctgggattacaggcgtgtgccaccatgcccagctaatttttgtatttttagtagagacagggtttcactgtgttgccaggatggtctcgatctcctgatctcgtgaaccgcctacctcagcctcccaaagtgctaggattacaggcgtgagccactgtgcccagcctagtccctcttttcctattgcctgcaaatgtttgagtaaacttgtaataatatctttcttgaaagttttgtatagctcaactggaattgccctaaatgcccacaggatagtgaacaaatcaatcatggtatatggtaaattcatacaatggaatattatactgcagtcaaaatggatgaactacagagatggccacaaatatagataaatctcagcaatatattaaatgaaaaaagtaagtatacaaaatacattttataaatgtgtaacaattacttaaaattttttcattcattttgagaaagatgcaagacaaatgtattttaaaaggcaaaggagtgttgttagttattcaggaggaatgagaatgggttggtaatttaaatacatgtttaaatatagctttttgtcaaaatactagcttttggggacataagagtgttttcatagatgcatattacatttttaaataactaactaaataaatgaaagtcactttgcatggatcaatgataactatgtgtcataagccaaacagccaataaatagaggaaaaaaaagcagaagagggaggaggaggaaaaaaggagaggaagggataatgaaagagtgagggaaggaaatgaaaggtagaaataataaatcaaataacaaacattaaaaaaatggggaaaatccacactaaaactatggaaaagaaaggtatactaaacaacaattctttaactttcgtgtaactctgtgaattaactgactgctacttaggcttgctattgtgcccatggagaatatgaatcctccccggaggtcaatgaacccagacaaaataggtcacatacagaattgcctttacccaattctctaaagcagcttttctgcacatttttagattttacatcagtcaaccttctgtctgttatttccggtttataaactataactgtgtgggattagaatcgcattacatttttaagccaaaaagcttaattcattttttttcactttgtacactttttaaagagtaaaatcaggcagaaagtcacctcttcccagttgagtcattatttcacttcttgttaagtttcaaattgttcttttatcttgggttatgcatgcctttgtaataatttattgtttgaataaggtatagtctttcaatgcatttaacaattaatattttcttaatgtttgcagaattacagtgagccaatcaaatacacaggactttataggaacagatgcctaagtgtctaaagaaataaaaaaaatatcaaactaggagagatctactcatctctgacaataatttatggatttaacttaaaaagatagcagataatttatttataatggacctgattttctgtaattacatgaactgtcaatgaatattaggccactgtgatagatgtgaattgtctatgttactatggtgatttgaggtgtttctattctacactgcacgcataacaatgtggagcataattaaaagacatagtgaaatatattttaaaattgctgtcaattaaaaagcaaaacatagtctgactttagcataatcctttcagaagctggcctatcaaactgatgaaaacaataattattagttaatatattgtcttttcaaatgtatctaaaacatttacaaaaatgattattttctgccaaaatgaaatgctagcaatcatgattttgaaatcttagttcatattctctgaccattatgtgataaaacatgaaattcttaacaaaagccttaaaaaattaaaaagttaacacaacaccaaataagaaaaaaacaatagcctccaaagatttagaacaaaaaactaagcacttattttaattaattagtcaaagaaaaaattaaaattaaaatcatagagtgctatttaacagataacaatatatcaaaatacctaaagaatgtgaccaaggctgtcatcagaggaaaatttagagaataaaaagttttattgaccaggaagaaattgaatccctgactagaccaataacaagtctgaaactgaggcagtaataaataggctaccaaccacaaaaagtccaggaccagacatattagcaactgaattggtatctaccagaggtacaaagaagagctggtaccattcctactgacactattccaaaaaattgaaaaggttggattcctctctaagtcgttaaatgaggccagcatcttcctaataccaaaacctagcagagatacaacaacaaaaaacttcaggccaatatccttgatgaacatcaatggaaaaacgctcaacaaaatactagcaaactgaatccagcagcacacacaaaagtttatccaggatgatcaagtagacttcatccccgagatgcaagggtggttcaacatatacaagtcaacaaatgtgattcatcatgtacacagaactaaagataaaaatcatatgattatctcaatggatgcagaaaaggcctttgataaaattcaacatccttcatgttaaaaactctcaataaactaggtattgaaggaacatgcctcaaaataataagagccatagactacaaacccacacagccaatatcatattgaatgggcaaaagctgaaagcattccccttgaaagctggcacaagacaaggatgccctctcttaccattcctactcaacacagtattagaagttctagccagggcaatcaggcaaaataaaaaaataaagggtattcaaataggaagagaggaagtcaaattatctttgtttgtagatgacatgatcctatatctagcatagaaaaccctataatctgtctaaaagattcttatgttgataaaccactactgcaaagtctcatgatacaaaatcaatgtgcaaaaatcactagcatttctatacaccaacaggcaagccaagagccaaatcatgtatgaactccctttcacaactgccacaaaaataataaaacacctaggaatatagctaacaagggaagtgaaggacctcttcaaggagaactacaaaccactgcccaaagaaatcagagatgacacaaacaaacggaaactcatttcataatcatggataggaagaatcaatatcgtaaaaatggccatactgcccaaagcaatttatagattcaatgctattcccattaaactaccaatgatattcttcacagaatcagaaaaaaactatcttaaaattgatattaaaaacaaaaaaaaactcgcataggcaagacaatcgtaagaaaaaggaacaaacctggaggcatcatgcaacctgacttcaaactatactacaaggctacagtaaccagatagcacggtactggtacaaaaacaggcacgtagaccaatataacgaatagagactcagaaataaaaccacacatttacaaccatcttatctttgacaaacctgacaaaaacaagcaatggcagaaggactcccgatttaataaatggtgctgggagaactggctagccatatgcagaaaattgaaactggatcccttttttacaccttatacaaaaattaactcaagatggattaaagacttaaatgtaaaacccaaaactataaatccctagaagaaaatctaggcaataccattcaggacataggcatgggcaaagattttgtgatgaaatcatcaaaagcaattgcaacaaaaggaaaaattgacaaattggatctaattatactaaagagcttctgcacagcaaacaaaactatcatcagagcaaacagacaacccacagaatgggagaaaatttttgcaatctatccatctgacaaaggtctgatagccagaatctacaagaaacttaagcaaatttataagaaaaaaacaaacaagtccattaataagtgggcaaagaatagaaacagatacttctaaagaaaagacctatgtgcagccaacaaacatatgaaagaaagctcaacatcactgatcattagagaaatgcaaatcaaaaccacaatgagataccacctcatgccagtcagaatggcgactattaaaaagtcaagaaacaacagatgcttgtgaggttgtggaggaacaggaacacttttacactgttggtgggaatgtaaattaatttacccactgtggaagacagtttggcaattcctcaaagatttaaaaccagaaataccatttgacccagcaatcctattattcagtatatacccaaaggaatataaattattctattacaaagatacctgcacacatatgttcactgcaacactattcacaataaaaaagtcatgcaatcaacctaagtacccatcaataagagactggataaagaaaatgtggtacatatacaccatggaatactatgcagccctaaaaaggaacaagataatgtcccttgcagggacatggatggagctggaagccattatcctcagcaaactaatgcaggaacagaatatcaaatactgcatgttcttacttataggtaggagctgaatgatgggcacctatggagacatgggggaacaacacacactggggcctgtcagatggtagaggataggaggagcgagagcatgatatagagacacgtttttttaaagttaagcaccaaaattagattatttttgttagtaaagtgtaaactaatctaatttttcctctttattattttatttcctgtaataatcattttatttttattaaaaatacattaaaaatatttgctttgaatataggaaatatggaagacctggaagaataaaataagaaaagttatattttggtaaacaatacacatcgtatcaatggctaatatatgcaaattttagcagatagaagtagctctcagaatctgctgaccacaatgctttcccccataaagtggagaagaaatgtggaagagcctagttccattaccctggttctgtaaaaaacaaacaaacaaacaaaaaacaaattacagttcaccagtgagtccagttcaagttggccagacttgaactgagaagaacactaataatattcatgtagtttcatctaaaagatgttagtaccagaaaataaaaaggaaatgtgtgtgttcaacaattgatgagcgctagcatcaatgctcctgaagatcttgatgttattcgctcttggtctgtgtctatagatagatataagctacttggagcacttggatgacaaaatctttttgattaaaatgaaaacaattgttgtgctaaaacaaatgatcgaaacagttttcatgacactgatattcttatatcatttaatcttaaatgttgaagacctttaaatagttaaaaacatatctgtttttttgaaaagcactaggaattaaatccatgtccaaaaatacaattttttgtatgttaaaataacctctttcactaaataactatttggtacatatagaatgttcatattaatctatttatatgtaccatataaatattatatgtaccatataaataactatttggtacatatagaatgtaaaaattgaaagaatttaagtccctattttataattaattccatttagttttaatgctaattaagagagaacactctatttctcatatttttagtatatcacaagtatatgaaaaaatgcctattttatcttaaaacagctatgctttcaatgtaattttatagattttattagtatattagttatcttttacagaagataaactacatagaatttagtttaaattaggaataaatttcttggcttcatttaaaaggagaaggaggttattattcatgatcattagaggaaatatcctattgccattttaaagttcttttatatggaaacacactgaattaaaaagtgaaggaattaagattgattagaagtgttttaaagtggcttttagatgtatctgcaaaaataaaaagtcagttctatcccaggccattatcagctgtcttgttaagtgcccctagcattctcatattgaagtcctgcagtgccacataaaataagtcctggggaagatctgaccccaccttgtgaatttctctgggctttgccttatttccccttctcattcatcaactgaatgggtttcctgaccccacaggcaagtgaaacttggtttctcactttccttgtttcctttgcatttcaaaacttagctctagactattcaatctcaatgttatcttaaacccctatagtatctggggtttgctcatattttctactggctgcaagctcaaaattggtgtaccagagcgctttctaacatagcccagtcctccaacacacctagaaacacacctgcctaccttctccccctggccttcctgccttccttcctccccccacctttcagggagattgtacattttcatcatctccactgaaatgattactaatattatcaaatgattattgggtccttatttgcagacgttatgagtatatggaaatataagtctagcctttacttaagacaatacctgagattttagtgattttatctccaaagcagtgatgttaatgtttacttttaatgatgaaatgttaaataatctccatgagggtcatgactagacaaccatccaaagagagaagggtctagcagtagaaagagcagaggctttagactcaaacctgccatcactgtgagatcctgagacaccatccctgtgcgtgttccctcctcttacgggggtgaaagtcacccacatcatagactgggctggagaattaaatgactaaacatttacaaaagtgctatatgttgtcaataattgttagtctccctccctcagtgccatgtctatgaaagtagaataagtcaataattttgttcagcccaataactaattaattcaaaaagctaattttatctttccttgcccattgatttgatcaagagtataaaaaataaacaagttgacatttcattttcttcaacatgaattcccgtttgaaaagagttaatgccttatagctatttatgctcatattggtgactaatatcaactttctgtatttcccactatatttggctaattgaaaaatttatcaactgaatccaactaactctaaaaatatatattaattaagaacattaaactcatacgaccctttactttgagtattgttgccttctgttgaggcctaactttatagagttttaatgcagttatttgttcctgagaataaaattaaaatttgggtacatcacaaaatgtattctttcagaaatataatttttacaccacatgctctgaggagtttttttttaatttctgttatgagtctcatatttttgaactacctctccctaagaactctggtacattactggaattagcatcagtaggcaaaattccctatccaaatgcataacacaggtggcatacctgttctttatcttacttgggagaggaaacctgatcccttgctttgtgctgactgctactcagatcacagacacacttgttaaaggactataatgtgattcagctcaaccattaatttatgagataataaatttaccactttattcaaacaatattagatttcctaaatacacacaagcatttacacatcataaattcaccactaaaaccacaaacattcttgtactagaaagttgatattacaggtaaatggggctggcatttcacatatatgtattttttcaattcataaggggatgttttacacattccaaaatgtctgaaaagaaaataaaaatattctttagaatttttatgaagctatatttttcttcctttgaaattgctaaatgctttatgcattctgatttaaatgccttttggaattgggatttctgaagtttatagatgcatttacctttatgactaaaaatctctcagaaacttatataaaatacatattttgtatttttaaattatgagaacagcataggagaatagtgtatataatatgtaaagttattccctggggtccagagaggcttggtttctaggcctcccatggataccaaaatccaaggacactcaagttcccgatataaaatggcatataacctatgtacatcctcctgtatattttaaattaactctaaattacttatacctaatacaaggtaaatattatgtaaatagctgttccactgtattgtataggtaataatgacaataaaaaagtctgtacatgttcaatacaaatgcaattttttaaaaaatattttccatccatggttttttgaatctacagatgcagaatccatggataccaacgatacaaaagaagattctgcaacccccttttatctgaaggaaaaacaaaatcagagaccatacttctagtttttttttctgtcatctgaaagcttgtaggaattcatctaagtctgtaggttatctcattagttaatttgttcttataccctaactaaattcaaacacaaaataggaatttttataaaaataacaaaagcacagtaattgaaagtgcctttaataaactggatgccttgtgacattttatctttcaataatatacaacttatttatatttatttaggttcttttttcattttatttaacttttgttgcatggatttctaaagttcttcatcatctcaatagcaatgatgttattaaaatagctacgccacatttaaggataatttgtaatgttaccttataagaacaaatgatcaaattatctcattggagaggaggaaaaaaataacactttattggcccattgtcaagttcattgattgtatatcaacaaaagaaaactattatctgagggccaatatccaattaaatatgctagcatgcatgtgaaaatgcattatccaggagagaataattaattcaaagctcgaaggagtcatgacaccagaaatctatttttgaaatagtcatacaatttgggtgcgagggaaggatatgataagcaaaaaaagaaaataaaagaaaaccatattgctttaactgtacagaatcatataaataaaaatgactaaggaacaaaaataaggactcttgttctggagatgagtagtagtgatggttgttcaacaaggtgaatgcacttcacatcacgaaactcaaaaataattaaaatgacatattctgttatgtatattttactgtaatttaaaaaaaagaagttaaataaataaataaataatggttctggatatttccagataacaaaccaccaaaaagcaaatacaaaaatggcttagacatcgttgctctgttgaaagatacttatttctccttgcacaaaatattacagtgtagaacattaatgtctccctgaaacatgtggctagaaaagaagcattagcctgttgtgtaggccaaatttaatttgagtaattatgttcttgctacctcgaagtcccttgaagtctctcataatctgtgtcccttctatgcttaatctatttacagcagtctgtggcctttcgagtaatcattaccatctgcccctaaggtagctgcatttcagcagaagggatcatgatttctgtattttagaagtacccaacatgaacaattattcccctgaaggtagatgatacaaatatatacgagatcacctgtgaaataaatgaaaaatcttcataaaaatgggtcatttttagtagtgataatattaatttcccattcctcctatctcctgaagtttgtttaaactgacacttttccatgatgaaggtatatttcgaaaataaataaataaataaaagcattatataccacacttttctgtaacatgggtgtgatatgatttttttaaataatacatttatatttttaaaataaacttttatcaggtgctaaaatatattttttgtttagttttgtaaactgggttgcctaagtaccactgattaattttaataacacttcttctttccctcattgtgtttctagaaagagccaactctatccacaaaaagaaggggagcatcttgtatgacatagaagcctccagataccttcctactgctctggcacaaggcagagaaattcccactattagcataactatttggattaaccacaagattatgtgtaaaatgcaaaagaattattgctttgggaagttaacccactaatttgttcatatattagcacagacaactttatctgttaaataactcaatgcaggattctgatgggatggggcatatagacaagtaggtttatttagaaaggcagcctagagtactggaaggggatgctgggtggacatgtattgtaggtcagccagaagtcactagagaatggaatggagtaccatagagagggccagcaggataaaaagcaattgtcaagtataaatcactaggatgtacctaagataacattcgcctgtgatgtaacttagtctatcttgcttcttaggtgtatttatagaaggtagggcactacagaacaagtcagaaacatcccagtctagacaccctggagccactcattctctccctgaatatactataccaggttcttcaccaagtaatttctgtaagttgtcccatgtatctttcctttgactgtgggcccagtttcactggccttctgggcaccccactgccacttctgtactctacttcaacctcactgcattttccacctcacgtgccactgaatctcaccacacaatctactctagccacgtggtccactggagctacacgctggcttccccagggacatccactctcccaaaattgctcaagcacttcaaacaacctaaaatgcgtatctgtcttttcttctgctatgaaactctgaatcttctttcaagtgcttgtccagatgccacttccttggcatgctcttttcctgccattcggaagtaactttaacactttgcttgcatctctctttagggcatctattttattttgcatggaagtgcatctactgaccacatagtacatatgaggtcacaaattgtaagaggtaaggatgtatcctcccatcccctggcatagtgccttacccaaagcagatgcttaacaaccatttattaaatttatttccagcagtgtggggtccaaaggcccaaagggggagttatttgagagtgcaaaggggcaaatagaagggacatgaagacaattccataggcttatctctcggcttctttgtacctttctgatagttttcttaattttcagtctcattacattagtaggggtcataacagtgctggaagccagtctccagcaggactagctcattctggagtcacagccaagcaagaagaggcaaagttaggacatttcttccctgcaagcctaggaagggtattgtttcaaaaagcaaaaagtgaaattacactaaactaaagtagcatgacaaagattaaaataggggacaacaatattgggattaatactgatcacgattaaatgaataatgtagcaatacctggattttcattagccagttctggcagtaataattttgtgttcagcagactcagaagctgtggtgtgaatgagactaacaactaagcactctctagttggatgatgtgaagaatcatttaccacatcttgctgaagaacattacaggttataaaaatgtcatctagaccatgcagacaagcccatctgtatttaaggctgaattcctttgaaataaaagcactccatgtggttcaaatgggtctgtgatttcaaatgtcagaaaactcttaacacataaccagaacacacagaccataatagggcaatcgaaggaatgtgagatatgaaatctttccaatagtctcacttagagcctaactcatcaaaagagtccattttatacataaagataaaagagaatgttttaagaattttataacatatcaatataattaatcagaacctatgatagcctttagtgcaattaatggctggagttctagttcatgaggtgttaagaaggagaggtcaagatatttatgattgtcattggataccatatgccacgtgtgggagagagggaggtggagtgttttatgagaataaactagaataactaaggataaaatattatttcaaactgagggaaaacaaagctagtttattttctagaattatatcaatgagctagattgatgtttgagatgaaatcaactactttaatacctatgcatattgatttatgtataaaactatgcatttatatattgatttatgtataaaagtatgcatttatattatcaatctctctctctgtcagtatggacaaagaatatatattagggtgggtgcatatatattttctgcagtttttgagcctagaggaaatcaggagtaaagctgtctggttggatttcttgacaacgtatgtctactcccctccttccatccctgtcattttctgaaactagagtagttgttctggaccttccccccctcctacccaatcttccttcttcctttctgctctctccctgtctcctgatttcactttctttatttcaggtgtatacaggtgggaaagctcatgagaagagcgtccctatctgaattatattttgctacccttcttgccatatcaaacccaaaataactgaaagaacatactgctcggtaatatgtcattaaaaagtgaattacctctaaccaagagggtgtttaattatctagtgtgaatcaatatattctactattattagcactttttaaagaaaattggtataaatgcaccataaaatgtcataatcacttgctttatacactactactttggtcactgacaaaagcctgcatagttaacatcagcttatatttcattttgaatcatattcttcaagagctctgttagcaatgggaatactttactttttaaaagtttctcttgcctatatttatgtgctctctttgtccccagtgcaatggtctgtgactattcaataaaatcttttaaactgaccatctactgttctgaacccaaaacaaagaaaaagtctgcaaatctgtgggataaatttaggttggcttaagctctagaataacacatacttttagtccaataaaaagaaactcactatgagtaagcgtcagtgacttcaagaagcttacctttatttggtaagaaagacacaaatactattaatcaaaataaagaaaaaaatagtatgtgacatggagtaagcatggtgcagagtggcccttgggggagaaagagcaagatcatttctgctgagcacatgagaaagcttctttgagaaactattcactgttttgttccagctaccatatggagaagctttcttacattattccatttaatcctcacatccctgacaagtagggagttttactatttcatgatgagaaaaataaagcttagaaaaattcattaatttagtgaaaaaaattacccatggccactaatccacaggcctctttctacaccactacatgatcttgcagcagagactggagggtgggtgggatttggaaaggtaaaatgggcagagtagacaacatcagctgaggcacaaaggtatgaggatccaaagcacatgtctcttgtggcaaaattgttcttttttatctgaaaaaaagaaaacttctccacactttaacctcctgtcttccagttacacctcattggcaagactgtcatgggagctcctctaactagaacttgggtgggcacactgctatcccaaagtaaattagactgtattcagccatacaaaatgagtagatattgggtaggcactagcatcgtctgtcataaagggtcagccacataggaagcactgaataaatggtagctcttcattattgttactatatctcattagtctaaagaacacatttcctacacacaaacatttcttaatgagtatatattttacagtggttgtgaggagcacattgcacaactcggctttgtgctgaaggtatttgatgctcatccctgtgtcactttcactggaagcaccacacatcattagactttacatttttatttctaattgtgatttaaaatgtcatcaaaaaagatgatactgtaggccaggggcggtggttcacgcctgtaatcccagcactttgggaggctgaggcgggcagatcacaaggtcaggagatcaagaccatcctggctaacacggtgaaaccccatctctactaaaaataccaaaaacattagccgggagtgctggcggacgcctgtagtcccagctacttgggaggctaaggcgggagaatagtgtgaacctgggaggcagatcttgcagtgagccgagatcatgccactgccctccagcctgggtgacagagcgagactccatctaaaaaaaataataataataacaataataataataatgctgtaatacaacattcaagcaaagggttgttacaccaaatacgatagagatagagttgaagaaagcagatttcctttaagaggcagtgttgctagtggtcaaaaacacacttgctggaatcagaagcttccgatctagttcttccactcaagagccaggtgattctggggaagttactttctctcctgtttcttatccataaaatgggggtgacaatagggtaagtgtaaggattacatgagttaatattaatgagtgccaacaattgtgtttggcacataggaagtgcttaataaatgttaactatcattgttagtaataatgttggaagcaggccaggtgcagtggctcaagcctataatcccagcatgttgggagggtgaggagggtggattgtttgagcataggaatttgagaccagcctgggcaacatggcaagacccgtctctaccaaaatacaaaaaaatggctgggcatggtgaagcatgcctgtggtcccagctacttgggaggctgaggtagaaagatggcttgagccccatggggcagaagtttcagtgagctgagattgtgccactgtactccagcatgggtgacagagtgagaacttgtctcaaaaaaaaaaaaaaaaaaaaaaaaaaaaaatatatatatatatatatatatatatatatatatatagtttgaagcaatgatcactgtaggtaaaaaaaaaaaatgtgtattatcatgttataaatccaacatcaagtggtttccaatttttaagaaagaatatatacacatataattaaaaccttgtgtatatttatatgtgtgtatatgtccatgtatatgtatagctattaaatttaaaaaatcacctaatatgcatgcgaaaggataattaaaagcaacagaatttgtcaaatatcctggaatatcataggattttaaaaactacgagaagttccagagatccactgtgtttaattaaagactaaaactcaattactgtcaaaaacttccagctgatgttcaagaaaaactgtttaatatccagcagtatctacttctattatggaaaatttaaaactaggaattcaacaaaataggaaatgccaacaaaacctggtattcttccctatgcttcaacattattctgtcaaagctaaggcaagtgaagaggtcaagatcagaagcacaggctttggaaagtcactcaacagtgggtcaccgaaggtcgtgcagaatgcacagactatatatatgataaaggcttagactgaacttttgatcatgatacagaagagtctagtcaaataaaatcatttgaataaatgtatgaaaaagtgggtttggttaaaaggaaatcatgtacatttaatgtagagtttcgtcttttgcagaaatatgcttctaaagtcgatggtgaatcttacattagatggtatcttggatctatgttgtgattccaaaatttgtccttcagtgctaactgtgaatcaatcagtccaaactttatttgtggaatgaagtttaatattaaaatatatcgtattttcaaatttaaacataaagtttgaatcataaatgcctcatgtcaacagcggcctcatactttactcataaatattccctctttcattataatttggttgggtttttgaaaggaatgtagacaaagtgtgagaactcacatcatcccttggcttttatgctttaagatctaattttcaaggcttaaatatgtctgatgccgtgaccatatggcagtgttttccatggatagaaatgatacatccccaaggacagaagtcatgctgcaaaagaggatggttttcctcctattgaaaattagtctattcaatcaaaatctcatgaaaacattggctagttttctgtgtatagctcgcacttcacttaccagactgttgcctaaatcttccctattctggaagactgtatatacagtgcaagtattatatgatataaccaatttccaaatgctttctaattcccacagtggggaaagaacaactggcaacacagtgaattatttcagtttaacagctgattatcaagacaaataactggatattgtctgcagtgacaaccatgaccagggtccagggaaccacactcagaaaaggtcataatagataaccattttcccaaaaggaagaattattctctgtgaggatactaatgtctccctgttctgagttctgttcagtctacagtccattctctacactctccccagtgttattgaaactgcctttgcaaaatcatgatagcaagagaagtccgacagtgttgacgccatcttacttctgacctctgaggtgtccttggtcattcccgggcataggccaagctaacttttgaaggaatttagtttatagtttaacttgaaagctaggacgatactagtctccccttaaaactaaccctttccttgctcagggaccaaaaaccacctttgttagactaataaaaggccacaagaataggattatgggaggaacctgaactcttctgagatgtaggcatagtttctctaatctcttactgctctggagtcatgtggccagaagtcacaagatctctgacttctccaattgctcctatagataacatcattattgtagaacctaagattggtttttgagtactttttcagatgaatcccaccaaaacttgtgactcatgactcaactggccccatggccccacccagaggaagactcagcacacaaaggctgttttccacacccctatgattttattcccaaccaatcaacagcatcaattccctagccccctgcccaccaaacagtccataaaaaccctagcctccaagctattagggaggttgagtgatagctccagttctcccacatgggctgaactcatgtcagttaaactctatactgcaatagcaccatctcaattgattaattttgtctatgcagtgaacaggaagaacccattgagtgaccacattacaagtttaaaatgtttttctggtgagggaaagagaaataaaacatggcttgtctgattagtactaagtagtacttcaacttcatgatcattagtattcaaaagacttcaacactgcctgggaatctcactagatttcttagccatctggctctctctcactcggctcaacaaatagtgcccctcttctacctcctactaaatctcagtttccatttgccttttgcctcagctgatgaacttaccctatattttaccagggaaaatagaagtcatacaccatagcccctacttttattccacaactgaattttcaaggtcttttactcaccccctccctctctgtctctagagctgaagtagagagaaagtgttacattaagggtcaatcccactgcactctggtcatcatccctccacatgcccaggggcctctattcacaagttattatgtcttactgctttcttaacctcttcttccctgccaacacttaacctatctgcattcaaatgcagattggtttactttaggattaaaggaagaagtgacttcagggtggaagagagagaagaagaaaaggaagagagaaggagggaaagaaggaaggaaggaaggaaggaaggaaggaaggaaggaaggaaagaaggaaggaaggaagaaaggaaggaaggaagttcctttgataccctgatccttcttcagctaccaccgtatctttctacttttcttttcagccaaaggtctcaaaaaagttacctaaaagactatctccactcactaacccatcttccttcatccttcatccctctgtaatttcctccctctctcagcattgaaacttccatttcaaaggctacaaattgtgtccatgttgccaaaccaggagaggcttatcagttcttcctcacaatggcctctcagctgtgtgataccacccacatgcttaagagaaggcattctgcaggcttaggtaagtctgaatccaaggctcaccacacactggatttatctataaacttttaaacctcctcatcaataaaatgaggatagcaattattttcctccattggctttttgtagtgattaaatgatataatccatgtaaagtgcttaatcttgtacttggcacatagcaaagattctacagttgtcagtttttatagctggtaatactcttggtgttattcttctgtaattgttctctcatgttgcatttcattaaacaacactctccagaggaagagagatggttgtcccatttcctgcatacagtggccagggctggtgctatatttactttgagccatcatgattttgcccaggggtggcagcaatgttgtctttctcagatgacttttagggggtgattctagggccttgttcccagtgggtaatgctggaaggtctgcaaacttcacagtatcttttaataaatctcctttaggagccaagcacagtggtgcatgcgtgcagtcccagctactcaggaagtgaggtgggaagattgcttgagccccacagcttaaggccagcctatgcaacacagcaagacccccctaaatcaacaaatgtataagcacatttattgtgaaggatttagggggatcttgctctctacataaatagatggatagatagatagatagatagatagatagatagatagatagatagatagatatagatatagatagatataaatagatatataaatatatctatttatatatctatatatcttacgagttaaatttgccatatttggcttttattgcttgcaatgaaaaattctagtcaaatatctaactcagcctattcccttcttcaaatttcagattcatatattcaactacgcccctgacattccaactcagatatttcatagccatcacaaattaaaaaatgcagaaatgaactatcaagctccctctcctccattccaaaccacttgcctcttagcatatggaaacaccatccagagttgcttacatgaagaatctggagccatcattgaaagctctctctttatacattttccaagtggtcagttttgcctcaaaatacacttcaaatttgtccactcatttctctctgcatttgttaccaccttaagttgaatcaccattatctcacaaatgcaccgaaacatctgcttgtaaaatgtctcacccttttcccatgttgttctcttccaatgcattttcttcatagcaaactaaatttctagaaacaaaatcatgtaattaccttaatcaaaattcttcaatggtgtgccattgtacattggaagaaatccaaagtttttactatcacttccaaaacaatgaacaatttagattctggctagctccttagctgcatcatatgtgccatctcacattcaattctccaggatcctacctcatttcacctccttaaaaccgataggcttttctgttttgggacctttgcacaagctgtttactctgccaggaaggtgctgcccacctgatctgacctcattgcaaacttcagagagacctttttatcctgtcagtgtcaccaaagagtccttattacactctctcaagccatcccctatatacctatcatagttcacagaaatcactgatttttaatgtgattattatctatcctccctatctgtctgattttcattaaaattgtcattttagtaaaaattttctgattttcataagaaatgacaattgttctattttatctatctctagtattttatgcctaatgtagtgccaggtacacagagttgctgttcaaaaatatctgttcaatgtttgaattaattattttcaatcacaacacccatgattcctctgtggtctgtagtagttttctttgtgcagtgtctgtcacagctctaaagagaagggtaagaacaatagaactgtctaacaggacagattcattagctgagattcaaaaccaaaaggcaaatctggctaatttctcagatgactggatgcatttatgcttttggatcagggatgacatttgctgatagataccaacaagttgcatatctagaaactccattatctgaaacatacacacaaactcaaacagaaaaatttactatgatttaaatatctttaaatgaacaaatgctgaacgacactgatattaagacctatttattagagcaatataatccttagatgaagaatatagggaaacaccatattcccaccatatttactggagtagttatctttacttctgtggcatccctacagtgatgatataatttggagacttcatttgccagtcatttacgaaatggctgtgagaagaaagtctcatgatcatagactcacttttagaagctatgttagcttggtgcatttcttagtcaagtacatcacactatcttaatctatgtctaaaaaatgtggatcccaaatgtgaattatctattataaatgtgataacagagacaaaggagggagatccacttaagagggtatgatggttaataccgagtgtcaacttgattggattgaaggatgcaaggtattgactctgggtgggtctgtgagggtgttgccaaaggagattaacattgaatcagtgggctgtgaaaggcagacccacccttaatatgggtggccaccatctaatcagctgccagcacagccagaatataaagcaggcagaaaaacatgaaaagactagactggcttagcctcccagcctacatctttctcccatgctggatgcttcctgtcctcaaatatcggactccaagttcttcagctttgggactcagactggcttccttgcttctcagcttgcagagagcctgttgagggacattgtgattgtgtgagttaatactctttaataaactgtcttttatatatatatctatcctattagttctgtccctccagagaaccttgactaatacagattttggtacctggagtggagtcagtagagacattccttctaaggtgaaggataagttgctgcatttggcccctcctacaaccaagaaagaggcacagcgcctaatgggcctatttgatttggaggcaatacattcctcagttggatgtgttactttggcccatttatcgagtgacccaaaaggctgccagttttgagtggtgtccagaacaggagaaggctctgcaacaggtacaggctgctgtgcaagctgctctgccacttgggccatatgacccaggagatccaatggtgcctgaggtatcaggagaagatacggattgtatttggagcctttggcaggctcccacaggtgaatcacagcagaggcctctaggattttggaacaaggctctgccatctcctgcagataactactctccttttgagagatagctcttgtcccgttactgggctttggtggaaactgaatatttgactatgggtcatcaagtcaccacgtctgcctatcacttgaactgcctatcatgaactgggtgctttctgacccacctactcacaaagtgggtcatgtccacagcattccatcatcaaatggaagtagtatatatgtgattgggtttgagcaggtcctgaagttatatgaggaaatggctcaaatgcccatggtccccagtcctgccaccctgccttctctcacccagcctgcaccaatggcctcatggggagttccctataatcagttgacagaggaagagaagaccagggcctcgttcacagatggttctgcacaatatgcaggcaccacccaaaagaggacagctgtagcattatagcccctttctaggatatccctgaaggacagcagtgaagggaaatcttcccctgtgggcagaacttcaagcagtgcatctggatgtgcactttgcatggaaggagaaatggccagatgtgtgattatatactgattgatgggctgtagccagtggtttggctggatggtcagggacttggaagaagcatgattggaaaattggcaacaaagaaatttggggaagagttatgtgaatagacctctctgagtggtcaaaaactctgaagatatttgtatcccaagtgagcgctcaccaacaggtgacttcagcagaggaggattttaataatcaagtggacaggataacccattcaatggataccactcagcctctttccccagccacccccgtcatcacccaatgggcccataaacaaagtggccattgtggcagggatggaggttacgcatgggctcagcaacatggacttccactcaccaaggctgacctagctacagccactgctgagtgcccgatttgccagaagcagagactgatgctgagccctcaatatggcaccattccttgaggtgatcagccatctacctggtggcaggttgattatattggacctgttccatcacggaaagggcagaggtttgtcctcactggaatagacatgtactccagatatgagtttgcctgtcctgcacacaatgcttctgccaagactaccatccatggactcacagaatgcccggtccactgtcatggtatcccacacagcattgcctctgaccaaggcactcactttgtggccaaagaagtgtggcagtgggctcatgctcatggaattcactggtcttaccatgttccccatcatcctgaagcagctggattgacagaatggcagaatggccttttgaagtcacaattaaaatgccaactaggtgacaatactttgcagggctggggcaaagtcctctggaaggctgtgtatgctctgaatcggcgtcctatatatggtactgtttctcccatagccaagattcactggtccaggaatcaaggggtggaagtcgaagtggcagcactcaccatcacccttagtgatccaccagcaaaatttttgcttcctggtaccgcgacattatgttctgctcgcctagaggtcttagttccagagggaggaatgctgccaccaggaaacacaacaataattccattaaactggatgttaagattgccacctggacactttgggctcctcctacctttaagtcaacaggctaagaagggagttacagtgttagctggggtgactgacccagactatcaagatgaaatcagtctactgctccacaatgaaggtaaagaagagtatgcatggaatacagtagatcaattgcggcgtctcttagtattaccatgccctgtgattcaggtcaatgggaaactacaacagcccaatccaggcaggactacaaatggccaagacccttcaggaatgaaggtttgggtgactccaccaggaaaaaaccatgacctgctggggtgcttgctgaaggcaaagggaatacagaatgggtagaaggtagtcatcaataccagctacgaccatgtgaccagttgcagaaacgaggactgtaattgtcatgagtatttcctccttcttttggtaaaaccatgtttgtgtatgtatacacctgtactaaggaaatatgttcattttatttcctttttcttttaacatgtgacatcagatttacttcatattagcgtttaagtatcgttagctttatgtaatagcatttgggttggggattggtgcatttctggttgtacgaaggatagctgcattatgttacgtgtaattatgaccttattattgtctttatttgaagataatgtgtgatctcagatgcgtatgggttcaagtcgacaaggcgtagacttacaatgattaatactgagtgtcaacttgattggattgaaggatgcaacatattgatactgggtgtgtctgtgagggtgttgccaaaggagactaacatttgagtaagtggactgggaaaggcagacctaccttcatctgggtgacaaagagggtgacaaagaaatcatctggtgggcaccatctaatcagctgccagcatggccagaatataaagcaggcagaaaaatgtgaaaagactagactggcttagcctccaatcctacatctttctcccatgctggatgcttcctgccctcgaacatgagactccaagttcttcagctttggggctcaaactggcttccttgcttctcaacttgcagacagcctattgtgggacctttgattgtgtgagttaattccttaataaactcccctttatatatgtatatatatcctattagttacatcactctaaagaaccctgaccaatacagaaggcttacactctttattctaacaggcttaaggctaactctatatgtctccttcccaatgtcaggaatctctgtagcttagaggaacagttttcctcagtgacatatgtaactcagtgattagtcacaggaacactgacctcatcacaataaaatagggatctccctattttaagatccccctaaggaataaagagctatgcactttagggaaaactctataaaacgtgtgagaatcaaaagagttcaaaaatggccaaaaccagccaggcaagatagtgagaatacatgtctacagaaacattttttaaatagcaaggtgtgttggtacatgcctgtagtcccaactattagggaggctgaggtggaggatcacttgatcccaggagtttgaggctgcagtgagctacgattgccactgcactccatcctgggtgacagagtgagatcctgtctccaaaaaaaaaaaaaaaaggcaaggagagggtgatccttactaaaacaggcaattcaatattcaattagggggattcattcaaaccatttatttcacagaaatggccaaataagtggccttgttaataagaagataaaaccctttcctttttgcattaaaataactgattttgtctcaaattatattaaataaggtaactacaacagaaataagaagaaaattacattgattgtatagacaagaattagtttctgaaagcacataaacctttacagaaaatacgcttactttatcaaagtggttcagttttcagctgcttctatggcttacaacaaaaaagggattctgttacatatggaaacttcaaaaatcacaaagctcaaataaaaataatagtccagggcaattaatctggaacaagaatacccatgaatactctgggtatttgttttaatgcacttcagttcaatagtgttgttttctttctcatcaaagagcaaactatatttctatttatcatcttcagaagtagtaacagagcctatcctggtaatatgcattgtggggaagaagaggatacaattgaacacaaggctatttcaaataatagaaaagatacctttaataattggcaggagatcttataacacaaactataaacaactgctggatttgaaagtcacaaaagcatagtcctagagtccatatcgtgggatcataagacagttacagctttccctagagtcaagaggaaatgtcatccattagaattcaagtgaactctctatatacccatttatagaaataactagacccctaagcagattcaggtacattcttcttattcttctacatctggccctgaattaggtgaggtgacaagtgtgatttttcagaccaactcatggtctttctggcttatggttatactgatcgcccctggtgacttgtgtgtgaacaaacctcagagcattcaaatccctgggttctgctctggctctgctagtatcctgctctgcaaacttaacctctctgggctttcatttctttatcttcaaattgaagaaaaatgtgatactttatccttaaggtcaacctctagttccaaattcttaatcagaaaaattatggcaggcttatggtctacagaattaaaatcaaagagccttgctgaggtaagcgacaacatttgcaaaggacaatgtaaggttcattttcttctagcccgaatgaattgtacccagtatttatgtggacttgaaaactataagtgtttttaataaattaaatctaaaatgaaggcatttaaaattattagcggcttatcagcatgaaacacaaagaacactgaagtgggagatttttccagtgaaactcatcattaaactttcaataacaatgtcatcatttcttttcccttctgtgatcacaccatctcccaggcacaattttaggtttaacagtcttaaaaccaggtaagactagggaagctgagcaggcaaatcaaatgattaagttttaaaaagttttataggtatttaagccttgggaaagcttaattaatgaagaatttaaaacaggagtgaaaattaaagcagtaggaaatattcaagaaaaaaattactatgccattgaaaaaattcaggaagagccacagggaactaatgcaaataatcattgactggaggaaatgtctctggcaaatgcaagaagtgacccaaagaaacagaactgagaaaatttggccagaaaagtaaaaaaagaacatacataaaatggatggtacaacattgcttttatttttcaggaagaaaatgtgattgattctgcgtaaaggtgcttttcataacttttatattgtcataaagacaataataatatccttagctcttcatattcctttgccagtctatcattcactcatgttttcaatgtaatattcagaacccactgtatcagatcatctggttgagttccataccaccatcttctctatccacttatcctatgagatcccagttgcatcccataatctttttaaatataatggaaaatttaaaacatttcatctgatatagtttgactctgtatccccacctaaatctcatctcgaattatcatccccatgtgttgagggagagatctgatgggaggtgattgcattatggtctttctctctctctctctctctctgttgctgtctctctctctcagtctcagtatctttatagcagtgttaaaacggactaataaatcatccttcttggtctcaactactggtcattcatcttaaaccatgcttatctctgatggatactatctagaaataaacacatgagatgacattttcttggatatctcattacaaacatattaggcatctgaatcagtattattgttttaatttatcaaataatgtccaaaattatgatggaaacaaaatagctggtccaaatctaaagaagatattttacttgcttaatcacaaggattatttaaaacatccacatgtggtttaactgactcccaaggtagatacatttccaaagcatgacacaagggaaagatatagcattaaaatcacattccagggtacctatatttatagaaacacacagaaaatgggctaatctttgcactttctcctattgagagaaatagatattctactcaaccctttcttcatagctggtaatgtaacataaataataaaatttatcttaaattgcctaccaatcatcaaattcagggaactgtccactgaacttttagtattggctttccatttgttggggaggggaagagtggggttacaaattatagactagaaataataacaataaaataattccaaggggcattaaatgccagagttctggggatttggagattggggtaagataactagagtaacttgctgactgtgccccacacatcctttccttctggtagtcaaaacagtgagaaatgtgaaggaggggcttaggcaaaagccagccttgacggcctggggcatcttattggcatttgaattggtgagagagctaacagtttccactcctcctcatgttattttggaagcaagacctaccaaacaggccaggcacagtggctcactcctgtaaacctagcactttgggaggccaaggcgggcggatcgcaaggtcaggagatcgagaccaacctgaccaacatggtttctactaaaaatacaaaaattagccaggtttggtggcacgtgcctgtaatcccaagctgctcaggaggctgaggcaggagaatcgcttgaacctgggaggcggaagctgcagtgagccgagattgtgccactgcactctagcctagatgacaaagcaagactctgtctcaaaaataaaaaaataaaaaaacaaaagacctaccaaacagaaccacagccactaaaagaagatcagagttaacagttggacagagaggggttatttctgcatgttggagatgcttgtgttcacagagtagctgtgtttatcattaataataataataataaaaagttatgcctctcatcagtaagcatagcctttaaaagctaggcatattcagggaaacaaattcatccacttctgacatcggttgcagggtcttacctctggcaacagattaatgcattagcaaggaacccaaatgaaaagtgcttatgtagacagcacaatggctgtgatttagtaatgttcgtacagcaatttatatttactgagtgctacaatggtttctattatttattcttcaagagaaatccatgaggtactgtcttcatttttttaggtgaggaaaataaggcatagggaaattaatatggaatcacagagatcaagtcaggttgtgcctgtacacacaaaaataaccttttagaaaggaaaaatgagcttaagttacgagatcaagtcaggttgtgcctgtacacacaaaaataaccttttagaaaggaaaaatgagcttaagttacttgcttgacattaaatattacattggtgcaaaagtaattgtggtttttaattgtggtgaaaaccgcaaatactcttgtaccaacctaatagagcagtggacactgacatattttcttagcagtaaaaacaacccccccccaaaaaagtcacatacaattccaatttacaaacaagataacaattacacagcattagtaaaccaaatataaatttctaacgtttactaattattagggcaatcaatgctttaggaacataaactttgaaatcagagggcatgtataatagttccaagcttctatcactctcagcttctgtgaatttcagaacttctgaactccagagtctgcaggctttaggaagaaagtgtttgcctaaacataacaggtcaaaagtataaattcagtaaaactactttgtttgcataaacctaatgacatagtgtgtatgctgggaatgtacttgaacctttgaattcagttgtttaattagtgagctattgtggtgggggtggagtgagtggggaaacccacagaggaggagcctccgctgagtgatttaaagcgtgcaggaaagaaggcctgtggcctgtgtatgcatagggggagctcctccctaatcctcattatagatttgtgttctctaaagccggaaacgacaaactaaaattaagtaaagagatgctaacggttatattaatttttaaagaagaaacaacagcctgcagctgatgatgtgttggctggaatggcctgagccgctgggaaagaatttaatggaactagagcttttaaaagtcatatgagttcaaaaggggaaacaggaaaaataaataaagagaagtaggcagaaagaacaggtgagattcagctgagtgaagttgatggcataacatatgctgaggccacacatttccaacaacagtccatcagccatgagctgagttatggctcccagagtcatggaaagcagttctgaacagaagctaaatgttggtgaactcaaattccaaaaagaataaagtcatgcttctccagagaccaaagagaagataaagaaaatggcctggccttatacttgagggagaaagcaaaatgatttacaaagaacagaactagtgattggaaccaatgagtaggactggatgagcagagaataggatctaaaactggcagtcttggaaggagcctaagagagcatcgaatccaagaagtttggggatgataaatgtgaggcacatgtatcacctgttatctatgtccacagtccactcaatactgcaacctggtccaagatgaatcctgtggcattgggtttatctgttaacagtttataagaagaccacattctagatcaactggagcaaaatacttcaactttttacaccagggaaccagggatgatgtatgtgctctaaggaactggaatggaggaatatactttatgtaaagaaggaagaccagaaatcccaatattagattggaaaaaaaatcctcttcgtcttctgccgggcccgcccagcagaccctggccaaatgacagatgaaaaaacgtacacagacacaggtgttttgcctggccgcgcggctaggggaccgagccactcacagacatcaaggaggatgccgtaaagagtcacagaggccgcagccttgacaagcggccgctacagtcatttattcagtacagatataaagacaaaggccttgaggcaacacacttgtaggtaattaatatggttgcgccccgccccccgccccgcccccaggttcagaggcctaagtaaactaacttaccttgatcaattctcttacacttccttgttatctactcttagagaattcagctgccttcagcccaatcctttcccaaagcttctgcaaaacctcccagccttccaggaatgtttccatctttctataatttttcccaccaccctgaccgatctcctacaatctccaaaattgtgaaatagaaaatcaagctattacaagtggcagggggaacctacctgtggtggcatttctgttaaataataatgtgtacgtgattgagctttgtaaactaaaaataactagaaaagggaagtgatgctctggagtggctttagatttgagtgtttacttcactatacatacatatttttttcctaaatacaaatatgatacgtccatttagaatatttggaaaacagaagtgaaagattttttaaagagagagagaaatattcaaccataataagccttccacttagaactgatcactgttaacaatttggtgcactacatactagtatttaattcatatgcagatctgtgccttgtttataaataaaagtgagacccttttcctttctttttacttggcaatacattgtgtgctttgccatttcattttattcttaaaacattaaagactgcattaaattctactgcttttcatcaattctctaaagttaaaaacttaggtctttgtatttccactatttcaaataaaagtgtggattgatatccttgattttgtttgcatttatttgtgtgctagtaagactaatcatttttcatgttttgggccatttacacttcttttgtatattggtttcatgttactgtccatttttttcctagagtattaagctttttaaaagacctctttacattaaatatattaatccatcctctgtcatatacatttaaaatatcattgatttgtcttatttcatttaaggtattttcttcaagaggggaggcctttagtttttatgtagctaaattttttccttcatggcttttgtttttggtgacaagttttgaaagatctctgtgctgcaactacatatacatattcagcagtagttccatttagttcttttaacgagcattgtttaaaagcgtggggactggaagccattcctaacactgaccttaatcttatgatctattctgcctccactgatctatgattaatctgatctgtgctttaatttctttatcataaaactaataagtagtactagtatttgcctcacagagcagttaaaagtagtaaactggataatctatataaagtgcaaggcataatatctggcacataataaataataaatgctagggattatttaactccctaatatctacgaacattattttagagactatgatacaaataaatctaagtttaattttctccaaatttgtgccaacactatattttgaataaaacatattgtgtctcactaattttatatgccacttctattatatactaaatgattacaggtgtttggatacatgtctacactttttattgaagtctactgatttccctggctagtaatataagtctactacaatattaaaatcagtatggctgaataatattttaattacttttagtgcaattatccgtccttaattattcttttctcagaaaatacccctgactaatcaggctgccaaaacttctggttaaagttccaagagggaattaacaaaagtatatgaaactgtcattcttataacgagcactacctttaaatattttttgggaaagtccaaggtgaacttttctgcccaaattatatttcacaccaatcacttcctagtttctgtccagtaaagtataaatgtataagggtcagtatcaactgtcaaaacaaatcaggtttttcgactgaactcattgagatagagaatagaaggttaccagagactgggaagggtagtaagagagatggcatggagaggaggtggggatggttaatgggttaaaaaaatagttagaaagaatgaataagacatagtatttgatagcacaacagggtgactatagtcaacaatgacttaatttacattttactaacattttactaaaagagtgtaatcggattgtttgtaacacaaagtgtaaacataaacacttgaacggatggatacatcatttcccatgatgtgattattatgcactgcatgcctgtatcaaaacatctcatgtaccccataagtatatatacctacaatatacctacacaaattaaaacttaaaaaaatctctttattttcttgtaaatgatctttattgaatttgaatttttatatcttctaatataaaacatatgttttaaaaaactcaggtttctaagtgtacccttgtaaaacatttaaaggccaaaaggagaatacattgtaccttctaaatcactttctaaacccagccctgggaccctcaggactccactcattacaggatgggggtcagccagcatgaatagccccggcttcattggtgatcatgaggagcaagaaaacaaacacctgaagagcctgagaatggaagcccaagtgtcagttcttccttgtagtgcctctgcactgtcgcaaatgggctgtggggagactttatgtgcctcactcagggggttcgtcatgcctccttctttgagtaggaagaggaattggaaatatacaagcatcagaagtgtgactgccatactcttcctcccaagagagcagatttaaaatccactcatagagatggaagtaaaaaagctccctaacaacttgtttcaaatcaatatgccactttaatatgagaaagttcccatgtcttcacagtggcttcacaagtggatttctgtcttgtctcatatttaatgattctataactgtgtgtgcaaagcatatgatttgatacatgactaaaaaggtattgttattaactgttaaaataccatgactacattcctactttgctcagttttaattttataataaataccttaagattttccaaattgctctaaatttacattttgtaacaggttcttcaagtttgttttgttttgttttttattttctccagggattgggaagcttaaaggaaaataagactgcaaagggatctcttaatagaaatgtataaattatgctgaagataacagaataagcaatgataaaaactgcaatttttcaaattaagtctggccaccaagtagattgggagtgtgaaaatgaaagaaaccataggaaaaaagtgtctatgacatcttaagcctcatcagagctagtgaaaggaacattagctttaatcagatgaatagaagccaggaagggaggcttcaaaaaaaagtcctaataaaggggagcatgaaaccatggctgaaactctgaaatggaagaaggctcaagaggtttattagactattcagaaagaaatttcaatttttcttctgcaaataattcagaaaacaaaaaaggtgggggcaggaaggcatatctaaagagatcaataggaatctctgatgacctcaaatttcatgaggatttgtgcaaatcatagaaggacaaatagtacagaggagaatgttcctaaacttagagtcaggaaagctcaaaaacataataagctaaggcttgaaaatgtatagacagcaagaaaaatattctattttttttttctttttaaagtgccatccagtacaacaagagtcgtaaagccaaggagcttccgttcatcacagaggaaatggattatgaaatgtttagtgttgatggatggggtgttgctctacttctcattattttctgtaatagaggacaactgtcaattaaagaatgttggtgtcaatactggcatgaagccaggcacgaagctggacagacagggatattgtaaaatgcattttctcactctgaaggaattagagactctcagccatgttcacttatgggcgaccacatgtcctcatttgtctgagatattcctagcttatgcctgcctttctggcatagctattaatagacctcctttccattttaaaagattttaagcactgagcagaccaatatcaagttccaaagttgaatcagtaataccaacaaacaaaagccctacggcagatggattcatggccaaattccaccagatagacaaagaagaactggtaccaatcctactgacgctattccaaaaaatggaggaggagggactcccctctaactcattttatgaagctagcataacccggataccaaaagctggcaaagacacaaagaaaaaagaaaactacaggccaatatccctgatgaacatagattgaaaaatcctcaacaaaatactagcaaactgaatccagcagcacatcaaaaagttaattcaccatgattaagtaggcttcatttccaagatgcaagcctggttcaacatatgcaaatcaataaatgcgattcaccacagaaacagaactttttaaaaccacatgtaatcatttcaatagatgcagaaaaagcttttgataaaatctaacaacccttcatgataaaagctttcaacaaactaggcatcaaaagaacatatctcaaaataataagagccatctatgacaaactcacagccaacatcatactgaacaggcaaaagctggatacatccccacttagaacaggaacaagacaaggatgcctgctcccaccactcctattcaacatagtactggaattcctagtcagagcaaccaggcaagaaaaagaaatcaaaggcatccaaataggaaaatacatcatcaaattatctctcttcactgacaatattattctatacctagaaaaccatctcagactccaccaaaaggctcctattctgataaatgactttagtaaagtgtccggatacaaaatcaacgtggagaaatcagtagcatttctatacaccaataatgctcaagctgagagccaaatcaagaacatgatcccatttacaatagccacacatacacacaaatctaggaatatatttaacctaggaggtgaaatatctctaaagggactacaagacactgctgaaagaaatcagagatgacacaaacaaaacaaaaaacattccatgctcatggattagaagaatcaatattgttaaaatggtcatactgcccaaagcaatctacagattcaatgctattcctatcaaattatcaatgttatctctcatagagttcgaaaaactattctaaaattcatatggaaccaaaaaagagcccaaatactcaaagcaatactaagcaaaaagaacaaagccaggggcattgcattattcaatttcaaactatactttaaggctaaagaaacaaaaacaacatggtactggtataaaaacagacacatagactaatgtaacagaataggaaacccagaaataaagtcatccaatcttcaacaaagttgacaaaaataagcaatggaaaaaaggctccctgttcaatatatggtcctgggataactggctagccatatgtggaagaatgaaactggacccctacctttcactatatacaacaaataattgaagatagattaaaaagttaaatataagacctcaaactataagaatcctagaagaaaacttaggaaatacaattctggtcattggccttgggaaaaaaaatatgagtaagtcctcaaaggcaactgcaataaaaataacaatcaataactaggacctaattcaactaaagaccctctgcacagcaaaagaaactatcaaactgcaaactacagaatgggagaaaatatttgcaaactatgcatccaacaaagttctaatatccagaatctataaggaacttaaacaattcagcaagacaattgtaaaaaccaataactccactaaacagtgggcaaaagatataaatagacacttcttaaaacacaaaagcagccaaaaaacatggaaaaatgctcaacatcattaatcatcagataaatgcaaatcaaaactacatgagataccatctcacaccagtcagaatggctattatttaaaagttaaaaataacagatgttggtaaggctgtggagaaaatacactgttggtgggaatgtaaattagttcagtcactgtggaaagcagtctggagatttctcaaagaagttacaacagagctaccaatcaacccagaaattccattactgggcagataccaaaggaacataaatcattctaccaaaaagacacatgtgcttgtatgtgcattgcaacactatttgcaatagcaaagacatggaatcaacctgggtgcctatcgacaatggactgggtaaagaaaacctaatacgtattcaccatagaatactatgcagccataaaaaagaatgaagtcatgtcctttgcagcactgtggatgcagctagaggccattatcctaagaaaattaatgcaggaacagaaaaccacatactgcatgttctcactcataagtgagaactaagcattgggtacacatggacattaagatgagaacaacagacactggggactactagaagaaggaaagaaggagggcggaagacgcaaaaatctattaggtaccatactcactaactaagtgataggatcatttacatcacaaaaccttagcatcatgcgatatacctaaacatgcacttgtactccctgaatcaaaaataaaagttgaaattatataaaatataatattaaattatataaaataaaactatctttatttgaatgacaaattatgtagtcatctttaacatatatcaacatgccaagagtactgcatgttttattgttttcaataatcttcttgataatctgaggaacagattatcaaacagatttttgtgatgactttgaaagagagaaagcaaacagaaagaggaaacatgggtttttaaagactaaattaggtgagagcctccttatttctttcttcattagggctattgcagtacatgtcatgggatttctgtagatagatcaaatatggattttaacaagacctcagacaaagatctttttgatagttagagtcaaggacggaaatatgaattgtcatacagtctgatgtattttaatgagttgaatggctattccaaatagtgttgactaatgtttactaatgagcaatgtcaactctgcccttggtactgtccttttcaatatttttatcaccaaattgtattaagacatgctgatcaaagttgtatctgatgcacggtaatagcagatattgagatgacagagtcaggatccaaaattatctcatcagactaggaaaatgtgccaagcctgaaaaattaaatttcatggggaaaaacaatttcacagggagaaacttatttttccaaagaccagttgcacaaaaataataagagaaaatatgagatgaaagaaagaacgtttttgctgattaaaaatcataattggtgaactggccacaaaagcattaatatcaacattaagaggctgatgtatcaatcctactgcgtccagcatgtcacacccaaaataacatgttccactctgggaacctcagcttaagcaagatagtggcaaactgagaaccatacaaaaaaataataggagagtaaattctaacagtgatttaaaaaaaaaagaataagaacaaaaatagtaacaacacagatttgcaatcccttatctgcagttttaaaatccaaagtgtttgaaaaccaaaaatatgtttaatttttgtcaaatcctgacctgaaatagagaaggtatctatgctctttatctatttcaacttgttgtacatataatttgctgtacatatttgcataaatattaatatacttgattatgggattctgccttatgctccattggggatattacataatatcaccagtgtatctctgtattgcctttaagaaaaacccaacaataggaatttcaaaatatagctggtctcaaggtttggagtaaaggattttgacctaatggtaataacaacaataatgataataataacagataacacaaaaatagcacttactatatgtcagacactgtcctaggaacttagcatatattaattcattcaatttttgcaataaccagagatgtatataccattattattatcctcactctacaataaagtaaactgaagcacaaagatttgcccagagccacatactaagatgctatttgaatgttaatatgatacttgaatagttgtcttcaagttgaaacattgtacgtggaagtagcaggaagcaggatgcctacaaatgtaaagcttaattggggtgtcactgtagaatgttcttaaaatattttgaagcttacagaaatacaccttgaagcaaattatttttgcttgagtagtctttctttgtaattttagaaggaaaatgtgccaattattcagggaggatcaaaacagaaaataattttgtaattgatcaaaccacaacttcctaaagctactacaatgcaaagttgaagcttcagaaggaaaagagaatgagaatctgacaatggacttccaagattcaaagctgaggagaaggtggaagggaagcacaacttcaccttaatgaaaaggaaaaagaatgatgtaggctggtgagccaggcccaagacaggtatttaaaggcaaagctgttgggcacagcttctgactagtaccaagaactgctctggatgcaaggcactgtggggagacttcgtggcacaacagctgagcatgtttgtgtgaactgaatatccacggtggtgtcaccagtgcatccagaccagcagtagcctcaccatggcagaggacaggatgcaagagcaacatgtggccacgggaagcagcaagaacagactgccatacttttgcttcgacctttatctgttgttagaagcaaaaaccacaccctgtgtggactgaatacaccagcaacctactgagacagcgaaggggtgcctggagaaactccaagcagcctgcccactggggtggagccacagaagttccagccctttgcagcggtgaggagccgggctcctcctcttcctgggtggaacctgggattccgacaacccagcgggaagtgctctagcggggattctgggcttgtgagagtccctgtttacccccctttcttccttttcatccattaaaaccctactttactcaccattcaaactgtttgtgagcctaaattttcatagccgtaggacggacaaggaccccatcgctagctgaactaaggaaaagtcctgaaacatttttggcctgcaacgtggggactcaagaagcagtgagtgaaatggggactgaaactcttactgttccttctaagcctttacatccctggacttctgagggtggagaaccatgcccccaaccccctgtctcccccaggccttttcatgccttttccttcctttttcgagacccacctgtgagcagcagctccccaccgccacccccatccctgccagcactgggacgcatggcccaagggtcctgcacagccactggctggttcgcagccaggcatgctgccgcagccttccacctccctggtcaaggggttcagctccatcagacagtaaataagcttttctcttggtggagggaccacttatctaagaataagaggttcttccccaggcatttttaaactgttcttttttctttccccttctccattctgttggcagttaacttttaaagtttttttttagatgttttactaggccaggcttcacccagcaactgggtttccttttgcctgtctgtgtattgtgtgtaatgtctgtcaaaagagctctaattattattgatggacatttgggttggttccaagactttgctattgtaaatagtgctgcaataaagataaagaaaatgtaacacatatataccatggaatactatgcagccataaaaaagaatgacatcatgtcctttgcagagacatggatgaaggtggaagccatcattctcagcaaactaacacaggaacagaaaaccaaacactgcatgttctcactcataagtgggagttgaacagcaagaacacatggacacagcaaggggaacatcacacacccgggcctgttggggagtcaggggcaaaaggaaggagggcattaggacaaatacctaatgaatgtggggcttaaaacctagataacggtttcataggtgcagcaaaccacaatggtacatgtatacctatgtaacaaacctacacattctgcacatgtatcctggaactaaagtaaaattaaaaatttttaaaaaaaagtcaacaagaaaaaaaaaagctgtaattaatttggccaaaagaaagacaattgcttggatctgatgtttttaaagggaagataaaatctatggtacctttcagttcatgtgactttaatctttaagaaataaaaacacccctaaggactattagtaaaatgcaggtcagatgcaaagttttctaagtgttgtgagtttacaaactgctttttgggttttgagaactatttgacttgctggcttcacaattggtaaggcctggggactatggaactaactatgccccttattatgctatagtcaaaccttggttgcagttagcacacaattaaagcaacttaacaagtttcaccttaaagataacaattgctggggttaccattataacaggtaattgagactactcaaaatagatttacatgcaaggggtataagaacagtaaaatgtgctttttctttgtaaaatgttataagaaggcatggaaatataaatttttgcctagggttaaaggattgttttaaattagataagagaaagccgaaggttcaaacaagtggtagaagaactggggaaattaatcttgcagaagaggttctctgggtgaacatattgactaacttcaaaaaagggtattatatggtttttctgtaaattgaacattaaaatataagaacaacaaggtattcttaaaatgctaatctgctccttaacaaaattcaaaagggttataaaaggtttttgcttctttaaaatttctgagtcattttggcaaaataaataatttatggtaatctggaattctatttcataatattaagtgctttaaacatatttaacagctttcccaaaatcaaacttcagtttcaaaattgtcttccctggcacctggttttttgaatacttcagagggcccctgaagtgtctagaaaagagaggtaaaaaggattatttgacatgtttaggtatatgagattgccaaaatgatgctcaatcttctttaggttatatcttggtggataatactaatatatgttccaaaattgtatgggatttctaaaattctaaggtctaagtatatgccataaatcataattaaggttgttatgttaagttattgtaaaacagagataacaaaacttctttgtcaattgtgtgtctaactgtaactaccctggacattttgttattcacagacgattgttgtcttgttttaatcctttcaaaagatggtttataataagctatacaactttaacaggtactttcaaatacaggcttctgataactttagagactgtaacattggaataaaggaaaaagtacaggactcataaagagctgaaatgttcatgaatgtcaagcaaaacaagagttaagtaaatggactgaactcaggaagctaaagcaaatctttttgacttttgcttggaatattgatgatccttgctttagttttttttatagtcaaggaaacttagtttgaactatttacgacctttaataattaagtgaagtatacactcctgtggtcaaaatttggagcatgtttgtttctctctgcctggttcctctagaatttggaaactatctgtcagtattcttatggcaatatagttgtttgcatcagtacaataagaatccatttttcttttgcaacaggacacaattagagaacgtagttattttaccagggttttgactggaagggtatgcttccctttaaggagtcaatcttgacttgcagagccaataaaaatctagtgggaaactggcctcatacccttgtccatgtagtccctgtacagggttcttgacctgtggtcagtaaagaatgtcactttctaacaggtccaggagctccaagtttgtcttgggaccttaagaggagaaaatcacccaactcacgggtatttgacaatacaaacccatggctgggcttggctttaaaaggtcttatctaagattccttgggaaacagagttccatgaaagccaattcaaaaggcctatgtagaaatagttattcttgctgcactttatgcaaataaccaggccaagtataagactaaagtctgttttataaatcattccatcatgatgatatttaacaaaaatgaggacttgcaagagagaaatcacgtttcaaaacttatcatatgcttgtcattaaattctaaactcaccagtcattttcaagttttcacctacattttagatcaaccctacttgttcctgtgaaccaaccactgatccccagctgcagctcagaaagaacaagagggatgggtaatgtagaaatctggatcaatagtctagttctgaacagttatcctacaaatcctgccaggtagtgggaataaataggatgcccataacccagaggtttcctttttgggaaagtaagaccaacgtagctaaccaaagctaagtgtcatccaccgaaatcccagcaagcataactatggctaccagttatctgggtgtgtcacaagacatccattcctctctcttgttggaggagaactcagctccagtttgaccttagcatttggcttatgacaaggagtccatgcgacccccgctgagacacatttttgtctgaaactcaattccaagcttcagataaaaaccctaggaaggaaaactggatctgagggatccagaggcagacaataacagaagttaaaaggcatagcacatgtgagcatggctgatttctaccgattaaaccaaccccaagctttcatgaataaaggccatgttaatatccatagcataaatgaggactaaggaactccaaggctactgacagtagcggagatagtggcataggtgagagtgggtaattcctattctctaggtcctccctgcttcatgggtgcaagtcactttgacacccatggtggcatctgccgaggtcactggaccctggggatgcaaggacagaagaggaaaagaggatgctcttccctctcttcctcatgtactgtgggtatctgctaggaaaagaaaggaaccagggatgcctgctcccctttttctagatgggtagccatttatattcactctgtacccctttagactgcatcctaaacccctgggaatcctttaaaaggcaccttctcttttctcttcctctggtctctcttcacaaataggtaatcatgtctctgtactattagacacttccctctaatgaatcctccaaactgggaaaagttaattttccaaaccttaaacttgttggctcaggatcaagctcagcgggaaaggaacccagaagcacaacatgctggcaaaagggtaaagttcctcttccagtagggcttttggcttccctctccctatgcaaactggtaaaaggccttgggatttttgagctatccttacccctccccttgtttcattttgatacatgttttctaataacgtggtgtatctgttcttactttcaagcatcaaactccaaacactcctgtaaccagagcctctcacatggccccttctactaggaacccttagataggcctctgagggtgatctgcctgctgtttccccaaaacagtgcccccttatcaggcgaaagcagttaagatagttctttgtccctatccttaatctaatggcagttagatgtatttctctagaaggtggtatgagacagccaggtgggagggggtgcctggagaaactccaagcggcctgcccactgcggtggagccatggaagttggcaccctttgcaagcagggaggagctgcggtcctcctcttcctatgtggaacctgggattcaaacaacctgtcaggaagcactctagcagggactctggccttgtgagagtccctgtttctcccttttcttccttttcccccaacaaaaccctccttactcactgttcagatgatctgcaagcctacgtttttatggctttgggacagacaaggaccctgtctttagttgaactaagggtaagtcctacaacactacttgggcaatttagggaaatactttcaagtgggagataatggatttagaggatgtatacacaggtgtcttgcaaagtggatccacttaaggtagccatgtaatgcacaatggtttgagacaaattctatgttgcctcactagaaatagactttactggagaaagaggaaacatgcaaagacaggatcaacacaccaagaacacatggattcccatcctcccactgtctttatagacaggtgtgtggggccgagtgagctgctagatacaaagtgtagcttgctatgctttttccttttagaaagcaagatcatgcttatcaaattcgtcatggtagatgctgaattttaataactgataactttttagttgttattttgagtgttttaatccctcctaatgtgttgctccaaattctaacatttaatagcatgtattaaatataaaagttaaggagatagtgggagaggtagactatatgacctctaagatactttccaactcagcgtctttagttttatgagacactctggagaagtattacatattattaatattttccctaatcttagttggcgttcgattagccttcttcactgatactgcacactgacttgagaacttaaatatatcaatatagaccttttcctcaattctattaactgattcagtacaatataaactgcactccagttgaacatcatttctacctaactcaaacactacaattcaatctcttccgattcttattccatctctcaacctgctggccagttcccatttattttctttccctactcacgccactgattccacaaaatccatactccagctctactgtactgcttactagagatttaataatccccaaatagcaactaagtagacttacagatgtctgtgttgtaacaactgaggaatataaaaggcagcgtgtttttccctagtcataatccttaaatgaagctgataacgtttactgtgaactatttgagattctttctcccctaaataagagggtacattgtcttcccttcagttggtacaccctcaaatttgaatctacagaaacactcactgtttgtgtctatactcaaagcatcttaatagcactggtttcacattaggtatcacattaataagaccactgaatgggtcaaacttaggtttctaagaaatctattatactataagaaatatactggagaaataattagttgcaggtcttggcattcaagaactcacagtataaaaataaaaaataactataatttaatgaaataagtataataaaggaaaaaagtacaattggccttcccaagaatatcatgtagcccccagaaaaaaaaagaaaaattagagtaagcaaccatggcaacaaggcaggctgctggccatttatccaaattacatagatcaatgttagctggcaatcaccgtcagatttgtacatagtaagcacaaaacctagataaggaaaaataatagggggaaaaaagaatcagaattctggtcacatttctcgttagagagctaaagtacatagacatgccataaatgtaggaatggatatgggccaaatattgatcccttcattcttcaagggctagggtgaggagaagaaaggaacttccaggcaagtcactttgtgtctcaaataatcttttatgaactgaacgttcgtgtccacccaaaactcatatgttgaaattctaaccctaaatgtaatgctatttggaggtagggcctttacaaagtacatagatcaagatatcagtagttacctttggtttgaagcaacaacattgatgcaaaccaaacattagcaacatttagattttacaggaagaaacagaaatcctgaacagaccaataacacacagcgagactgaaccagtaataccttaaaaaaaaatctccctacaaaacaaaaaccaaaatcagatggattcacagccaaattctaccatatattcaaaaagaattggtaccaatcctactgaaactatttcaaaagattgagaaggaggaatcctccctatctcattacaaagctcatatcaaactgatacctaagccaggaaaggaaataacagcaaaagagaaaactataggtcactatccctgatgaacatagatgcaaaaatcctcaacaaaatactagcaagctaaatccaatagcacatcataaaaataattcaccacgatcaagtgggtttcatcctaaggatgcagggatggttcaacaaacacaagtcagtaaatgtgattcactgcatacatagaagtactaacaaaaaccatatgatcatctcaatagatgcagaaaaatattttctaaaatccagcctccctttttggtaaaaatcttcaacaaactaggaatagaaagaacatagctcaaaataataaaagccatctatgacaaacccatagccagcataatactgaatgggcagaagttgaaaggctcacccctaagaactggaacaagatcaggatgcccactttcaccacttctgttcaacagagtgcaggaagtcctagccagagcagtcaggcaaaagaaagaagaaaggtcatccaaataggaaaagaggaactcaaactatttctgtttgctgatgatataattttatatctagaagaccctaaagactctaccaaaagactcccagatttgataaattcactgaagtctcaggttataaaaccaatgtacacaaatcagtagcactgctatacactgataacaaccaaaccaaaaacaaatcaagaacccaatcccatttattatagctacaaagaacaaatgaacctaggaatatacttaaccaagggggtgaaagatctctacaaggagactatcacatgctgctgaaataaatcacacaaacacatggaaaaacatcccatgcttatgaatgagaagaattaatattatgaaaatggccatcctgcccaaagcagtctgcagattcaatgcaattcttatcaaaataccaacataatttttcacagaactaaaaaatatcctaaaattcatgtggaaccaaaaaaagagcctgaatagccaaagaaataccaagcaaaaagaacaaaaccagaggaatcacattacctgacttcaaattatactacaaggctatagtaaccaagacagcatggtactggtataaaagtaaatacatagaacaatggaatagaatagagaactcagaaataaagccaaatacttacaaccaactgatcttctacaaagcggacaaaaacatacactagggaaaggacactctattcaataaatggtgctgggtaaattgaaagccacatgtaaaagaatgaaactggagctctatctctcactacatataaaaattaactcaaagttgattaaatacttaaatgtaacacctgaaaccaaaaagcctctagaagaaaacctaagaaaaactcttctggacattggcctaggcaatgaatttgtggctaagaccccaaaagcgaatgcaataaaaagaaataaatgaggcctaattaaactaaacagcttctgcatagcaaaataatcaacagagtaaacatacaacccacaaaatgcgagaaaatatttgcaaactatacaatgaccaaaggtctaatatccagaatctacaaggaattcaaatcagcaggaaaaaaatgataccattaaaaagtgggacatgaagagacgtttctgaaaagaagatacacaaatgaccaccaaatatatgaagaaatcttcaacatcactaatcatcagggaaatgtaaattaaaaccacaatgagataccacctattcagtcagaatggccattatttaaaaaatcaaaacacaatagatgttggcacagatgtagtgaaagggaacacttacacaccggagattggaatataaactagtacagcctctatagaaaatagcacggaaatttctcaaagaactagaagtaggtcttccattcaatctagcaatcccactactaggggcatccacccaaaaaaaaaaaaaaagccatatcaaaaagacacctgcacgcatatagttatcacagtacaattcacaattacaaagatacggactcaacctaagagcccatcaactgatgagtgtataaataaaacgtcatatatatacaccatggaatactactcagccataaaaaataatgaaataatatcttttgcagcaacttggatggaactataggctattattctaagtaactcacaaacagaaaaccaaataccacgtgttcttatttataaataggagctaagctatgggtacacaaaggcatgcagaatggtataatagacattggaggctcagaaggagttttgaggcggagaatgagggataaaaaaactacctattaggtacaacatatactatttggatgacaggtatcctaaaagccaacttcaccactatacagttcatccatgaaaccaaaaaccatttgtattcgtaaaggtattgaaataacaaattaaaacaaactaactgttcaccaagctcccacagtcgtgtaaggtcaagtccctggaacaactctcatctcctatagcagctctcactgtttcctctgatggaatcccgactgataactaggggcatggaagaggcatcctgggcactgggaacattctacttattaacctgatggtagttatgatggtgttcgcttagtgcagatcaattaagctttaaatcaatgttttgttcaattttctctatgtgtgctcaatttcacaatagatgtttttaaaactcaaaaaaataagattttatatttagtactggagtttgatcatttttctttgtaaacttcttctgaaggttaggatttacgcagatctaaaaaaagacacttccactctttacagtttattttttatatttaagacatacctggtttatgtttaatagttgataagtagatatagactagtgttcttgattcaaagaaaacaaagaataccgtggagtaatctgattctgaagtatctttggtcatgttgtaactgctgagtagctcacgtctttcatccataaaaaagccactgagtgttatatttgtgtgaagttggaaggagaaatgtgttgattctgaaacattcttttggggggcaaggagaggaaaaattacaatgaagcagaattttttaagagaaatatctttatccaaacttaaagcacttttcaaacagcagctctcctctttctgataaactaagagcacttctcagaagtactctgtcaaaaaaaattattttgtaaacagttttccattaagtggtactcagctgcctggaggacccatcttcagtgtgcttgccacttccttctttttgacagatatccaggttgcggtgacagttgcatacagtatcttaatttcaggaagagatggaattttccaaaattgactaacagtgaggagtgggaggttgctccaattaagcactcggtcctctctattgtattaaatttaaatgataaaaatattgtaactggtaatttggaaactgtttttaagtatagaaatgtctttgtctaaaactcttgtaaatcattaataagaaattaaaacatcccacttgagtacctttatctaatcccatttttccttcaagctcctcaggcttctgccaacaaagctttccattgcattgcttatttctattttgccaccattttttttcgcttgacctcccttattaattcagtaaagactgtaggccatcttccagggtatgtgctagaactacagtttaaaagatgagtaagcatagtacctcccttcaagaagcttgtggtccaatggagaatgctctgctagcccatttttaaattattgcagttcatttttacatgtctaaaattattgcatcaaatgtacatactgcaggaaatctttcccacatgtgtattttatctactattatttttggacgcatggacaaacaattcataattaaaagctagaatttcctctgatataagattttaaatgaagatacattaaaacaaaattagtacagaatttaagggctggaagaactctataaagaccttttagtataatgttcttatctaactgatggaaacactaatgcctagagagtgaaacaactttatttactcaacaaatataaatggagcatcaaccatatgccagatagtaaggtagaagctggaaatatagtgttgattaggacccacattactcagctgtaattagcaaataattaaattataataatcaccatacatgagaagtacaagatgctgaaagaacataaaatagggtgatgaaacccaatctgtagatgcaagggctatttttctcagagggtctcattaaagatggaacttaataggctgggtgtggtggctcatgcttgtaatcccagcactttgcaaggatgagatgggcagatcacttgaggtcaggagtttaagaccagcctggccaacatggcaaaaccccatctctactaaaaaatagaaaaatgagccaggccaggtggcaggcacctgtaatcctagctacccaggaggctgaggcaggaaaatcgcttgaacccaggaggtggaggttgcagtgagccaagattgctccagtgcactccagcctggcagcctgggcaagagagcaggactccatctcagaaaaaaaaaaaagatgaagatggaacttaataaataggaggctcaccccagattgcacaatgagtgagatgcgcaaatggaactgaagtcaaagtccttatagcatgagtggcatatctctgctatggcaagctcccaactggtagttatttatggtgcacgaactatgagattatgaatagaaaactgtcaatctcattgacagaagactgtcaagaagaggtgagaatataagctcacctctagtcctgcctgaccagcctgctcaaccttcaataagagtgttgaaatatataacccacatttctttgatcaagaagaattattagcatatgttcaagtttctaaataattgagacttgctttttagttaggtatctttaatgccctttatgcagcaaataaattattattatataaagtttgttttgcaatacatattacagtggaagaagtgcagtatatttctacattaaatgtgtgaatttttccaattatttctttcttattgttaggtcttgcctctcagtggcatacaagacaatccatttaataatgccaagtaaggaaggagagttttagattaataactcctgtaagtaacctatttgtcactaatataaccattttatcattgtctatctgccctggtgcactgctgactaacattattagtagcatgctttgcttaggagaatgtaagaataactaattttgtggttttcccagaaatatttgttttctccagcttttattggtatccagataccactcgttctaataaagcaaagccctcagtgcttttcagaagcccctgaagtgtgtgtttggttactctttacgtgattaattttcccttgttagttgctgttcacacacacgtatgtattcacctgtgtatcactaccgcctttcccctgtccattgtgtgattgctttaaacaagaaaaaccaaaatacatttatttttagagtttaataagaagttattcaggaacatacttataagtactttagaaatatttgaaagaacagtaagtaggtagagaaaataagtggttaggcagccagctctctgactccttaatccctatatttattagaccccattttctgcatactcattcttgccctttctgcattctctttcttgccccatatactgatgcagaatagctagcccactagaactcccccctattattttaggattcctcaataggtatctcatgatttagcaaaagttgttctcttctgctctgtggcagcagcatttcttcaccagctctgacccccttctaagagtggtccatcctccactctccacaatcccctgagagctgccactgttgttggtgtgcgtgagagctaaatctacctaaggtactttcctcatgactccaaagctactggccacctcctggcaatgacattttaacataagattgcaaaccagacagaaaaagtactatccatgcattattatccctggagctattcctcatcagagaaaacaaaagccaggctgaaactcaacaacttggagatttgagggttctccttcagactgaatcaatcaccagtgacagagcagggactttgtctcattcccaagtacacagacttccaggcatcacactgaggtgtatttactttcaattgctagatacatgctttaagaggcagacacaagaaggatccttttcagttgataaattcaagagcacaatagcttcaatgatctcaccttctctaaacacatacttttaattgacaatgattatgtatccaggcaagttttccagaaaaagaaaatccattctttaaactttgaaggctgtttccttcttatttactgtatttattatttacggttaattatcatgggtaattcctcctcctttatgagtatgttttacttgaatttgatgagccatcccaacccaatatatagaaataaattagcaacttctctaaatataaaaagtctcattcaaagccaggaaacttcaaaactaaactagataaatgtatatacccttagtagttcccaaagcatttctgaattatggtacctttcttagcactgattccttaccgtataaatgcttatacacgtttattttcccttctatactatttagtccctttagatcagagatagaaattatgtattattatatccctactgtactaaatatctgacacacaataggcactctctaaatatctgaatgactgaatgcatgaatggagagtgagcaactaataatgacagctgtcctctatttaagacataatacatctcaggcactgtcttgggcaattttcataaaccatctgatttatttctcatgagatcataagggaggctttattatccccaatttggagatgagaaaacagctgcttagagaggttaagttccttggcaaaggttacagatcttgtagatgatagttttaattttaactcagttgtttcctatgtaaagcttacactcttattcactaagacaggggtcagcaaagaatggtcggcactgtttttgcctgccaatattttagcaaagacagttttctggcgactcggcctcacccattcatttacctattgtctatggctgttttgaggctacaacagaaaagttcagtagttgcaactgaaataatctagcctgcaaagcttaacatatttattatatgactccttacagaaaaagtgtgtgggctgggcgcggtggctcacgcctgtaatcccagcactttgggaggtcgaggcaggcggatcacgaggtcaggagtttgagaccagcctggccaatatggtgaaaccctgtctttactaaaaatacaaaaattagctgggcatagtggcacgcccctgtagtcccagatgctctggaggctgaggcaggagaatcgcttgaacctgggaggtggaggtttcagtgaacctagatcgtgccactgcactccagcctgggcgacagagcaagaatctgtctcaaaaaaaacaaaacaaaacaaaaaaaagtgtgtgacccctgtggtaggatatactgaataagcagaccacagcagtcagaaaaatggtgaaggaaaggcagggaaacctgcgcaagtgagaaacttgttctctacatttgctgaacccacaattgtttcctactccccaccctaacataattgaattattgtggcattaaaaagtacccaggcaaggccttagtttaaatctaaccagccttacattaacctggtctgtctgtgctgttgccttagctcattttcttctctgtttggtgctatgactaactcattcccaatgaagcctctgatatttcaagctgagagaagctaaggagctgaaactcttgttaaacaattcattagcttttcacagggcagagataaggtgatcacattcttcaactcacaacataaagtgcaaaagtatttcagacctagtgagcctttctctttttccttaattttcccttatccttttctcctaggtgtttctttctcccctccctccatctctccacttaattgttcacatgtaaaccttactgaaggtcaagtatatattgcattaattaaataaaatccaatgctcttttcttaatattcaatcaggtgtttaaatacattacatataatatatgttacataaacaagatattttgtccagacaggagtctggaaattgattgcttttgttggaaagacttatggtctttggatgatgtgtgggtcttccttcccatagctcttttcatccatgagtgatgagttaatagtagattaaaaggctcccaggagagaatgaatttggactgcactcccttttgtgtgagatagcattaaaacatttctgaggtttttagataaccccaaataaagccaaaaaggcaggcaatagtaacctccatgaaagagggatcatgttgaattttttcactactgtactctacattgcctagcgtaatatctagcatgtaaatatttgtggatgaagggaaggtgagcaggaaggaaagaagtagagaggatggaagacagggaaataaatggaaggaagaacgtgagaaagaaaaaaaatcatacttagggcacgatcactgtatatggagtgggcggtgtaggctgatactctgaacctagcatctgtctgttgaagaggaaggctactgtagtcacagcagactggggctgatgctagaatcctcttgggtccaaggactcagcttcaggaaagtggcccactttgtgtattatcacacccggctcccagtgattcttgctgtaacttgtgtctttgtaacaggactctctggaagagaatatcctccttcacactttgatggaccaaatttcagggggagtggcagagctctgcacttgggacagaggtgtcctcaaggaatgcactaggttagcaagagaaagggccttgattatctaccatagctgtagacctgtaagacttcaatggcaccagggctccatcggaggcagtaagtggcctacccaagagcaccttctgaaaagtctggcttgaaggagtataatggagttgcatctctccagcacagtgtcatagatgtgtagcaagacagacaggctcaggattaaatgtgaccaaaactgcagattctagggattatctgggtaaggaaagcctgggtaaagtctagattttctactagtttaggagatgggagcccgtacatcttgtgttctgtgtattttgtttgtattattttcttagccacaagttgttgaagtctgaaaatatggactttcatgtcatccttcattaccttccacagtgtgatctcagaggcaagcaatgcactagcatctggcctaatgtgttactgatggcagcggtgggccatccagagcagctgttgccattacacctgctacagcaaggaggcacaagtggtagcagcaggagaggctgcagggcagcagtggtggccatgggacccctgtgccctgcgtccccaaggaagctgactgcactgcccccaccttcacgcagccgggcagtacccactccaggccccggccccgcttgccactcttgacagccactgctatggggagttcatggggaagaggcgaatagtccctagagacttcccctgggggaccccctggagcctaccaccctgggggccaccatgatggggccgggccaagttgcctacaggcaggggaacaatgtggttgggcacagaggggtgaccagagaggggactcgaggcggagccgggcctggggtggtaccatgcttcagggagcctgcaagagccctggacaagcgggagacccaccccctctgagttagctgggtgggagctccctgggtgcagctgcagctgctctgccccatctctggacccaggcatctctgtgttcctgggggcccaggaaggcccctctgacccctgcaggcttggaggtgcctgcttccactgcctggcttctccccactgtcagtgtatgctctgatcttggagtaaggttggggccaagcctgagcactgttgcagtttggccaggggcatatgctcagggcagcagtgacccaccaaccccttgctgcctcggctccctctaaactttggctgtggacaagcacaggagggaggcacaaggggtgctgaggacagcggggtactggcctgcaggcgccccttggcatgaacggtctgggtgcgatgaatggtgacaggcggcagacaggctcctgggcagaagggggaaggtcctcagtgatgccctaccttcaagctgaggagggcctgaaccctgggggctgggagccattcccgcataccagaaggtgaactcgtagcgcttttccctgggccctcgtgggtgcccatggactgatcaacatgcacttcctcccctctgaggcccataaaaacccccagactcagccagactcaagcagaggacagacagatgatggggagatgaccagatgacaagctgcagagaggagctgcccaccccagggtctcctctctgctgaaagttgaggagacaatgggatgaccaaatgcagagaggagctaccctctctgctgagagatgaacactcactgggatgccctggctacagagaggagctgcccactgagagtctcttctaagctgttctattgctcagtaaagctcctctttgtcttgctcacgctccacttgtctgcatatttcattcttcctggactcaggacaagaccttggtacctgctgaatggcaaggctaaaagctgtaatagaaacagggctgaaacatgccccttgcttgccacgttgtgggtgaagagaaggagagaaaagctgtggcccttcagggagcccagctctgggagctccctgagccagggcagtgactccctatttggggccctgaagttcctgacatctccaagcttccaggagctactgcattcgctggtgccagctggagaagctgtttgcagtcctcctggtccagctgtagcctcacagagagccagcacccacactggcacctggaactgcctgccccgcagcagcagcagccagtgtgtcttgctgtgcacactggccagaccccacactcactcacactcaccactccacgcctgactcacagtctcccttggaggcataggatccaggccagtagtgtaagccaagtgcaccctgccaggccaagtggacagaatgagcccagcaggcccagtgaaaattcaggcaaaggtgccaccagccatagaggcttccagccagaaaagcgacaccccacggatcctgtaacattactatttccttctatccaaagatatgtgaaaaaccagcccaggaattattgacctgtcttgtccctctcaaggtgcctgtcaccctacaattccagtagcttgcgtctaccagtttttatctttttataatgcttttaaaatataaaatacaatacatacacagaaaactgaataaaaccaaaccacatgtctcagtgaattattacaaaacaagcactgcgtgaccaccacacaggtcaggagatgcaatacggttggcacatctgggggtcactccccaccacacatgtatgtgccccgctataccagctcccaaccacaaatctctcctcttgatagccactctgacttttaagataaactttgtcttgattttttaaaatcattttcacctaacagtgtattcctaaaccttttagtttagtttttgcctgttatttttctaactttacataaaagaaatcactttatctccacttgaactttatctgctaggccacttttgagtttgcttgtgagaagtatctccattgttatggttatctgtaattcacttattttcattgctgaatagcattccattgcatggacacactataacttatgtatctattctagtattaatgaatatatgggttgtttctagctttagctattatgcacattactactacaaatatgcttttatttatgccttgttgtaaatggatgtgtatttccactaagtatgtaaccaagaatggaattggtagatcatctggtatgcctgtcttcaaacatagtagatattgcctatctgttttacagggtggtttaggacactacatgcctcacaacagtgtgcaagaatcctacagcttcagactcttgccaagacctgatattctgtttcctttaaatttagtcatacttatagacagatgttgctatcttatctttaacttgcatttcctagattaatagacctagatttgcatttccatattactggacctaacttgcatttcctagattattaggaccattttaacttttcttctttgtattggtgaagtaagtccatgttcaaatcacaagctcattttttctattgggttgtatttttaatactcattgatttgtaggctttttaaaaaaatagccattctagaccatatacaagcatttcaatcattatgtatattgcaaatatcctatcacattctgtgtctttgtttttcactgtctgaatgcccataaaattctcatatccagtaggagaagatacatgtaaataaaacctttgtgccaggttctctcatatacgtatgttcagggtattaagaaatacagagaaggagttgtcaattaaatgtaggagggatgagaattcaaaaaaatgtcatagatgggtaaagtgaatattggaaacatgcattcatatttttcaggaaattaaaggagcaaggatctctatgcaaaaaagcactctgagtcctctgaagccctatttatgcagctgagtgagagagcagtactcttgactagagaaatttttcaagggaggtcggtgatgaatagagccctaagtataattaaggaaaggtaaaagaggtctctggggtttagagacatagtttcgcttagaataaatattcccagtggtttataaaaagagtgaacagaagtatagttgtcttggggtggagtagagctgagctagatggcaatgagagtgagtttaggaagttgcagatagaaggcaaaaaataccagaagtttggcaagtattataggaaatagataacataccagctttagagtcacagagatcttggtttaaattctgcccctcctttccctattttctctctctctctttctgacacacacacacacacacacacacacacagagacacacagtgtctatggcatgtaatgcagacttttcaaaaagtggctgggaatgctttctctcagttccctggacaataaaataactcacaatgagagctctcgcttttcctctacaaaaaaaaggttcacaccttttttgatggtgttacagtgctttattcacccgcaaaggagcaactgcatctttccattggttccaagcttcccaggttttgagcagctggcttcctcagaaaactctggaaaacagctgacaattatacctgttatacaaatagcctgtctgcagagtctcttcttcttgctctataagaacagagaccaatcacaggcaatgttgctttaatgtaatataaacccactatgtatccagcaagggactggccctggcttacctctctgtgggaggccaagaggcttcaggaatgtgtgcctctcttgctgacaccagcctataaatttcccccaataaagcctgttccttaaccaaatgattctgtggaatttgtcttgagccctgtgcacaatggtaacttgagacaagcaacaaccattcttagcctcggtatcctcatctgtaaaagaggaattatgccaacaacaataagttattgtgaaggctgagcaagataatatatttaaaatgttttagcactgggcctattttacatggctaatagaagaaaatgtacttatggctaaaataatgaaagctgagtagcctcaatttctcaactgaatgataatgttatggcgctgatctcaaaaaaatcattcactagataactgaagactgccagtagagtgtatgtgtgtcaggggtgagaaggttgggatctagggggtggctggaaaggattttccaaaagagatttgcggaatgagagggactggccagaagcagatatactctgccaatttatctcatcaacaattgtagattgcattttcacttgtaataatgacccaatagctattttaattatgtttatatatacatatacagtttatgtatataacaaatatataagcagaagcttctgcatgaccatgggtaaaattgttcttatgctactggactcagagaggctatatgtttctattacagtagttggactgaataaatacgttctggcggggagggtctgttttcctgtgtttaagctgtaaagtgggagattctctatagagcagattataaggaagttggcccgaggatgacataaaagataaactgtgtgtaaataaagtagtcaaagcaaactaaggtttccagggctaaacttcttgtgttggagctgggaattgcttctgattttattcctactgctactagtgtcacaggatccttggagtgttgcttttctggctgaaaacctctgtggctgatggcgcctttgcctgagttttgctcgggcccgctaggctcattatgcccactcggcctggcaggctgcgctcagctcgcgctactggcctggttcccacgcatgccaagggcaaggcaggcacggagtggtgaggggtatgtgagcaagcaagcgtgggatccagcaactgtgcacagccaggcacgctggctgtggcggggtgggcagctccaggcacctgcatgggtgccacctccctgcaaggctgtagctgaaccaggcataccacaagcagtttccacggctggcactggggaacgcagtggtgcccagaagcttgaagacaccaggaaccgcagagccccaagagtgtgtcacatccctggctcagggagttccttggtctgggctccccaaagggccgcagctcttctctgcttctagtagaccacaacatggtgagcaaggggtgtgttttggccctgtgtgtgttacagctctttcagccccaccatttggtgggtctccagttcttgtcccacatccaggaagaatgaggtacgcagacaagtgaagggtgagcaaggcaaagggtgctttactaaacaactcagaggagacctgcagtgggtagcttttctctgcaggcagggcatcccattgtctgctcagctctcagcaaagaggagacccataatgtgtagctcctctctgaccaaatgatggtcagctcatcatttgcctgagtcgcttgaatccagggtttttatgggcttcagaggggaggtagtgaatgctgattggtccatgggcagccatgggtgggcccagaaaaagcacggcaagttctcactcctatctgcagaactggcctgaaggcggggtttcaccggggaactgcccctttccacccaggagcctgtctgcctcccattgtcattaacctgccatttacagtgcccatggcgtccaggctattcatgccaaggggtgcctgcaagccaacactgagctgcccttagccccttcttggcctccctctcatgctggtcagtgcccaaagtccagagggggctaaggtggcagggggctggtgtgttagtgctgccccaagtgtgcatgcatgcacctggccaggttgcgacagtgcctgggctcagccttaactttgctctgaaatcagagcaggcaccgggagtggggagaggccaggcagagggagcaggtacttctgatcctgcaggggcaaaggggcttcccaggcccccaaaagtgcagagatgcctgagtccgcagccgcagctaggtcgctgcagtggtgcctgggggagtgaggttcctgcccctccaacttggaagggggcagggcttccatctgttcctgagagggctcagccctggccacacctcccctactgcagccagtgtcatggcaacagccactccagacaggccgttgctgttatcattagagctggccagaagaaccaacactttagtaatgagttaagacaatattggaggaatgagagtctgtttgggcccacctgaaggcataatactggggcccccacaaggatgaaagtaagcatgcaagcaggagggtaagagtggagcagataaacttcagtgttgcccttaattacaaacgtagctggctgggtgaaagagacaccaacccctaaaatacacctgacagatctgctcactcaaggaattctactcagtgagaatttaatcctggtagactacctagatcttcgggcccttttaaatgcaaatgacacaaagaatgacagaaacctcattgtaaacttacatttaggtctgagcatgaaggactgtatggagttctttctcaatggcaagtttagggtaggatggagggaagatcagagctttggaattctgaaggagagggaaacatgctgaaaagaaagagaactggaggggaaagccaggaatagaaaagaaaatgttgcccattcacaatgggaattaagcttttcctataataaagaccttgacacagaagtgagtgggctaacgaactttctccatccaacagttagttctatgtgtatcactaaagttataaacacattcttgagtaccagaattttaattttgataccacaacctttgaaattctactataattgggtcaaactctggaacagtagcagatatgctgacttgctatagaatgagagtgacaaagaatgatgaggaaatgcctgaggttgagtcccaaagtactctaagtgtcccccaccaaggacagtgatgactaaggccctctccatgtccttgatgtcaacattagatgatgtgtgttaaaaatgttgagaatggaggggactatcttcaggacatggcattactctccacatggaaggtgtgttcaatatgccatcctgggaagattgaattcttgcagcagcacataatggaaaaatactacagcactaagcagtaaactgagaatatatcagaatcccaaagactacatctaatattgcttaactgtagaatgtagttatacactgttctgactggaaaaaaaaataaaacactgcaattttttctcttccctattgaggatgagttccttactaacttggaattcagttaaggtttagtttaaccaaactattccttagggagttgattcctatcaaaggtcaaatcctgaaagagtaaaataatcaccttccaaatatcaatcttgtaaaacagaaggaggatcagaaaattagtaggttatactttatgggcaatttctcttcacagcttaatgctttgtttatataactatccttattaaattattttagcaataagaatggtgttgccttcaccccacttcactctccaaaccctcaataggaaaaagttggctggaagagtgaataacaaactaatcgcctcaaacttcactaagattaactggatatgtcacctcctctaaagatcacagcagtcattcactggaataacaaatggcaagacgggaaaccaaattgtcaacatgggtacaaagaatctactaatttgcttgaggttagtgggtaataggcagtgttatactaacattattattcctttgtgatacatttccaaccaaatttcttttattagaaatgcttttttctgattatgaaaataataaatgctccttatgaaaaatcaaaaatatattttaaaaatacaagaaaacaataataattaacaataagactggcaaccacagatgatcattgtaatgaattagcattcttctttcagtgttttggtgtatataagtacaatacattacagcatgtaggtgctttgcagtttatgtgtattagcatggtctcattttgttaaattattataagcaacaatattaatgcctgtattatattccaatctattgacatttatatatcctttgttttctaacataaaaagcttttaaaataggtacaaatactttttctaaaagttttacattacttcttagggtaaaattcttggaagtagtgtttctgaaccaaagagcaagaagaaaatattttgccgaattattttctagacagttttctttgttttatagtttgtttaatcttttgctgggcatataaaatagtagtctgatctctgtgccttcttatcaatccaaaatatttcttctcaaagtattttctatttcaaaagatgaaaaatatgtctcaagttatgtttcatttattacatctaagtcttaatcattttcataaatgtatcagtcaaatgtagtttctttcataaattgttggaatatgccctttgtaaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttgaaaaacactcgaagacaaggaaaacttgattctgaaaagtcataggaagagaagacctttgaaaacacttcaatacaggagctagatgaacaactcagaaaactgatcagctcaacaggtgacaaggagggacaccatccatggtccaggggaggcttcctgctggcttctgggccctatgtgaggtgctcccagctgcctgcccttattccctgttctgcccaccctgttctccttgctgtaccttaaacatgtcagacactcttctagccagaaagttctttcctgagataatcgctagcctcaccacttcatttccttcaggtctctgttcacacaggaccttttcagaaaggctttttctctgaccacactgcttaagtagcagcttccttcactctttttctcctcaccctgccataaaggcttcacagcccttgagtgcaatggcaagctatcatagtgattaaagacctgattccgtcccctcccacctgtatgaagttcagctagctattcaccctccctttgcttcattttctcacgtggcaccaattgtagcccacatgattgctgccccaccctctcctcagtcaccattccagagtgctctgatggcttcacactgctagtacctgcaatctgtagccagaaaatgtcatctggccccaggagcatgttcaacctatgtgctaagcaggacagaagagccaaggagtcaaaactccagggaatggccttcacactatggtgagggggaagataactatctcagcttccttaccccttgggtggaaaaattaaggccatgtcgattccagaagtctgcagccaaactaagacccagttgcccatatcctatatgccgtgtaatatatttcttctcctttctctccctgtcttagttctccactcttttaccagtccagcactggggaagtagcaagcaggtaacttcactaagttccaaaacattaattgtgttttccagtttagaagttctgcatttggcagatactgggtaactgactagccctaaatgaagtgacttttgtatgtgattaccttgtgtcacctatgatttctttttcctcatctaagatctcagagagaggatctcgagctctgaaatcccactgaagccttaactcaaaattatttttgggtttgtaagaataagtaaatgtctctcaagtattgaggcaaaagtaaagaccttaactaaagaggaatggacatcagattgtcctaagctacctctactacattaactgctggatgacaatgtcacaaatctaaagagttctggagcaaaagtctgtgttccaagctaagataatagaaatatagtatcagatatgcaagagtttagaaagacgatcttttactgagaaagttcaattggaaaaacaaaacacatcgatcaaataagaggagaatcaaaagtaacaacttaggaataaagaagtaatgtaagagtaatgtttgagtgtcttctattcagatcagactatgatgtaagactcatggaactaggaagattagcaacagttccacacataaaccataaattgtgtcaaagaaatagtactagcaatgcactgatttagaagttgaaataatttgggatcataatgaaggctatgaagcttgatcaaagatttgaaagaaaagatgtgtatttgtatggataggaaaaaaaataaaataagagcacttttgaagttggaaaatgcctgagcaaagatccaagattagagatgctcaaggtcaatttttgccacagtgaatacaccagctggactggaaatacagaaatcactgtagcatatcaggatgtaaatttggaaaagtgaatttggggtagactgtggggggacctggatgtcagaccaggaaattaagaatattttattttgtaaacaatgtggaactgttgagaactttgtgaaaaatcaagtagctaaggggcactaacctgtatctgtggaagaatgaggcaggatagaagcctgtcacaaacatttgaaaagagagaagggaacgtgaaagatatagtgcgataaacaaaacagcaatagttggtaactgcttaaatatgaggctcaatatggagaaagttactactttgatatatcaaagttaagataatgttgaggaattaaattaaaaattagggaaacaggtagtttagatacacagcatagaaggaataatgttatttactatctacatttagggataatagttggcatttacttaatttagttatcaaattctcttttcgataaatctgtataacatctcttttctcgaatataattgtttggtaaacattacagcattttattaacaaaccttgttaaaagttataacaaattatacatgttttaagaattaatttggaatacaattatatgcttaaagggacctcaaagaatgaagactttagatgaatttttcatattaagccaaatttgtcaattggaaagaaatgtatataaaagattttttccatcatttgtcttctcctggtgtcccaatggtaaagctataatattgattaattagaaagagatctcatagagaagccattttattcactctgataccctggccactctcaggaggacgtgagagaaccactcaatatcctgagcacttcctgtgtaactgacttgcctctagacccaactttgaattaaatatttgccctggaacttgaatcatgccagaaatttgaagaatcaccttttgcgtttcctgatttctatttccacctattccctttcctatatttatctttaatttctaaattttctagaaggagaaattgaagtaatattggccgaatattcccaatggtagtaaacaaaagagaaacaaagtacctaccagaaactgaccatcttaacttgtgcattctgtgacattttattaccaaaatgaactatttctacgcatcccaaatctcctactgacttctacaattaatatattcccatattccacaataccaccaggaataagtcaatatttagattagaatatttctccagcacatgcacaattattacaatgatcatggtattatcaatacatatatgtattcatataatttctatcataaatatttttccagagacaatgagactatatcattttattatttcctcattttctatgatgtctaataaatatccataaataaaaaataaatctaagtaatcaattaagtatattatttgtattattaaggagtattttcccctttttaaatgagatgttcttaaagcaatactgtaaagaattctaacagataatatatattttctattttgagggtataacatcatttgatattggaagaattgccatggggtaaaaactggaatatggaaagctaccatattgacaatccctcagcatgcaagtatcaccaaaactcttacttaaatgtgctagtagttatttcttgtatacagtcattaaatttagtttgtagccagaacaaacattatcataatatattttttcaccatattaaatgtttaatataatttcaataaactaatttatactatacgactgaaaaactacaggcagattattaatgatgataaaagaccagttgtaaaagaacatctgttataaaagttaaaaggcccattaagaaattatgtaattaagtcttctatatccattcggagcaacagcaaatatctctaagtcatttaagaaaaatccaaagtccccaattaacacattctttttattcttttgaattttgcatcttgtgtgaattgtgccttaagagttattagtagaatctattcatatcccaaattagaggaagacatattagtgaggtcaacctctctagctgtaatcacttagcatatgaaagaagaaaacatatttttcctgtttcattaaaaatgtgaatatggcgtatagagagctttataaagcagatcaaaaaattcacttatccttatttgtgcagtccatttgagctagtaatttctgcttaggtgaaggtctgctcaactatgttacagcatatcacaaaacccacataaggaaaataccttcatttatcattgttaaattttttcaagtgtagaatactttccattgaatcactgtcctctgtaccaaaatttcaagatatggaaaatctgaattttcttaagaatagtttaggaataaaaaaatcctgtttagtttaaaggcatattcaagctaaatcagttatgtttaggtcacggttgcccaaccatggcctatgggctacatgcacgtgtcccaggacagcttggaatgcagcccaacacaaatctgtaaactttcttaaaacattaggaaaattgtctgcaattttttttttaagctcatcagctatcattagtgttagtgtgttttacatgtggcccatgacaattattcttcttccaatgtggcccagggaagccaaatgactgggcacccctgatttacatcatgttagtcatcacttttttttcttcttcactaactcacctataaagagcaatgtccttcctgataaagtgataaagtgaaaacaatgttagaactattaaaggacattttaacactaattgatccaacctaatggaaactgtaataaaagaaagattagcaaagcacaaatttttcttgcttttactttgtgaaagtatttgtttactttattatatataatatacattaaattgataatataataatgtattatgtcaggctatatgtttggaaatgaacagtgtctctttcttcctaattaaaaaaataagtggcttgcttggaaaaaaaagaggaaaaaaaaataaagccctgtaactaagtctcatttataaatattaatgcaaaaagttctcaataaaatactaaatattaagtaaaattaaatctaatattatattaaaaacaatatacagtatcaaagaagcatttattccacaaaaaacagtgtagttagacatttggaaaaaattgataaacgcattaataacggacaaaaatacatcatcatgttgataggtgacaaggcatttgacaaaatttatagtgtatctatatttagtaaaactttaaattagaaatcatttttaggatggtcaacagtgacatcagagatcagcaggcattatttaaaaattgcagtattagaggattagggtcaaaacaggaatgcccagcatcacaatcagtattccatgtcattccagatgtgctaaccaatgcaattagacatgtaaaagaaataagaataaaaataactgataatctgaaattccactggaagcagttagtaaataaaagtgctacttaaaaattattattttaagcatatcaataacttcttaatatacctacaattacctgaaataatgagaaaaatttaattagcagtcataacacattaataacatcagcaaatatcaaatctccataaacttagtgggaatttcccagaactacattaaaaattataatatactactgagagataatatgagttgaatacaaaatgtacacattgctcccctgtacagatatagtattttctcgaagttgatctgtaagtttatcctattcctaaaaaaattccagttaagtggataaattttaaaacatgtatttatatgttcaaaaacaaagccagcaaaattttgaaacccattctaatggcagtggcttgccctattagatattaacatatatcatggcaatattttaaataatgatatactagcacaaaaaaagatagccagattaataaaatagacaattcatagcagatctagaaaatataatattgtatagtaatatattcttaatatttcatattattacattttaataatatattaaaatggccttccacatcactaaaaaaatttgatgagttttttgagaaataactttggatactggctatcaaaaactcaaaaaattagatgtctatttcataacttacaacacaaaatgaagatgaattcaatgtttcattattaaaatgacatcatgaaaaagctacaagaaaatacgtatttttaaaagtcctgaaagcttactatggctattttagtttaaaacgaatttcccagttcaaagattgacctgtgaacaagatataatagtaaacatgaacttatcaggtaagagtaaaacaaaatattttattgacatctgcactctgggagcagtggtgagaaaagagaaaggtgtttagcaccaggaaagagagacatttggtagtcagtaatcaagggagggtttgcttatttatattactcttatttagtagagagttggtagtacaaaagaagagaaacctttttgaaagttaatatttttggccaatccaggcctttcacaggagatcttccataggactgttacacatttctaggcataacatgacagaaagtgcagaggagaatcttgatggatgggccctcacaatttgtttaaattgctgtagggcaagtaacaccaaatatgaatagatgaattacagaaatacaattgtaaaatatatgtcagacaacagattaatgtatgtattctcaaagagattttgacaatcaaaaggaaacagaggaatattccaaaagaaaaataggcaaagtaatgaacaggcaatttgcaaaagaataaatacaatggctaattagtatacaaaaactctaaatctcattaggaatcaatgatattcaaatttaaataataataaaattaagttcaccactgatgtatataaagatgaaaaataataacacccagttttggtgaatgtgtgggaagatagataaattgatctgttactattatgtatatgactatgaacagcaatttgagagtagctatcaagaatcttaaaggcagggattacatgcctaagaatttttccatgaaaataattgaacaagtaaattgttgtcatcttcttcatacacaaaggacgccatgttgttaccgagattaagataaattatttattttttcagaatgaaaagctatttactattgtaaagactctgtcctcgcagtagactaaaatcaagaaaacacaaagactcttttttagacggcacccacaattcaaaagctctaatcacaagaacaaagagagacacagaataaaagagacagatggagacaatgtgagtcccatttgagcacctgcagggaatgggttctctgaacagtaaaaagctggaagccgaagcagggacacctgggcattacccatctttctttccctggatgagaatgaagccttgctaatgctaacttcaattcaagaaccagaagagcccaatatttttatacaataccttaaatagaagtgcacagattgttaatgttaagttcttccagaaggctgatgtaagctctgggtacaaaagactcatggctcagcacaaatggggccttttcctacaccactctagttagtatgggcaacaccaacagcaattctgtgatctattccagaaccaggggccaggaaatcctccgacagaatgtgccatgctaaaccagaaatataacctaacttaacacatacacatgtacggtctcttctcactaattggaaatgtgcaacacctttacaactatgtacctatttaaattcttaagccatttttatttttaatttcttaagccatgtgcaaacataaccccctgaaagagggatcaaacctgctctagagtttataaacacaatctgctgaaacaagcaaaagcatttccatttgtcatgcttgatatactcagcccatcctgtaatttgaacaaggttattcattaattaccttggtaattaatgttatgtcaatgttatgacataatgggtgtcaatgttatgagtttataactgcaaactggatgtttttgtgtccctctccttacatttaggcaaaaaactgctttaaatatttctaacctttgctactgtatttcctctgaggctacacgatgccaagacagcttaatagaaatggaaaagtgcagtcagtactactgtaaatagctttttcatatgaaaccaaatatgcttatgtttgtaaatatccaaagagtcatctcattggaaaatctttaagtcaatgttgttggcatcacagtaatactgttgagtttctagagattcaaaatcatctctccacttactaccatttcaataaaatacagtctttctcattctccccctaatgataaccttgaaaccaccattgcaaaattataactgagacagtgaaagagatctgacctaacgaactccatcttgcttctaaccttcaagctgtcctgtccctttgggaggaactttgtttatagtttaaatcaaagatgataatagccctttctgaaaacaaacctccttcctgcctggggactagactgcctttgtaggactaacaaattagccacaagattagaaattatggtttaggaatcatgcagctggagactacaagattccgaccctccccaaattgctcctgagggtaacatcactattgtaaagcctaagaccagtgcttcagacattttccagaccctgtacttgatagatcagctggcaccacccaagatggataagctggttcatctgatcttgtgatctccaccaaggaactgactcagtgcaagaagacagcttcgactccttacgatttcatctctgacctgaccaatcagcacttccaacttactggcacccccacccaccaaattatccttaaaaactctgatccccgaatgctcagagagactgatttgggtggtaataaaactccagtctcccgcacagccagctctgcatgaattactctttaattactctttctctatcgtaattcccccgtcttgataaatcggctctgtctaggcagcgggcaaggtggttacaacctctctcatgatattaaatttaatactagactgaaaattcactagtatgtaatttttccattcccttcctgagcaatgtccagacgtacaaaaagccatttcaaatgaccattaagtttttcattcattcagcaaacatctattgaacacctcttagctatgcactaaactaagtcctgagaatgtaaggtcaagtaagtcatgactcccaccctcaaaaagctgtagtctagggtggaggcagacaagtaactttgcaattcaattgcagtatggtaagtgctacctactgataaaggagcatgtaggtggaacatcgaaatcagactaacactaacgagggtgatctcaagccagagaagcctttctagaggtgacttttgacctcagttttgaaagataaagagtaaaaggtgaaatggggttttgaaaaataaagagtaaaaggtgacatgtcaaaaacagaagagagaattattcaggaaaaggaacaacatatgtgctatcataaaggtgggcatgacccatttccagaatcacaaagtccagcatagccagagaaaagggcacatacagtacaaagacaataagaaccttttcaggacaggtatgatgtgttaagccaaggagttgaggcaggatgctgaaagctgcagggagctatttcatgactgtaagcaagaggaaagtatgatgatagaagtgttttgaaaacaagccctctggctgctgcacgtagcccactagagagaggggaataaaatgttactgaaataattaagataggagcaatctagtggggaagaacaggtttgcaagatatttcattaccggtgaaatactgaaagcaagtttagtagtttaaactggttcaagtttgctgacttggaagaccaggttggatgctgtttaactcactaagatgagaaactcaagagaagaaataggtgtgaagtgagagttaatacacctaattttgaacttgatgagttgaacatccaagtgaaggatacagttggagaagtgaaaggtctagatctttctagagagatgagaatcatctgtatagaagagaaggctgaagccataggagtggtcaagattaccagtgtggggggtgagtggggggttgggggatgcagaaagaagaacagaggaaccagcatagagccctgggaaattctacgttgaggaaagcatgagtggtagatagactacaaatatttaattgctagaagaggagaaggaaaagaaggaaaaaaaggaggagggggaggaagaggagtaggggaggaaagaaggagagatccacagatgttgatgaaaaactccaagaaggttaagtgtctcagatgctttaacaacataacttaggatgagcagcacaaatgtttggagccttcagcaacgtgcaaatcagatctgaaggaaatattggtacagggaggaagaaaaggagaaggaaccagattccagaaggctgaagagggaaatgggcagtgtggctgtagtgtagggcagttttccaaacagtttattaaagaagagaaagaagaatgcagacatcctcatatcaaccactacatttaaaaggactaattattattatccaattctttcacaaggcatatgttggcaacatccttttcaagcagaaataaggtctttttaaatcaattttaatggaagaaaagatatactccctttccccattctaatctgatgacaaaagttctaataaagtagcagtgagaacaggagcagtagctgggaattagagtgaatcaccttgagattccatccaaagttactcaaaattgtgtttgcacacacacacacacacacacacaccacatacaaaacatagtttatattagtaaagtataaataaatatgttatattcacctcttagcatcttacatctttgataagaccacggtgttacgtttagttacctaatatttaatagcagtgttttatatcacttctttccaagagatttaaatcactgttctcaattttcctaatgcaatcttctctcattattcctttttgagattggtggtgatcctcccacaacccctttgtataattattttcagttattactaatgcttgtttataactctgatttaacatcagctataaattacagtcatgcaccacacacatttcggtcaataacagactacatatacataatactgaatttttactgtaattttctatgtttagataggtttggatacacaaataccattgtgtatctaatactaatacaattgcctacagtgttcagtacagtaacatgctgtacaggtatatagcctaggagcaatatgtaccatatagcctaggtgtgtagcagactataccatctaggtttgtataaatacttctatgatgtttgcacagtgacaaaatcacctaagaacacatttctcagaacatgcccccaacgttaagtgacacatgactgtatcaataactataatggtctacatttatatagtattggtctgagagatcccaaaggacctttccaaacaatacatttttcacataaataaatgccaggcaacattgagaatgataaaagcaaccagtcacacaattaacatactgtttacctagctcctgaacaataaaaatgcttctcaagactcaagctgatatcaatcacaataggtactccactgaacaatatgccacaagctaatatcacctctgattattaatatggggcaattttttattccctaggagataacttgtatcaagtcaaattgaattggtttgtacaaacagtacgaagacagaaaataagaaccttttcaggacaggtatgaaaaggatcagtggcattttttaaagtcttgactaaaatggtactttatgcataatttatataaaatctttcttatactgagctttttctgctaaacagggaaatctgtgctgataactgaaacaaaaggtggtcccaagtcacaaattgagactcaagtaagcactccttccctgaccttgaacaaatcatttatattgtttacctcagtttcactgctttggaaagaaaactctatcatttctgacatgaactcagcaattcttgatttgaaaggtcatgaaaatgtgctgagagattcctctttccacaggtggttttggcagcagagtcttgtcttaaagattcacgttattcaggtatttttgttaacctgccataataagtagtaatgtagaatttcaagaaaataccgaagcatagacatttcccaacggagaaactctaacaacttcctgcagtaaaccacataagatattaacaatagaataacccaaaatacatcttcctatctaaaactgatattactatgaaaatgagaagttgaaagtgggggaacttaagaattagtgataaataaaatcaatatgggcaattaactatcctctatatagaaaacaattgcaagtataaaactaatacttgcttatatggctgtgaataaaaccagtgagacgtggctacagagagtaggctttcaccattacactcttctggtctgactccaccaaaaagcttttagaaaatagattactggcagtactcgggatccactgaatcagaattccgtaaatctgtgtgcgtacgtgtgtgtgtgtgtgtgttcagtgttcccgagttgattctaatgaggctgtttccaatacacagaagtcactaaccttgcttacctgcagaaaaccaccaccaccaaaaataaaacactgttttcaaacagaggaaaggaatcatattctccaagcatttggttttccactgggaggactgtcacacaatagcttttaattcagagatgcacatgatatgtctgcaagggtagagaattttgtaagcatcagttgctctcctctctgcttaccctgggaacaggccaggatttttccttgtaactctggtcctgaatgtggcagaagaactgaaatgtcctcaagaagaccggtctaacacgagctgacagcatgatgtcatgacaagaacaaaagttctgaggagcaccacaaatagagactaaaatcctagctttgttatttacgatagtataataataaggggaaattatttcccttattaatctccctgagccttcgtttccttctttgtaaaatggaaataataggagccactttcacaagattgtgggaagcagtacagcatgatgtttaagagtggatgcaaatcccaatgctgtcacctacttttaaaagactaagttccttgtctgtaaaatggggatcccaagagtaccaccttcagagagtgatgaggaggaggattaaatgagacaacacatccattacagtcatccatccctctgtataagcttggaattggttccaggacacctaccccccacaccaaaatccgagatattaaacttccacacttggccctgcaaagccacccacaggaaaagttggtcttcagtacaggcgcgtttcatacctgcaaaccctgtattttccatctgcatttgggtgaaaaaaaatccatttgggtgaaaaaaaatccattagatccatacagtttaaatctgtgttgttccagggtcaactgtattattattatgattgttgcagtaattaaattaaaatattgtaacaaaattgggccaatgtttaaaccttattctcacattttttaactttatataggtagaaagacatactggctatgctcaaaagtctatgtaccaccagagaggctgaaaaggcaagggaaaaggcagcttgaaggcaagttttaggactgcaaagcagtcctacaacagtatcctatttcctttaatttgggactttaaaaaagatctgggtaagcatttcaaggattaacctcacagcccccaccccaccacacttaccacttctccaaggccagcccgcacagccacctctcctacggagcatggtggccaactcaccattaatcaaccacgccaaatattttaccctcagtgcccagactcttagcctgccttctgcctggaatataaccgacaaaccaagtccccatccagcaaaatctcacttactcccgtaagacctgacaaaatactccttcctctttctctaagtttctcagtcagaatacattattccttccactggactcccataaagcaatcatgtgtatacctaattctagtcactagttaattactaattctggtcactagttaattactaattctggtcactagttaattctgatgtattttaataattgcctatttataaggctggctttcctttagatttcaagttttctgcgggaagggactctatcttacatatcttcatttccaccacttccccaacagaggctgacccgctgtctggcatattgtaggtattcaacacaaatttgttgaaatcatatttatgcactggggactgcaatgaatggagcccaaagctcacctcaatcacttggtacctcccctaatggctttaactcattgtatggtatatactaaatgaaagtgtgctttgaaaaataaagcataaagccattcatatctgaaaagtagactagtgcataactgagcctaggacatatgtagtacgatttcagtgaaaggatacaactgattggcagtttaaaaagtcatgttcccatataaaggtattatagcttaatgtgctataatgcagatccagtaaaatccccaccactcatttttaaatatttgaagacatataaggtaatgtctcaggaacacagattgattttcagtggatgtgctattaaaatgatccacttttcatatcataccctatgctgaccctttagacaagtgtcttaaactatactaaattatatttcaatcacaatcctatagcaataaaaaataaataaaaagaatatgcacctggagcgaaaatggaacagaaacatagccattgctaaacataacattttctctattttggtattacttttaaaaatttagtattacttttaaaaaattataccaagtggaggtattaaaattttcaatcaaagtaatatttgagttgcttctctaacagtatacgttgtttacatgtttttgtaagccagtctgtttcttcttacttcatacaatagtacttacagagagaaattatttagaatagtggctctcaatgtagtccacagatccctagggggcccccagaccctttccagtgatctgccaggtgaaaaacattttcatagcaatattaaaattgtatgtgcctcttccattgtgttgacatttgcacttatggtaaaaaaaaataagaaaaagaaaaagcaacaatggtaaaatcactgatattttacaatgaggcagacagtggtgccgaactacactagtagtcatcatattcctcactgctacacacttgcaatggaaaaaataaaaaattgctagtttcacttaagaatggccaagataaagaagtaaaatttattgattaaaaccttgatgtgtgagtaaaaaaacagtgaaatgtaaaactaaagcacttctgttccagaccaaagcatgacgcttgactcaggaggggtgggggagcatttatatgattgagttgtgatctgaattagccatctttttaatggcatgttttttcttgaagaaacgactgacatataaaccatggttattaagacttgggtgtttggaagatttttcttaaaaatgaataaacttaaactattagctcaagaaaaactgacagaattttctgccaatgataaaatttgggccttcgtataaaaatattttggaaaacttgcatactcctcaaatcaagtccaggttttctgatcagagttttctgattacactggtggtgatatcaactagcgtaatgttttgttattatacaataaaatgttccaacatttaaaagagatacataactcagtgaaccaatattttgcaaatatttcaaagcttctatgattaaaatatctatttaaagcacaacatagaccaatgaattttaagtttattgaactgtctcagaaaactgaaattaatctttatcaaacaatatttgtcagattttggtgtaataccaaagattatctgaaaatgttatgaaaatactcttatgttacaactagatatgtgtcagaccagatttctttacattcctcacccagaacttaacatggcaacagattgaatgcagtggaagatataagaatgcaagctgtcttctagtaatccagacattaaagggatttttaaaattgtcaaacaatatcactcttctcacaattttttattcttttgcaatggctatttttcattaaaatatgttatttattaacatgtaattgatttattattatttttagaatgtaacttattattttaaaatgaatcaaacacattttaaatgtttctcacttttaatatctgagataaataatcaatgataatgcacacaagagcttcctggaatccttaataatttttaagtgtaaaggtttgctaggaccaaaatgtttgagaactgccgatttagaatttatatgttaggattctctacaatttaatagaaaaaaaagatcatttctctggcaatgctatttttcattctgttgagtttgattcttatctgtatagattcaatgatcttcatgtcatttattcaacatttttcagtccttgctatacgccagatatagtggaagaaaccaggacacagtttctgttgtcagggtacttacaatttccattgttattcatattaagacatagtcatatattatattatattatattatacttgtttctcttctgtgtgtgtgtgacgtgtgtgtctgcatctgtgtgtatatgtccaactgcttcctaaatatcttcacttgaatattccacagagagctctcataggtccaaaactaaaattattcaatcgcatctgctcaattaatgaaaatgtattaccttgtactttgcttttgggtttttttccccctaatattaacactaggcataaaatgtgaatagtttgtctttttcttttgtgatgataaatcacagctgtgaagcttcattcttttctattctgttccacggtacaacctctgcttgtaaacatattctccctaagtcatgcttattgaatttcttcttgcacactggattttcacaagattattcctcttaccttgtgtttctctccttccgaatattaaataccaccctcacaataaaaagctatttagaattacgtgtacctgtattccatttatggcatctctataattcataagcaactcagatatataataaatttatatgtacaatagatatataacaaatttatatcttctgaaaattctcttttgatttggatatatttatttgccctaaagaaagctaagagaatactgcttattaaagtcacaaaggggccattataaaatattacaactagagttttaatgtgatgatttaaaacaaatgaagtacattcattttttcagctcaccagggaaaatatcaaaataaaaatttagaagattcatatgtatttaaatatcacatttcctgtgaattagacaaaaattatacaaataaaccttcaatgtatggccatggcaatggagacatttctgtgttatgccatagtactcatattactgaaattatattcataaactacatgagtcattgtatgttccctaacattacaaatctttaatagtggaagactctaaatttatgaataaccaggaaattcatccatggttatctagaatatagaaatgaaattttctgattcagatattattattgctttattgagaccaccatcataacagtaccctaaaagttaaaaatttttataattagtaacaaaaagcaaaatttaaactttttaaatttaatttttagatagtattaaaacgcattcaccagttttacacatttatgttacctgtttgactagtccctctaagaacatcaaattccctggttttgataatttgtaatcaagaccaaacaatccatttgatgatgacttactagaatataagcctagtaacacatcaagaaactacaatgactcccttttgcctacactaccaaatttaaattattctatttggttttaattaaatattaaatttaaatttttagatatttaaatatctaaaattgctcaataaagcgcgaaatgtcttgataacaatgatctttcatacaaggaatatgcaatataaattatacttcaatttttcagtttcatacttctatgtagtttataatgactgaatataaaagaaagaacacagtaaaccactgtgtagttactgtgttgttaatggtttcatgctaatatgttttgcttattatatttaaatgtatgtatcttaactcctaattgaaatatatttttttcatgtttagggcaaagcgttagtcaaatgtatcattggtgccctcccaacactatattacactattttcaacataacatatattcagtaccattaaatgtcaaatcacacttcaatttaccttggaatgcctggttacaagaggatagccgtatacatagacgttactttctcaaagacagactacttgtctgtagtttgctattactgtttcatgcttcataacttcaactacaaaaatattttgttggacaaaaaaaccacatttacatttgattttcaggcatttaaaggtatgcattcctagccacttgccctattatgctctgtggtcatgcattctgccagttttacacattcatgttacctgtttgactagtccctctaagaagatcaaattccctggtttggataaagattttataatcaagaccaaacaatccatttgatggtgacttactagaatataagcctagtaacacatcaagaaactacaatgactctcttttgcctacactatcaaatctaaattattctatttggttttaatactattcatattctgatgctaacatattaaccaaccttattctcattactaacaaaaatatatacagtattcactgtattttctttatgcttacctttctcaggatgctaataatattcttcctattttctccactttcataaatactatggatactttttctttcagttttgctttgagtaataaaaccatacaaatacaactgaagaattataaattttccttcagtccaattcttctccatcgcctccttgctttccagagataaacactacctcggtatttattattcctgtgtatatttgtattcactttgcatataagtttctatctacaaaaacatatagtatgtattaatgttcatatattttatattattttattgtgtcatattatcacactattctacaactagcttatatcactcatgttttctagatttacctatattggtacatcatacttaatagtaaaaaatgtaattatttctgtctatgataagaaaaaagacaaggatgtcttagtttgtgtttttccagtacaattcaacattgtaatggaagacctaaccagtagcataaattaggaagaagaattaaacatcaggcatattggaaaggaagtaataaaactatcttcatttgtagataatatgattaagttgaaaggcctaaggtgtctaccaaaaagcagctgaaaaaatatgagttaataaagattgctggacacaaagtgaacatacaaaaataagtttttccattaccaaactagaaatggttattttttaaataattgcactcacaagaccatcaaaaatatgaaataaagagaaatttaacaaaatatatggaatacctacatgctgcaaatttaaaacattgtggagataaattttaaaacatctaaatagtggaaagataatgttcatagatgggaagactgaaccgtaagatgtcaattctctccaaatctatagattcaatgcaataccaactaaaatcagagcaggtcgggtttttttttttttttttttttgtaaaaattgacaaacggattataaaattcatacatagatgcaaaaggcatagaataccaaagtaatttttaaaaagaaaaacaaagagaatttacactatttgatttcaattcctaatataaaactataataatctagtcagtggggtattagaatatgcatacacatatagacctttagaacaagacagcaaatccaaacatagacttacacatatgtattcaactgatttacaacaaaagtataaatataatacaatgggagacagtcttttcaaatactggtagtagaacaattaatattgatatttttaagataaacctcaagcttcacctcttatcatattttaaaattacccttcactggctaggtaccacagtacctcacacctgtaatcccagtactttgggaggccaaggcgggtggatcacttgaggtcaggagttcgagaccagcctggccaacatgatgaaacctcgtctctaaccaaaaaatgtttaaaaattagccagacatcctggtgcctgcctgtaatcccagctactccagaggctgaggcaggagaatcgcttgaaccgggagggagaggttgcagtgggccaagatcatgccactgcactccagcctaggtgacagagtgagactccatctcaaaaaaataaaaataatgaaataaaatcacctttctaaggatcacagacttaaatataagagctaaaactataaaacttcgagaagaaacaatgaaaaaaaaattcataagcttgagttaggcacaaatttcttagctatgaaagacaagtaagattcatttttagaaagttgacaaattagccttcatcagaattgaaaatgtttctcaaaagataccattatgaaagtgaaaagaaaaatatttgttaaatatataaacaaatattacatatttttatataaaatatatataatcatatatttaattaataaaggtctgattttcagaatgaatgaagatttttacagttcaaggggaagctgtaaataattcagtttttaaaaatagacaaaagatttgaagatacttgatcagagaagatataggaatggctaataagcttatagaaagatacacaagataactagtgaccagagaaaggcaaattagagccacagtgagtaatgactatacactcacgaaaatagctaaaattaaaatgactgacaatatgacaatatcaagtgttggagaggagtacagcaactgaaactgtcatatattgctgttagtgatgcaaaatggtatggtcactttagaaaacagtttgtcagtctctcgtacagttaaatgtcttcttaccatagaatcttgaacttctattcccaagtatttagccaagagaaacaaaagcatatatcctcacaaagagctgtacttgaactttcataaaagctttattcttcacggggaaaactggaaacaatccaaatgtccatcaactaatgaatgaatacacaaattgtgatatgcaaaaagggaggtgggcaatgaatgaactaccaatagacacaacacaggtaaattttaaaaacttcgtgctaagtgggagaaagaacacaaaatctgcaaaagatataactccattcatattaccttttttaaattaaaaaaatctactgatagaaagcaaatcagtgatttctaagaaatgggattcaggacatgacactgcagagagacaggagagaacacttgaggtaataaacatgttctaaatcataactgcagtggtggttacaccactgcatatatttgttaaaaaaatgaaacctcaaattgtacacttgaaattgatgggttttaccgtgtctatattttacctcaattaagccgacgaagaaaaaaataatgggctggaaagaaccttaatgtccactcctcagcctcaaaaaagtcatgaatgttaatatccaagcctcaaatatgactgtaataaactttcaaaagatttaccttgacttcatatttgttttagccactgtcttccaattctttaaaacgactctttttttggcttttgctcctcagttcctgttttcacttttcttcacataatctcacacttagagagaactagtctgactctattagtcccagtgttctgtctaaattataaaggttctttgctttctcttttagacacatatttttttcactaataagttttcccctgcttctacaaaagcagttatcattagaggtggtataccttaattaccatagtaattaccttaatcaccctgtaattaggactacaactaagggtgaagtgattcttcaaagtcacaaatcctggcttcaccacttaacttgtatgggtactagatgtatgcttcagtttcctcatctgcagaaataaggataaaaattatccctactttatattattttgaggattaaataatatagaaataatgcctagaaatctacctgacacatcataaggactcaataaatgttagcacttgtatcagtctcacattttccattggaaattccagaaagaatgaaagaaaaccaatgtgactaaataaggccacaaaatgagattttaaatctaggaattttacttaacatcaatagtcaacagaagagtcattttctgtgcctcttttttgtatggcttcttttttgaaaaaaaagaaaatattgttgcattcttaagtttctgctctgtattacaatggagagaacaatttaaacattatttctcagaaggatatttcttatacctattactaccttttctattgtgtgtgtgtttgccttgtgcatgttatgtatgtacatgtagttaaatttaccttgtcttaaagttaatttggggctcttcagaggacttgcattaattggagctgtgtaagcaacttgcattatttagacagaaaaactaggaatacccaagtccttccttggcttagccaatcctcctcctgtggaggtctccaaggaaacatacacacaaaagaggcaaaggaaggcaccattgcactttattactagctatgactttggcctgaaactccatagtgaaaattcataaactagaacagacaatagggagggctccttgcccctatttcagttagaaaagtgactcagttatataagcagggcctaattttgagttgaactggaccaatctgccccaggccttctcaggccagaagagtgatctttggtcagccactgtatgtgagaaagcacatccttagaagaaaagctaggaggcctgaactgcttagagagagcatctcactacctcattatcactggtcctttagggaatcctccaacaagagccttgctcacttgtttttagccaggtgatgactccacccagcagcaaagagttaaacctcaaatctaacccatccaattcaacctcttcctccttgcatggagtgggaggaattcaatgatgagatcaagtggagagcatttactttccattaaaagcttacagcagtcattaaaatggctatattggtggtcacagtggcatgtgcctgtattctcagttactcagaaggctgaggcagaagaatcacatgaagtcttgagttcaaggcagtagtgcactatagtatgcctgtgaaaagccaccacactccagtctggtcaacaaagcaagaccaagtctctaaaaaaaaatgactatgaaaattaattaacatttgactagttgttatccgatgtagtttgctatgctatactttccagaagcttcaattaaaatctaggaggtatttgcaagacaaaatattttcagtgttcagtagtgtcatgttcacagtgtgaacttcaaggaaacactttaaaaatcagtacttcctaactacagtagggtatagtacagactcatgtagaagacatgcctggaccctaaacactgtgagaatagccataaggatttccatgggtttctacaaagtgtttactagatgatgtgtcattttaactctaaagagcaaatcatactttgagaacttcaggaaataatatactttttagcacaaagggctctgactcccatgacagaagagaatttactatgatggttacacaaatctcttttctgtctaaaagtttttgtaccagcttttcctaggctcttatccttctcacaaatcaggactcagttcaaatatctctatcttggtgacactttccttgacttccctacctaattagtcccactctcctcctctgacaatatcctgtttctgcatggaaatactttacattttgtagttgcttgttaagtatatgtgttactaaactgcatcctcctgaggacagggattgtggtttgctcattcagctcctaacaatgcctagtatacagtaagcactgattaataatctgttcaatgactagcttgaggaatggatgcagatttagcaattttaattggctatcgtcagagcaatgtcctcttttagctcctttgatacttggagcattgaacatagaattgaaaattttggatctagtcccaattccttgactatctgtgagtcttaaatatagtgaagcatatatctagttcacctacctagttaagtggtagagccaggatttgagaccttgaagaattacttagtctatatttaaattttatatatatatgtctgttgtcaaatggcataataacactcttagttgctctactacacaggacaattagggctaatgacagaatatacgcacgcacacacaggcatatatatatatagatagatagacacacgtatatacgtatatatacacacacatatatacacacatatatgtacacacaaatgtatatacacacatacacacacatattaaaactaaaagcattaagatttctgaaatttttattgtaatttgaaaaaattcaagatgattaacagttaaaatgatttaatatggttaaattttaaatttatcatcaaagaaattttccactgagtattgaaataagaaaacctgaggtacttattaggagcttatcatctttatatatatacatacattagtttgaatataaatcccaaatgatgagattattttccacctcaaatactgaaagaatgtttattattcaaacatgggatagggaaaaaatacaaaataggcaggcagtttaaagcaatttattatttttctaagtgccatatagtgtattttattctacccctccgaatctacattttaagtgatctgaatccacactggaatgcatcaatctttatgtatttgtgatatcattgcctttgccaggaaactatgcaaagacttttcaatcacggtgattaagtattcatattcccttgtctacaaagagaaatacttaaaatcttagggaaccaccgccggataatgatatggcatttaacagttttttttcctaattcaaaccaaacattagaaatggataggctaatcaggtattattatttcaaggaacgcttgaaatgcacagggttaattttttatgttagattgaatctgttggcatagtcccttgtgttatcaaatagaatacctaaacttgtatatgtcaattaaacacctttcccatggggccattcagaatgcagtatttaaaaacctgcaataaatcgctaaagttttaaaatagctcattacattaatctgcaacagtatcatgcctaaattatgatgctcttaaaatgtagtaaagtagatagatgttgtccacagtactctgagcatatttgattcttgttcaattcttaagattaaaaacaataataacaatataggtagtgaactggctctggaaacattttcggtaaatgccagccaaaagctaacacaagctcaaatgtcatttggtttatcccagtcactgttcaaagatatgaagcaattcaaaatctacttttactcaatatctctatgaagttagaaaaatttatcttgacattggcaagaaaacatatcctttctttacatatatcattttattctttttatttatttcttctatttctatataaagagaggtagctgtgtgtttatgtgcacacactccattgtaaacttaaaagctgttgttattataaattcactttctagttagacctgtggtaggacttaaagctattcagctgaaaccattctggagtttgcaaaatatgctattttattttcataaacattttgtgtctggaggctgctagaaaatttatggactggttattttctgcttcagtaccagtaaagcacattgctatcatgctcaaaagccaaaagatggtttcaataatgctaaaaagaaaaaaaaaatccaacacaaaatggtgtttgtttattcatatattagcatatcattgtccaaagtagtatcatttaaactttgtagctcatttgaaaggttcacatagtgcaaaactgatgaagcacataacccgtaaaggtataaaaagaaagtattatgcatacattgcaataaaaatctcatttttttaaacaatatctgatagtttgtgcctatgcacatagactgtttaagatgaaaagaaaaactttctcatttaaatctactagttaattgcagtctttaacagtgaaaatgcctttcctctccctcaccccaagatagtttctgtgtataagaagtgtcaattctctttatggttttggctgaagtttatctagaaggatcagagagatatacccaagtaattcttatttaaatactacctggaaaaaatgtctgaaatgtcagtcaaaagcttttttttgcagacggctgatgtcatttcagaataaatacggggacagaaaaatcagaaagcacttatttttagaaaaaggagcaatgtacaatcaagaacactgcagttttctcaaatgtctctttagcactctagaatttattgactctagtatgtgtgacaactctgacagctgtcgttaacaactaagtgaagaaaagcaaatgtgttttcctccctggtaaaatgaaacaattacatgctaagagaaagaaaaagttggtaaccttatactgatgtttttagtactttggaactaccctagagaattagctgggagagtatgattttcttctttctcctcagtgcctaggacagagactgacgggattagattattttctgatggtgtcaattgaaactgaaacagatgtaagaatgctgtttcctagaagatgaaatatttcaggaattacatttaatattcatatggattaatcaggtgctcaacagccagccaataaatcctatgcagtaatattttccatgggtaattcttcaattcaaccttattagtttttatttatttcatcatttagacaatatttatgttccttcagtcccaacaatcacaaaaataacaacaacaatgatacatacacacacaattctgactacaaagaacacttgacttcacttttcatgacatttgaacaattgagtatgggcaaaagtttcatcctcaaatctctaagtgaaaaaaaaggatgggttcaacaaatagtgctggaacaactggacaaccccatgcaaaaaaaatataaataaatctaggcacagaccttattctctttaaacaaacaaactcaaaatgaatcatatagacctaaatgtaaaagggaaaactattaaaactattagacgataataacatagaagaaagtctaaatcacactgggtatggggatgctttttagctacagtaccaaaggcactatttataagagaaagaattgataagctgggcttcattaaaatgaaaaacttctgctctagaaaagatacattcaagagaaggagaagacaagccacagactgggagaaaatatttgcaaaagacacaactgataaaggacaactatatcaaaatatacaaagagcccttaaaactcaataatagtaagatgaaatgaactatcaggccataaaaagacatggaggaaacccaaacgtatatcagtaactgaaagaggcaaatctgaaaaagctatgtactgtataattccaactataagacatctggaaaaggcaaaactgtggagatagttaaaagatcaatggttcccagagatgaggtgggaagaaaatatagataggtggaggatagaggacttttaggtcagagaatgaacctcaacatagaactatggatactcctatacattccactcaattttgctgtgagattaaaactgctctacaaaatgaagtttattatttaaaagaatgacgataacaaaaccaagacgagaaggttcatgaaggtaatattttctttaccagtttcaaaaaaattatgggtattgtactaaaatgtaaacctttataaatttaaacctcattaatagatattaaatgttatttcataaaataatttcttcagctttaaaaattaaatattgaatgtctaacaaagtaaatttaaataattgaatctaacattaatagagacagataatggtagaaatatattttatctttattaaaaattgctgtgaaatgaagccggacatttaaaagtacagattatacaattttatttatataaagtttaaaagcaagaacccctagtctgtgctatcaaaagttaggagagcgacttcttggcgagggtgtaatgaggaatagagaacccaggaggattttgaggtgccagctgaggatttgggggtttgttttggtgttctggattctgtgtggggtgctttcaatttatgaaaattcactaagctatagatttactgcactcttctgtatgtattttatactttctctaaagttaacaacaacgaaaagccgaacaagacctggggaaaattagagctttcttaagcaggattgagtataaattgtacttgccaaaatgttcatttctatttgaattacttttttaaataaatagggcatatgacttttaagtagttctgtcatgcagaatccacttatctctgttctgtgagcatggacaactgagtcagctgggcagtgctacaaggacttttctctgattgagttgcgtgtgatcaaagggcaacagtttaactctgcaaaggaaagagggtctctttcccaggcaacgactaagtttctgaagagactcttaagctaggaggtgtattatattctagtacacattccctgaacaccttttcaaccaacaacctccaccttcttatctatcctatccttttacttgaggccagatatattcatataggttttaggtcattttactcccatatcttaccctaaggttctaataagaaatcaagggttcaggaggtgactgcaagagaaaaaagaaagggcaaactaaaaagtctaaaccttttgggaatagatgaataacaccttgaagaaataagaaattaaattcagatagcacaatattactgattacaggagatttatcagatgctttgaaatctaaggcatgtaaaggaatttgtgtggatgggcatgtatttggtgagtttttatgtgtgtatgcttgaaattcagtaaatatatactgagggtttattgtcaggagcagaaaaaaataatagttaccatttattgcatatttacactgtgccaggcatcgtgttaagttcttaagcacgaattatctcattaaatgctcacaataaagctatgagctaggtattattattttttccatccaaagatgaggccataaaggcttataaaatataaataacttatccaagatcttacaacattagtagaagagctaggatatgagctcatgtctgtctctgaaaagttcacgatcctagcctcttactactctctcggttactgagtgatcacaagggcaaacagagaaatactggggagaaagaggacaagaggagagaaaaagaattttaagatataaaggaagatgaagtaaaagaagtgagagaacagagaaaaaatacaaatggcacagtttgggcacacaatagacatttaatgaatgttaaatgaatgtttttgacatatgcacattaaataccataaatacatacttacagattttttaaattaaaattgagtaattgttcacttagcttagctagagacaaggtgtttatatgagtcaaaagttattttataatcattttaaacacatccaaaagactgggaaaatcaaaatcccttaagcatagtaattaggcacaataatttaaaggaattttttcattaatgtccctcactttttctttcttttccttttttctttttctttttgagacagagtctccctctgtcacccaggctgaagtgcagtggcgggatcctggctcactgcaacctccacctcctgggttcaagagattctcctgcctcagcctccctagcagctgggattacaggtgcgcatcaccacgccgggctaatttttgtatttttagtagagatggggtttcaccatgttggccaggctggtctcaaactcctgacttcaagtgatccacccacctcggcctcccaaattctgggattacaagcataagccacagcgcccagcccctgtccctcactttcaaactaattttgtgtttaaaccttaatgtaattataaaagttaacagatttaaagagaaaaaataatcaagtctccattataatttttgagtagattctttctgaagcaaaatactgctactgctaagaaaataattatccctaataacatgggcgcaattccattaaatacgttccatcaataaaaaaagtaatatataattttgaagaaacaagaagaaataatgaaagaatgaaccccacctggtccattctagattcattagatgcccatctcagcagtaaagtactttcctatttaccttaagaatgtcataaaaacattcacatttctgttcctatatccaaggacctggcactgctgaaaataccctgttggttggtgctgtggcagaagcatcctttccaactcctgccttgttttcacctcccaaactaatccttatatgtagtactttctaagtctgcatctttctaaagattctcaagttctcagtcccaacccactcatctcatcatttttgtaagatgacccaagcagtctaaatattctccatatattgtacagtttatatatttttaagtattgtctatgtatcatcaccttacatttaaacttcataggaaaccaaaatagattagtatatatatccttatcagctttttttataaatgaggaaacaaaaatgtatagaggttttgttgcttggccactattacaaggtgttgaatgttgtaaagctagattcaaactgagtataaaatttgtgtttctgatcgctagaaaaaatacaaactattagacataaactccttcagaaatttttcccaccacctcaaatcttctctgttcctacatctgtttcctcatttttcattcaaggctcattactgcatcccagtttagacccaaggtcagccctcaattattaagcccatggtactccacctctctccaggatttatcattcatcctgctttttttcaaatgtgatgaagaagaccaggaattacaaaaataaagaatgagtaaaagaagcccaacacaatggatgaagttgagtaggactctaggaagagctagagtaaaaactgatttgcttcaagcttttcttcaatgctggctcagtcttggcccacatgtaagtccttatattttaaaggagaaataagagattgataaaccttgtccttcaaaactataaaagaaatcagactttgaaaaccccacagtttaacacctcactcggttagaaaacagaggcaggtagaattacagtgctaaatttcatggtgatttaatgggtaagattaatactttacagctagcttgatgtttccttcatcagaaacaaaaaaattacttgtgaattgacctattcatttctaaaaatatttataaatttttaaaaagtgaatgtatatacagtaatattgattatatagcaataagcagagacttcaagaattacatatttccaaattattaatttcctcaattgtatttctaatgagacaattattaaaggatattatttttagatcaacagataatcaatcatatttgactttatttcatttactagacaagtaaatttaatcataaggaaattatgcaccataacttcaagagatgatgttttatgtcaatttttccatataatgaatttctgtctcattttctacttataaaagtagatgagggcgggctcgatgattcacgcctgcaatcctagcactttggtaggccaaggtgggcagattgcctgagctcaggagtttgagaccagcctaggcaacgtggtgaaaccccgtctctactaaaatacaaaaaaaattagccggcttggcggcatgcacctgtagtcccagccactggggacgctgaggaaagagaattgcttgaactcaggaggcggaggttgcagtgagcggagatcgcaccactgcactccagcctgggtgacaaagcgagactctatctcttaaaaaattaaaaaaaaaaaaagtagatgaaatagaaagtagtgtcaagttgatatatcaatagtatatatactaaaatactgaattatctccagtaatgaggttgtcacaaacagttataaagagagatcattggggaagttaagatacttctttggtttctagtcaaagcacagtacctagaacagagtcatcattcaaataattctgtatttccttcctctatctttgacttctttccatttcacatgtacctttactttcctattttagatactattttctcattgtgactactggaactatctcttaaacataccatcgctgcctttaatctcagttgcttcagttttcaaattgctgccatagtttcttttctaaaacacttaccctagcacttcactgtcctgctcaaaaagctccattcctttttccctgctgtgtcaaattcaaagccaaactcggcacaggtttctaaccaggaccaagctcatcttactgtctcatcacctgactgcccccacaaccactgtgttacattcttccacagtggatgctcaactttcttagaatgtgaatgctcttccctgtcttcaagctattattaaactgccttctctgtcatgaataccttttccacatctcgaccaccagaagaaatgtcactttctatttgtaacttaaattagatgtcacttgctctctgtgttgtaatctttaagcttcccttatgtagtttcttaatctcaaccttatactgtgtttgtaaatgctcatgcctctatcatatcacttatcaaattgaattattgttagtaacaggtttctgtacctccactgttaagctatgaaatttgacaactcacagaaccacattgtcttaatctgtgtattctcaattttaaaagacacagcactcttgtaaaaattaggtaccttagaagagaatcaataaaatatatgtaaaataaataaatgatttatgaaagataaacatgaacataaactaaagaaagacaataagaacactgataggcatctattttttttttcttgtaaagaacgcctttgactttaaaagattatgtagagaattcagacctggaagagaactcaaatattagatcattttagtataatctttccatttaaaagatgaagttgagaggcttggatgggctcgcaacacagaaaaatggcagaactaggggaaaaaaacctaggatcccaaatacacagtcaacaccattatatagtgttatgccaactttactgagagtcatacagcatatttgaaaaaacaaagacatttcttgtttatggacagaagagctaagtatgggaaaaacgttaattctttctgaataaatctgtattcaggcatgttataatcccagtagaaataactaggcagtattttctggaattttaatagtattttaaattttaattatgagagtaaatgagcaaaaataactagagtgattttatactatacaatatattgttggtgggttttagttaaaaacaaagtgaaattgtgatttgtttttttcaatgaattactgtaaatataattactgttaataattttcttagaatacctttctagaaataagaaaataagaatttgatatgtaccaagcaaatgatctccaaaaaaacaatgctgatcaatataatacattttagtaactataaatgtttaagtcttcataaatttgataaggggaaaacagtctctcattgatgaattggactttctttgattataagtgagacttaacatttttttcaaatgtttattaacatttacaagttttgtcaattgacctcttagagattgcatagtttatatcaattcatgtggctcttttaatgtttaggatattcatgttttgacacaacacccccccaatgaatccttataatttccgtttttgaattatgttcatgataatttgtaatatccaagtgttacatttttaaagaatcaaacatggcattttttaaaataatttcttttactgattttaaactttcccattcaaatcaaataaaccttcgcctacattttcttttattcttttgcttctttttcacataattctaaaataaatttcaaatggataatactttcttatgtggaaaaatcatctcagttgaatctactgtaaactcttaatcaataaaatgttatttcccagtgagttctaaaagccaccattatcatatgataaattcatatatatatatatatatatatatatatatacacacacacacacacacacacacaattgtagaattatttacttatttatcatcattctatgtttctgactatttctatttggtttcatttatcacatgtctattttggtactagtttcatactggattgattattgtagtttatcacatgtctattctggtattagtttcatactggattgattattgtagtttaacattatgcttaagtgttaaatgtttggtaggaatatttttccttaaaatcactctagttatttttgctcatttactctcataattaaaatttaaaatactattaaaattccagaaaatactccctagttattctactggaattataacatgcctgaatacagatttattcagaaagaattaatgtttttcccatacttagctcttctgtccataaacaagaaatgtctctccgttttttcaaatatgttgtatgtctctcagtaaagttgtcttcaaacaggttcaatttattccaaaatattttaaataatttttgccaaagaaaaaaagcgttccagttcccatgtattaacaatgacttcttaatactatgtagaaaagtcttaatgttctaatattaatgttacattttatctttctaatataattattgtcgagatcaaataatttgaaaatcatcatgaagtaatttttcccttatagtaataatctttgtcatttttgtttcatgtttatcacactggttaaaactgatagaatattaataatagtggcaataggtttgatccatctcttgataagagtaactataaatataaaatgttatagactgagaaagatgtgctttatcatgttaaatatttgttcgatttctagtttttttgttttgtatttgtaacataaattaggctaatatttttatcatatgactttacacaatcttatgaaatgtttattattgtcttatttgacctattagcatgattgtagtatattttctaatgttaaactataattattcctttcagatagcttaaaggtattttatgctaacaaatttccttcaaaatcagactatagtgttcagagactctcaaattgtatatttggaaattttgcattaactctttgaaatcaataaggtttctaaaggaaagaagatgctgataacttctatctatgtactggtctctacaatctaacaaacgtttccatattattcttggaatattgagcactgaaatatttagatcacaactcactgctgagtttagggaagctgctttcttcctcttggtgtcagataattcaaccccaatacaagggtttgcattacaaaattctgaagttgactcttctctccaattatcacagatccttcctgattcctgtctccctcaggctaacacaaactcatccacctaaagaagcaatgagattcagatacctagacatcacccctctctcaggtttccaactccctgcttaagctttccccataaggcacttacagaaactttctaaatgtcacctttttctatagggagtggtctgtgacaaccaagtttgtactacttcctcctgtacactgataatctggaacagatctgacatacaacctaagtttggctaatgagattcaagcttccaagaagctgacattgagacttaaaaaaaaaagttagttttaacaagtgtcttaaagaatagctaaaccctggaaatggagatcctctgctatcctgtgaacctagaagaagagaaaaccaatataaagagaaacagataaagcagacagacagaaagacagagatgctttttttttcttataggtttttatttcttaggaccagttctttctttagactcgtttctattcccgctatgcggtttcctgatgcacattcacaaattcttaatttcagcttaattaagcaagttttagttggtttctcaagttggttggttacatacaatcaaacaattcagattaatatgccactgtgcttgacctgccctgatatgagctcagctatagggcaagggagtagggaggtagctctgaaattctatccaacactttctttatgataaataaggttctcatagcaacagaaaaatctttgattctatacaagatgtacagaattaatattttattgcctatagatcagtctggagtaaggaattgacaagttcctaaaatatctaacctccttttctctatatttgttgataaatcttagggtttaaaaattatagaaataacattttgttcagatagcagcaataaaagtaaccctaaaaggaaagtctttgtttccttctggcttcccaagtagacagaagatgttaagaaaacttgtaaggaaaacatgagtaattctggatacactgtgattcagaatgtgcttaaaatacagatgcagaagatggttcaggtacctttttttcagtgattttaaaaaatcagtttcagtgattacattcaattaaaccaccattgtagcttatgtctttgatgccaattagtactctacagttcagcagtttgactgaatattccagctttagttagttattttttaatgaaataattctggcctgaaatactagtcatttatcactctaaattctaacatattctttgctttgtcaattaaatgatacactggaagaagcacaatcttttacatatctttaaaccattgcttaagtaagcataccacatacctggttacaatgtgagaaagattaaattttaagaaacaaacagttctctttatttttgtaccaactgtctgatgagcttccagtgctctggctacttcaccttctgctcctataaactggaagcagaatcttcctccacaccgataacgtggttttactatcccaaactaaaaaggagcatacaaagaaatgtatcctgatatctaattatgtcaaaaagaactaatttaacaacaattttatctatacaaaaattaaacattgggatagccactattcaattttaaatgggcattactaagtaattccatctaatgggtcaatttttttaattccttgagagtaccttttgtagctcactgatcctggcagacaatctagaaggccacactgtacaaacttggcagttgccttataaagctcattctttgacaactggcaatagctaggctaaaaaccttctaatatataatgttttttgttgtcgtgtatagtaagcagctctggttctagtcaagcacatctgggttcttcagaaaattaaaaattggtcctgagcaaaccttgttttggccaatggcctccttgcacttttggtgttagggaggtgggtcagctgtcccaccaggtgagaacactggctatcaccaacataatcaactcaactggtttccaattaacaacataacatagctgttttctaggttcctaacagctaacacaagctccaaaagtctacttccagctgctattaaatccctgcgaagagcaatgatatgtgtgtaagtctgcagattgtatgtgtgcttcatagagccactgggactcttcaaggtacttccgagaccagtaagcaggactaaggaagtggaccagccagggctatgccaatcccttaacagttcttgttttttaacagattgaaatgttagatttctgagtaggatatttttgaagatagagtcttaaaactagagtataagggagatgttcttcatttattcttcagagtatggtacatccccgtatcatcagggctcaaaagagttatacatctaaatcaaggatgattatcttcctcctccttggaaacatctttaatgaaatatactatactttcagtgttataagagttacatcatttcttaactttgattgtgggtacaaatgcaaaacagccagagaagacttctgcttttgctgtaaaattttgtaaaataacattgctcatttggctgtcaaagtcgcatatgacacctttcttttggaaataatttccaagaaaatgtgttctctcttgaaaaataggtaagcttgcttctatcatataatgaaaattataaatcacattgtcggtccctttatgctttgactgcttaagaagctcaaaagttaatgatttcatcctttattctgcttaccatatttgtttcttcctcctttagtagttttgatggtgtacttttatttgaacagctttgtgtgtcatttttatcataaacagaatgaacatgaatacataagtcaataataaaattaaaatgtgatgaatatcctggaaatcactgaaaatcaacagaattatgtattctatgatcatttgcttatcttcaggtctcttatcctgtattatcagctactggaacacaaccaagactcaagcccagcaaaatcaatctccaaagagctcaaagagattgtcttttaagttcatatactaagatttatttattttccataaccctcatctgagctatatgttgccttatatcagacacagcacagttctattatgctccaataggttcttgttgctttcgagatgaagaacaaaccttaataatggcctataagacctcacatggtattcatggcctggcctattgccctacccttatctcagacacctactcccttcagatttcatctgttcctaaatccctatattagggaaatgtccactattataaactctaaatccagaatatctcccttttcagcactcattgcagattacataattatatttttgtgtgcttatttgattaatacctaagttctccaggaaactcgaagtgccatgaatgttttgtctatgttccccagtaaagtatcgtcagcacctgtcctaaaaacaagcacagcaacagcagcagcaacactttgataatgtaaaaaaaaaaaaaaaaaaaaaaaagtggacagaactcaaagattattggagtctagaggcaaatccttttaatagccattacattaagatattctttaacagtctttaatagtatcattatattacaggatggtataataattataataattgaagtcatcaaggaagggttaggttttgatcatggttaagatgaaagacaaattagtaatttgcctttaaaatgctttctttagtgcttctttaaaagacttccctgtcttctggaggtgagcttcagttctatggaaacttcactcatctgcattattcttcccacttcttaactagcaatattagataaaggaagtgttccccaacctcaggttatggtaaacaaccttgtattgcaacattcctcttttgatcaatttcataattgcataaaaattattttcaaactcctgttagtgttcatattcccaacaaaaagattaatgttatgtaatgtttcacaaatattctgccacagacgatgtgtgttgaatttaaaccaaattctgtcttaggttgcctttaaaggaaaaatgcaaaaaaaaaaaaaataaagaagaagtttccacttgaattctaaattgaagatgacctcgtgcttttctgagaaacgctggcaactgaggtcactggagtgtgttatgatagacggtgcagtgctgtgcgtgtctcaaggcatgtccattgtatggattaaagccaaaccaaaagtattagacagctcagagcattctatcatttcatttgaaaataatgatcaaagtcatgggcaacaaccattgcaactctcatgaaagaacagcagcattcaataattccatcacttcagacaggcagttgggctattttcaatcaaatactgtgaatccagtatattctgtatcagtttctcgtggcagtcacagaaacaacatttctgcttttacagtataaaaatcctgcctacattgtgtgcatccctttgcttccgaaggactgagtcattgagaaaaatataaggaaacagaaaacacagaaacttaacactcgttgagtataaatatacagcaactccaagtcatccattttcttcaagtcaacctactgtttcaaaagcttaaaatcagtttcaaaacaaaatgtctacaatctcttctctaataatgacatgaacaaaacattttcaaagaaatctaatgtcaatggtttcaaataagccttctaagtgatctcttcaatagtgatatttaagtaaaacattttgattgacagaggcttattttaaacttttgcctccttcacgcatagattaatggtagcataaaaaatatgtttgagattcaaaagcaggtggaaaaactcacacttctaatcaaagaagagaactgcttctaatcctgtgttttccactctgcctgggtatcttctatatataggaggaaaaacacaccctgtcgcttttaatgtatttagacacacacacgttgtaacttaccattaaaatttacagcccgaatataaccaagtagctctttcccatcaatggtactcattcgtggacaaaggccaatgtatccagggcagagatctttgtgcatattgtgcagggcgtaagccatggaatatacagcatcaattacaaattggacctttccttcctgttcataagatgaatcccgagcaattcgctccagccctgcaaaataaaaaagtaaaaaccatcagttgatgttagattccaataaaagacagcattagagctaagatttccatcatttgaggaacacttaatgagacacgactatttgatttcacttctgattaattctatacttactgagtcaggtttttaaactggatattaagtttatttggaaagagtaaaactatttcattagcaacaaaaagatataaagtaaataaaagatgtatagtttcattatcttttttccaccttattgagtcctattatattgtgcattctagtaattacataacattttggtagtggcttgatcttttaagtaaaatgtgcagtgtgtgattcttgccatctgtctcagctccaggagtgtcatttattagtggcccaaagtaaggtctttcaccacctaccaaatcagttctaattttgaatgtgctccatttgggagcctttttgtaacttttatatgacaatactcccttaagtgaccctggttatctttataataatcattcaatttgttttctttttgaactcaattttctatttagaatttctgttaaaaagatgtagatacctcaaaatgaatgtcattcagaataaatgtacctgtgtttgggcatatttagggctgctcattggcactggagattacttttaggttggtgtttataatttaatatggaaaagaaatatattttaaatgaaatataaatgagagatcaactatgatccaacattatcattttgaaagcgaggaaactaagactcatggagattataattacatggggtacatggggtacatagggcaggtgtgggaagcattcgtaggtctcagactgcaagcccaatattctctcaatccccagaaaaatttggtagatggcaagaatgttgggcatacaagaaaaaattatgaaagggacatcaagagtttattaagggaacaaaaaatgatctcctgtcacttctacatccctcaccaacccttacacaactggtaacacttagacaaaagcaagtattttaaactttccatggatgttactaaccttgaataaattgtatttaaattcaacaaatatttgttttctgaacatcaatgcatataacctacatatttagagagtcgaattaacgtggtttatatttgtatatttacactctgaaaaactagtttttttctaaacaaaaatagtggtcagtttatttatttttattcatcgaattattgtttttgttcttcctctggtcttaatcacttgtgacactctgtgcttttagatgctcttggttggtattctggtctctgtggtctgtcatgatgctgaattctgctcctccctgtttggcataggttttccgattttctcatgtctcaacttttcattctccaaggctgagtttcttcatccccaacctcagaatctgctaattgtcaattttgtcaactactaaaatttctacagtctagaaatataaatcggactataaaatgttgactacagaatccagaacattagatcaatttataataatcagtttacttcattttggaagttagctttttggaaaattagttttctaaacctttcttgccatctaactgctatcgtcccatatttccaatggcctaccatatctctacgtagtctgctgcttccatatcaaacaatatatgtaaaacaaggctatctctgcaggggattccctaaaatatcctactgaaagttttgcaagtttgcgagcacaaagagacagggaagattacttctcaaaagttatattgtctccttcaacctaccccttagctgcatgatctaagctaagatccacaagacatggggactatgttctctccctatccctaggttatacttttgtctcctgagtcttagaacaacactgcttgttcccagaatcattcatcaagtttcctgtgaaaacaaccctttccacttctgcctaaaatttctctcccatggctttaaccacaaagtagatcattcataagtaaatactgaaggatggttacagcaaccaaatagacgctgttatttccgtatagattctagtctggtaactatcccctcttgtttagtccaggactgaagggcttctcaggacctaggaccaaaacctgaagagcccccggaaaaccaggatggttgcttatgaacaaagaggcaagtgacgaggaaatttcagagagaagactgaataacaactttgaggatcagtccctaggtctggatggatatccctgtgtttcatttattttgcatcgctgaacttgataacggaaaataaagacagtgaggttcagggcagttgtttccacacttgggtctctccttaagtacagatttctcagcaccaccccagacttgctgggtcagaatctccctacttgggacatgaaggatctgtcatttcaacaactcgccaagagattctggtgcaaccagctgagtctgtgggccagctttaggaaatttctgctcttccatacagcaatcctcaaaaataccactatagatctattgtttagagaattttatggtattgaagtatgaaaataaaaataattctttcatgatatgcacaccccgaagaaaatctaatcaaattcttccccttttctcactagatgaagagtcaaagaacacaattcccaatatttacgcatttcaaagcttccaccatgtccttagacacacagggaggcctggagctgatgacaagggtagaagccagaaagacacgaaagatctgcaaataagaaagaatttcccatttctcaggatagagttcagttttctaagttaaaatgtcagagggctaatttaattgtcctgaaattaggcatataaaacttctaacatcaatgcaatgatggcccaataagcaggaattgaatgtgttcctcctgagagggtggaaacagaaaatagaaagcagtaggaagaaaaagatacagagaggagggaaaggaggatgcagcaacacagagaaaggcttgagcccaaggtacaataatggcagagggaaatctaacgttccaggttgtttgtattgctgctctctaaacaactctgctgcagacacatacaaacacacacacacacccctcacatacctcttctgtaaatattatttgtttttaatctaattattttttattttgtgggctttaaagaaaagggaggacttccatgtttccattactgcagggtggtgaagggtggagagtggacacagaactggcagaaaatgcctaagccaaatggcttcaaatgaagcaatgaccacaagagcattaaggaatttggaaattttttacaacccatggaattcatgtaacagctagacatgtgtgaatgttttatagtttcaaacttactctatcctaaaatgttcttgatttaatatattatcattttagtgccagtgcaacctcaatttaatatattatcattttattttatatattatcattgtattttaatgccagtgcaaactccctgtcaatttataaagatactcctcagcattcaataatttcctgataaattataatcgacatgctccaatttaatacatatactcttcctcagcatttcttaaaaaataaacagcctggtgtggtggctcacagctgtaatcccaacatttcgaaaggctgaggtgggaggattgcttgatgtcaggagttcaagaccagcctgggcagcagagtgagaccctgtccctaccaaaaaataaaactaaaaattcaactttatatccaataggtctaaatgaacaatcaaatacacataatcttattaaagaaacatatttaaaattgtactattcaaattattcattttcttttctagttataaactccaattattttgactgttgattaaacatattcaactttgtacatttttgttcttttaaagagttcagaagtctgcctagtaactggtgccacatgtgaatcaatgaacactgtaagaatctccccataaatcaacataagcatatggtgacaaactgaaagactgaatactattaccatttctaaacttaaaagtggatcatttgatttcttttcaggctgtttagacaatgtatttttctgttccttaacacttcaacctcatgatgacacttaagattttacagcagctagaatttgctcctcacttcctatatttgattctctcattcatctaaaagaggagtttaggaagctgacagtgactcatcaacctaattggctgtaaaatttcattatgctatagtttctaaagttagtgttaacgtattgctataaagtgctaaatatcgtcaaaggctttatgtcagctaaccattttaaatatcaccgattgtaaagttgtgatgtgttttagtgtatagcttaaaattaacaacatatagcaaagtgttttcatggtgagagaggaagtcagcctcctaaattttatgggaagattgttttacatcttcattaatgaaatctaaatcttgtgactggatctcaagttcctggaaaataataaattcttactggtctaagaaatatcacacatactttagttaaggtctttcacactttgtggtatatattcttgggttttgttccttttcagtaaaaaaggcaaattgacttaagttggcaaaacattgtatatgttacaatgtaagttcctaaggtgagcctaagagaaatttcagactttgatgcattgtggttgcaaagcattgctttctaagaatttcccatttctcaggataaagttcagttttttaagttaaaatgtcagaggactaatttaattgtcctgaaattaggcatataaaacttctaatatcaatgcaatgatggtccaataagcagttggtcaattcaagtaaaaaacaaatggaagtcataccagttgcttaattctggggaaatcaaacatccaattggttgcctttttcttacaaccatctcagcttggagtataaataatcccacaatctaaatttgtagattaagaagtattttttaaagtttctccctgaatttttctgaattatgaagcaactattttaaataattaagtcagtttcttggagttgctctggagagaatggtagaggaagaagggaatttgtgaacctgctatgaataaatacatttatgcatctaggcccagatttagaagtcattctgaatttcacaggagcttctctgcctattgataaccaggaataagactgtcatgctttacattgtgcttttcccaatgtgacacagatatattgttactgcatagtgcagtgacttttaaatccatgagaaccatgccaagaaccacatcacacactaaagagtgagcgctatcaagctgacaaataggtttttttttttttttttttttttttttttactaaatttaaactgatttgggttccaggatacaatagggggaacataaggtagaaatacaagcatgttcaattatacaggaatatctccagagcactaggatccacacatgaaagtgtgcacctcccatactgaagacagatgaaaatatgaaccctgagatgagacagaaaggcaaactgactgatagaagcagctggctaggggagagagaggatcagtcaggtagatctggatccaggtcccagctggacagcttagaaggcgagtggccttggacaccttcctgaaccatgtcactaatcctgggccttcagctggcattgccactcttagggacctctgtaatggggttcctcatccctccagcttcatctgctgcaccacacacctctctgctccactcttaggtccttgaatattacataagatctccaaatgcaggcctttattcagctgttcactctcttcattccttgcctagatgtttccaagcctcaggggagatgtcacctcaaatttgttaatatttaatgattttcttcccaaacttcgcctagattagatcatcgagcatcttaaatactaggcttaaatactgaatattgttcacttgaaatggagaactatgatcaatatttaaaattattgctgagaataatgtgtaaaatcaattgaagcaagcataggttgaaggtagagataagttgggaggcaggttatgcagaaagtggaaacaggataacccagggaagtgaaaacaaaggaatgagagaaaatatgttttagaggccaaattgacagaatctaactatctgattaaatatggcagtaaatgtcaggaggcaatgaacaactcagggttctgatgctaggtagtagaaaattggcaccatgaacagtttgaaaaatcaggtgaagatttggttaatgatatctccccaagggcatcaagacctcaattaaaaggactgatttttaatgttctgtgctatttattatatcctctaacagagtatagactttatatagatgtttaattattaaaagaataaaaggcccaaatgtttagagtaatcacataccaataacgtggttgatcatttatttgcaacactggcataatcaaagaagctacgttggagtagagcaccttatgcaatgttgcagtaaaaccaacggcctgagaagccagacttgcattctggttctaacaccacaaccaattaactttgtggccttgggcaaaacatgatctctctggcttttggttacttctcagtaaaaattagagaactgaacaagatgctctgtcagggcccctccagctctgaaattctggattctaaggcatgttctcttatttctaactgcttcctccttatactttctaagatcccttgaagattatttaagtaatcttcaagtaagtgtgacagaacaaataccactaaacccaattctccacaacagtatgaagtatcctgtaactgggctactgctgagacctggaaattctgcactaacaaaaataccaaatgtcaacctggattaattttttcccgcattcagagttttggttcactgtgtcaccatatttccattattcttagacttagagccattgaacaaatctggttcctcaaaaaagagaagattttaggtctcttctttttctgatatgctggctaaatgaatcaattatggaaaataaggtcagagaagtgaaagggaagagggaggatacaaataattaaaatggtaagagtacttcacaaatagtatccctttaattctaaattattactactcctcttgtacaaatagaagaactgagattcaaaaagtcaaataacttacccaacattgcaaagtaatggcagtaaacggcaatttaaaatcaggtctacgtgactcaaaacctctgccattaccgctattccttctcctctgtgaaatttcctttgattcttccagttcaggtttatcttttgcttctccaaattccccttttacttacacccaccagaccaatgattagcttgtctcttaaattaactgtaaatgcaggttctctacatgtaatgtgttcatgcacttgtgttaatctttaaagacaatagtgtagtaggagtcaaaaaatattataaaatataaacttttacagaaatactgacaataagtattaacaaatactaacagaaatgccaatacttatattgaactacacttaaaaaggaaaaaagtttctataacattttaagcatttttctgaactgttaaacaaacaaaaaaaacttcttatgaatttcagccatccacttatggaaaagttgtcataaaatggctgaaattcccaagcaaaaggactggacatttgtgataaagaccaacgctaataaagcttatacatttatctttataaaaatgactaaagtattttagtcttggaaggtggtgtgtctgagtctatgcctttatatgatttttcttaaaatataacatcaaactcaaaagagaatttcacacccaaggttctgctttgtggattcttcagctggctctgtcaaggacctgtagagacagatgtattggactaatgaagtaatttgagccactaccttatctatttacaaagggcagagaaaattagaagacaagggtcctttgctgaaaatcacctgctatcttcttctgtaatttaaatgtagcagcaagaactgaaggctcttagctgcctgaggacacatgaggagacacttgtaaatcaaccactgaagagctctagatcagttcacaataacatctctcctttgtgcctggcaggaaatagaaagtgcttcaggcaggtgccaggtgtccccttcaggtattaaaaatttccatgcaatgccctagagtttcgaaaacactgaaaaacctaaggtaagtggcaaataagattaagagtgtatcttcaggcaaaacaaccagtttaaaagaaagactttcagaaaagcaaattatttcatagatatatccctaagtccctgaacaaagaaaagcctgtttgattaaattcaattatttgcatttttctacataattatcttagatcatacacatgagagacaaattttgatttaaaataatttataaaacttgatatatcatagttaatgtttctcttttttaaggcatattaaagacactcctcctcatacaattcaaatttgggcctggaaattcccacttcagcagaaaggacttctaatgctacccccacccccaatatgttacagtcatttcagaccctatgacttggctcaggatttaccttttaaaaatacagtctattttttaaattacaaaagtaatacatattaatactagaaatatggaaaataaaagtgtagaaagaagaaaataaaaaaaaatctattagcctcccagcttaatgaccatttgtatattggtgtggcgtcttacatttctttctttgcctctttatttttaaacattaaagtgatatactctttttaatatgctctattcacttcatctataatgagaattcccctatattatagaaaagcatggttttttatcttgtccttaatctttcattaagattcttatctaatatttaatcattcaacagattaatatttttgcaattaattcttttgttatattcaatgtgatatttgggttgagataaggatcataagtttttcattttccaaattgtgaaccaattctcccagtgttatttattacatgtatattcatttcccaaataatttatataacattatttttaacatatcagatttttatatattcttgaacacctctctggattttctgccctaggccatttttctcttaatatgccaatgctacatttttatgattattatgtgtttatgttataccattggttcattctgtactctatcatactcttttgaaaaatttctgattagtctaatagtctttataactaattaaaccagttcaaaaagttagaacttttattagtcatatcaatttttaaaattaattatgaaagacataacatagctacaatactaagcctccatttgctaacatagagtctgtttattcaaatcttctttaggaatccttaataaagatatgtcacttgcacatttatttttaagttaattcttcaatattttatgttttgtagctttataaaatgatttattttcattaactggtataatttataaatttctatttatttttaatactcaacgtttttctctcatttaaattctacacatcctagcaagcccagattaagtcctacctcttctacacaacacggaaaaatataaaatagcatgggttttgagaccagattaagattttaggctctgcctccaagtctctgaattcttcactcataaaataggaatttatgacctatgttgcatggctgctgtgaggattaaatgagacaatgtaaggcatctggcaccttatgtagtaaataaatgaacatcactatttgatatgtgaggctataaaatacttaaccttctataacatacaacactttttcaattatacaaatgaaagagattacaacagaaagttaaactcagtatatattcatatattcaattactaagcatgagaaaggtaatttagttctgtgattgagaccaaccaccctgcttccgatctgcctaggttcaaatctcaataccaccatttactagttatgagctttgagtaagccctttaacctcctatgcaccttatctgtaaaatggggataacaataatatctcccccatagggttgttgtcataattaaatgagttagtatatatattagacaattaaatgagttagtatatacattaggcagtcagaagagtgttgaaaagaataggcactacataagatgatattattattatctttattattatcattcactgagcttgtgtgatatactaagcagtgaggaggatacaatggtaaacaaaaactgacctactccttgctgtcacagagtgacactgggactacgatctgaaagataaatgggagtgaattaggtgggcaagggaagtagaggggagcacaggatgacagcagtggcaaaagcccattgatgggggcagcagaagagtacaaggagtgaggctcagccagtgaggcttagcaggggaagaaggagggaggcacaggtgaggcctgacgggggcagggccagattatggaacaatgcaaatgaccgggagtctatctgtcttctttctgtaaaagcagagggaagccatcaaaaggtaacataaccagatttccagttctaaaagagcactgagtcaagagaacagataggaaggaggaaagagtaaatggagtaggcagattgggaggtgattttatagttcagaaaggagcatacggtgtcatgggctaaggtggtgatgaaagtgaagaaatgtgattgcactagagacaaaacaggattaaaaacaacaggatttggatatgggcaccatagcaaagagtggtacccaagggtgacttctaggttctcggcttaagtatctggacagatgccagtgctgctcaattagatgggcaacagtgtctaggacagaaatagcatgtcctgccagccagataactgcacatttacctaatgcatggtcaacatagtgagtttgttcctgttatgacaggtcaggggaatcccactagcctgcacctcctaaaaattgtatactcacttgccactctgagaatgtaacctgccttatttgtaggatatgtccaagttcaaggttccaacactgcgttatcattatttttattacttacaatctccctaggttataaattccaacccaggaacagagaaagagatggcatcagaattgttttcaagaatgtgtcatcattcaacactgacttcaatcattctatttgcaagttactaatagtactctctcaggtattcccttttaaacaaaaagctgaatagtcaatgtgatgacctgctttaaatataaacatagaaaagtaaaacatttcccctttccattatctttttaagattttgtcaacaatgaagtattatcacgggaacacatgttataacaccttaaacctgtaattaatagaaatgcttatgttaaaataatctcatcctatctgctttttctaaaaaattttatttatttatttgtttattttgagacagggtctcactctgtcacccagactggagtgcagtggtgtgatcaaggctcactgtagccttgacctcctgggctcaggacatcatcctatttcagcctcccaagtagaatggaccatgggcatgagccaccacgaccagctaatttttaaattttttgtagagatggggtctcctcatatttcccaggctggttttaaactcctggcctcaagcaatcttcccatcttggcctctcagtgttggaattataggcatgagccactgcacccagccatatctgcttttttctaagctatcatgacctattagtgataataaaatcaatgtagttggtcacacacagcgtatttccaaaataaagaaaacatgtagaaatcaagttcattgcaaatagtaacaggaagtattgtttcttgagtctttatttcagttgagaggtgggtttgtatactgtattgccataaacaatatattattaatctggagtgaagtaaaaaaaaatttgaaactcattaacctagtccaattctagtattccacaaaggtgaaactgagacagaggaactgagtgatttttttccaggtctgataacctgtgaagaggcacagccaggaatagaaccctaatcacttaattccatgactcttgttttatatcatgtctcttttcagcttcattttctctcccattgtaattaagttctattgaggataactaaaacttaaggaaatcactgaatgagtttgcccatgaggaattaaaagcattgaaggaataatgaagtatgaaaataaatgaataacaagaaagtatgagtaatgggcaggttctctcttactccaaagggaaactatcagtgaaaaccaacaacaaagaaccacagcttttggttttgaaaaccaaaaaaatctaaacacaaacgattttataacagaaacttaaatttgtaaataaaggcccataagtgcctgaagtttatgatgcatatcctttaagtgaaaattttagggtgtctgtgtgtattattggaccacccaaatgaaaaatgaaaacaattcttgcctctgtacaatgcagtcaatcctctggatgactgactaggtctttcacttttcttcccaattttaggggtcacagcacaggcataggtatagtgccagtggctgattaaagcaggtcgcaatctgtctgggagagtttctgtgccattcttcatagggacagggaccagacaagatgacctcccttgctgccttccaattaattcaatcagcctctgcttctatcagacatcttcagggatgcaaactgtatactcgctccaagtcctcaccaggaatcagtaaacacagaggctgcagactgtgtttaatgaataagcaggattcatcttccagtcatcatttttatttacagcttgtttccaggtattattttctcccccaatgatctaaaatccctatggaagactggggccggatctaacttctctgagctcctgctggggctaatctggtacccaaatacatcttaggttaatatcaatgttgttaaaccaacctaacctgaatttctttctcaagaaggatgtataagtaagataatcccaattagctctccataaatctttttgctttaatattctgtgaagagccactctaggaaactattatgagatacagtaaagtacagtaaggaaaacattgtcaaacaaactaaatctataccttctatttctgaaggcatatatttagtgagccactgcacctagccctacctgcttttttctaagcttcatataggccatggcctattagtgataataaaatcaatgtggttggtcacaaacagtgtatttccaaaataaagaaaacatgtagaaatcaagttcattgcaaatagtaacaaattgaacactgcaaatgttcaaataaatatacataaaaggtagagttggtatggggtgtctgctttttgtttctcttcacatggactggcaggataatttccataatagaggaaatagatcatctgagactaactatattagacaatgttggtacaacagatccaagatgaggtaagtgctcacatgacagctcatttcaaacccctcataaatcaggaacctgtggctatatttcaacacttcctatacaatcaataaaacatcagtgttcattaggcagacctcatctatagcctcagatcaaaaactgtggcttttgactacaaacctaccttacaataagaagggagtgaatttaacacatctttcctttaaaagaaaataatctaatataaaatgtgatgtccttcaacattacatataagctaattatagcacatggtttgtgtgagctttagtgggctgcatcaggacctggaaaacattccaaaactgaagtggaattttggcccagtaagaactgaatcactaaggaacaaaccctggtttcaccttgagagataatgcatgacctattaaatctctcattattacccttgtgtacaaaaacaaaaaaaaattgaaaacagtttcatctttaaactttcaatgcatgcacatgcaaaaaaagaattaaaaatattttcatctttaaactttcgttgcatgctttgaatatcaaaacatattttgtgagaaaaattataaatagaaatttgataaatttagaaccaatgtgaaaatcatagcctgagatgcactttaaacttatttctaacaaatctgcttttctcagtgatttatttttgctccccaaattatggtactggcaccaaggacttggagagaaaacaggtatgataaagagaacatttaaacataatggcacaaatgtacacacgttcctaaatagccttcttcacagaagctgaaaggggaagacctaaccatttattgggatctattatgagcctaccaccatgctagacaagttggacagattgttacataatgcttgtaatcactctatgaggcaagtattattattaccgttttttaggaaaactgaagctcaggttaaataacctgcccattattatagatttagtaagtgataagccaagaatcccaactctgcctgtctattcaaagtgatctaactctttttattacagctcaggtctaaacaataaagaacatgcccacgtacagtgtaatgaatttagatgaagatataaacgtgttaccagatcctaggaaagaccagtttcaactaacactagtactgtaagcacatagtaaccatttggcctttgactttttatcacaagcttgcgttcagcttctatatgaggtgacttttccaggctggagtgtagtagctactcacaggcatgatcatagcacaccacagccgtggactcctgggctcaagcaatcctcttgcctcagcctctcaagtaactaagactataggtgaatgccactgtgcctggcttaatgtgtcattttctaatatgtgagttttctaatagtcttccaatacttttaggaacaagacagactcgggtattggagtaatctggtaaaacaccctctttcggtcaagctctttagaagagcctttatgcttctacttccttattgcaatgcacatcttggctgctgcaatttgacttctatcccaaccacacaccaatgctacctaggcagacaccattagttgtacttcataccaattcaccacttcttacatggtattagaacccacgatttttaggaaggcatgacttggtcagaataaagactttatttttccagcctcctttgcagccaaatttagctgctgccaataggatgtaggcaaatgtacagtatggtaatttttaggaacctttcttaaaagacccgggtcttttaagacccaggtctttcgcttctttatcctttttcatcctgttctccatcctgccacctaaatggcagatgaaatcactggagctctacctgtcacctggaaccaggaggaattagagccacaacgtggagatagcagagtaataaactagaaggagcctaggtcactacagcctgggtaaagcagtgccgctgcacccttcctgcaccacctcctctagattttaccagacacaaaaatgaggttttatctcatttaaacaaatgttatttccactctctgttacttttagctggacacaatcttatatgatatataactatgatctccttgtgtctaaacccaaggacactaaacatactccaccacattttgacttttaattttaccagtcttttgaggttttctggagcactaggaaaaccataaaatttataagagaaatctctcctcttataactctgttatctatggcaaataacaacctcttttgctttcactgtctccatctgttgtgaaagagagaataatgacctcctacttcaaagtgttgtaaggaatcaatcaaataaaaactacaatttctagttttcttgtgccccttttcacaggacacaagtcacttaagattcaaaatttttacatttgactttaaaatacctatttacctgagtacctcttttctagtttcacctactcaccaaattaacgaactttttaatgaaccaattactgtttacaaaataaacaaggaaaaaataaaagcctttaaaggtattctgttatttgttgtttctaaattcatcttgctttcctatctaattttaagacaattttgttaatggttcacaagggcagggatcatgtttattttcattcatcattttatttccagtgcacatggtaacatctcaaaaaatgtgagtgtcctctatcccaaccttctatgtctgccattcctgcagtgaggggtcatttccactgccatgttacaaaaagttataagtagatttatgtcctacctgtacaggccacctcatggcatccccttgtcctttatttttagtacaattctataacctatcatgttccttaataagaactagttgttctactctatattcttatactccaataatattataaattaataagacaaattcaaaagttctcaaaagttattatagttaccatgtatgaactttttgtccatcagctggatgtgccaatctaatttagaagatctgattaatctgacaaagcgtttctgaactgtatgactgttttactcttagttaagttcacagagttattttcagcatcatattgttttcattttgcaaatgtttttctgggtcacaatgctggctcttttctgcacccatgtgtagtacacatctaacctagtaatgagggaggctaaattagtctccagtgcttcttgcttttgcagttctagatcattatctcctctaaatagccatccttctttctccacatctctgcccaacaagtgcccaataccatcaaaagaaactgcttcacacagaaatattaatgactgataatgcccgggtgtgaccactctgagtgcattttgtcaacatgttatcacttctggaatttatgtcaccaacaagtttcatgtgtgtgacaatcaacaaatttagatggccatttatttcaactatcccaaagtcccctttctcagatttctgggagtcaacaaaaagaggggagggagtaataataattccaactaaatcctatagtgttacttttgttatcaaagtagcaaaggcctactttccttttgatactagtcatttgaaattaaatatgaaaactcatttacccttaaaacaacttgctatgtattactctattaatgaaaagtctttcttcaaaagtacaaatcttctattataaaatacatgtgaaaaatattattaaatcaattctttctcaacctatgagaaaacattctcaaacttcctcttttcctattatatttacaaagtattttctattctccttgatcacttttccaaatagcatcccattttatttatttatttgctgttatgtttctgttctttcttacttcttcataaccttctcttgccctgacttgctgtggtcgatatcttttttttatttctatttctggatattcaatatcatcttacatatttgtagatcatcatgcctcaatatgaaaattcattaactagggtaaattctactgaaatgtaatttttagttaatttcactaatattcagagaaattcctaaaactttccgtttgtgatccgtttcattctcttagacaaaaaatatcacctaaaaattaaatatatcacaaatggctaaaggggaaaatctccatctaattatttctatttgaaagtaccacattaaaaaatgcaactcctttattttcctcagtgaatctttgatgaaatccaacaaaaatgatgagttacctgaaaaatgtagatttctatcattaaaacaatctggccggtgcgatggctcatgcttgtaatcccagcactttgggaggccaaggagggaggattacctgaggtcaggattttgagaccagtctagccaacatgtcaaaaccccatctctaataaaaatacaaaaattagctgggcctggtggtgggcacctgtaaacccagctactcgagaggctgagacaggagaattgcttgaacccagcaagtgaaggttgcagtgagccgagagtataccactgcactttagcctgggtatcagagcaagactccatctcaaaaaaaaaaaaaaccctttcagatatctttaacatttatgccttgttcactcaaaattgtatgtgctttttaacacctcccatcctacttatactacatcttctttatattttctttttttcagagtcactcaaatatctcctatgccctagaatgtgattcttcccccatcttttgaaatggtaaaataaaatacaattgtgttaaatgacatgaagaatgaattctgtttcctctacaaatggactctatcataactttatagttgaacatacaattagcagcaaaccacgagagcgtttaattagacctagactctaggagttgagttcacagattgtgcctatgagaaagcaattagaggtagatctggtcagttaaaaaaaaaaaaacctcagagacagaaaaaaaaaaaggtccattgttttgtcttcagctgatgtaaattcagccttaatgaaagataagctattttcacagagaatagatttttcatattgctcagagtgtatttgaaatcttataacatatggcattctaactttgatatgactttttctgagctacctctatattatcaaggaagagaaaggagaaatagagcaaatagcaaagaccatatcaaacatatcacaaatgactatagacaggaaagcaagatggtttttcttagcatagacttaatttgtctacagtatgatacataacatgcaataagataatcactataaacatcttatgtatattacacttattttgcatttcctgcttgccagaagccatactgaaatccaagatacactaataatgttcaaaagactaaccaaaaaaaaacacacaatgaagcacaatacagagtaattactattctgtggaaagaacaacaaaggcatttttttttcctgtagctgtaatcagtttataattatggcccagcaaacaaggcaacacataaagaaacagtaagaaactcctcctcagcttccatgttataaatttatggtatcttaaagctttttatctttgctgccccgacagacgacagggactccacaattcttaggtgactgttgccttcatcagtaccagcatccataggtacaggttaatgttccacagccgctaatttatttttttaaatgttaaaaccccatagagcatgacaaataacacaggtttaaaatataaacatctaaaactcagcaacaggagaaagtagcttcttatttgccagtgacaaataacaagcctgcagaaatacgaaaaatgctctccaaaaaatatatggatattatctgataatggtgacttggtaaaaattatttcattctagtaaaatagaaagtgcaagttgctttttgctactccatccatttatgttttccattaagttcctttctatagaaggtttgctatataagttatgtcgtatattctcaggtatagatatatctggaaaaggagaacaacaaagactctcttaattttttcagagttgaatccctaaactgttttccaactggcatgttgtactatgaaatccaactattttatttgcttaattccagaactggtctctatgtgagaacacattctctctctcttttttttttttggacagagtttcgctcttgtcgcccaggctggagtgcaatggcacaatctcggctcactgcaacctctgccccacaggttcaaatgattctcctgcctcagcctcctgaggagctgggattacaggcgtgcaccacaatgctcagctaatttttgtatttttagtagaaacagggtttcaccatgttgcccaggctggtctcaaagttctgggctcaagtggtccacccgcctcagcctcccgaagtgctggaattacaggcatgagccaccacaagtggccaagaacacattcttaatgacattgttaaagatattctgctttttaaaaaatgcataatactagcataagtttgtattgcaattttctgtcatttgataaatatagagataactctactgcccaagaagtttaccttcatgtagcttcataaagatgcaatagataatacacccatccacaccaacattttaaattaaatgtcaggaattttgttttgtatttgtaattattcatgtcactgcattagccattgtattagcattttatttaaaagtttactttttttcattaaggattatgattgtaagtcctagaggtgaatccgctttgttttcttacggtcgtgccaaggcagtcagagggtgaagaagtttttgccaagtcagagaccagccctggagccagggctgcacttatgatagcaggaacatatgataaaatcaatccagagtccaaacaagtgaaggtgaatgaggaagggcagcagcgatgctccgtaaagtgtggatgcagacagtaatgcctggtgactgggtcggtgagaatccagggctctgggtaggatgacttggcatgaatgtcagaaggtgccaactgctctactagactgaagaatgggagtcagatgtctttcctgcggggcagttggtaggaaatttcagatcctcattaactctttgataccaccagggggccatttgataaatgacagtgccagtgttctaaatggagtctaagcatctgttggaataaatgtacatcctaaagtgcctagcttatgaatagagtgtcactcccacccagacaatgtgcaataatgacttgtacatctcatacatgcagttattacaccagggagagagacagggacctattcaggcatagcacacagttcttaagaatattacattactacatttttttaaaaaacacttaatttgagatgtcatgcttagataattgatatatcttctcttgctactagcattctttgcctttattttgtgacttgctttcacaacacagaccttctttcagagttactataatctttctaccttctgcactattttcatattttaaatgcaaagcattgtctacattgtcttatatgaggcagctttcccagactggattttctgtaaagtcctgctgtaaccaggtaggctgccaacttgaggtagtgactcacactctgggttctgcacacattcaaccacagagtagagaaggaggcattctctctttcccttgcttaggaaatctgaaggggaaactgacttgtaatgtctattgcaagtgcaacaggactgtgttcaaaagcataggccttaaatgatctttcaaagtaatttgctcatagtcattattttgttgccatcaggtgaagaaatagctcttggtcacagcttgtgggtaaaagaaccatagaggtggttaactggattccattttttaaaaatgcaaccctaaaacagataaacatcaattttaatcaggctattaatctctatactgaaactggacatgtacttgcagtgaaacaggtttctcggaaagatggagaaatggagacagatacaccaaacaggcacacctgagcactctgtgttcctcagtgagaacgtgggcttactgatgctgagtttgcttctgaaatcaggagtgcctggtatttggaaacatcctttcaatggaaggtcacagattataagtgatatggtttcagagtggtgattttaaatgcttgtggtacatgcaaaatgctgctgttatcccagtacctggagagcaaggcccatggtcccaggatgcccctcagcaaaaaatgctagaagaggtcagcaagaggatctgagcttgctccagtcctgggtggcctctccatatctggtcactctttgtattcttgatggatatttaaaagaacatcacggtgaatgcttgtgctctcttttaaccaatagctattgctcctggaaacctaaagtaatcaaagcagtatttaaaccaaaagttagcaatgtgtggtctctgtactagcaacagcagcatcaccttgtcaggaaacttattagaaaagtaaattctccagtctctccccagccctgcttaagtagaacctcttggctagggcccaacagtctatactcttaacaaagtgattctgatttctcctaaagtttgagggcccactggcttaaactgtaagcaattaggtactgttactctaaattactctcagctttaatcatgaattaatctgaacttggttgtctcccctgacttcactaccacagccctgcaattcaagcagtttcaatctgcaacacatctacagttccagaaaataaagccattgtttttccaatgaaagagaaaaaggcctctgtgtaggttacggggtgctttttttccatcccaggcatgaatagtgtattcactttgtcgaagctgtttctgtgactatgggaaacagaagtagctgcactttctaacagttttgaacacttgcaaaccatcagtatggtgactggccacagcaggatcccatttcttctttggctccttctgcactgcccctcggctacaaaagatacatgttccttcaacattctttcattttctccttctctactgaagtccactgtaaagattgtacatcagattcttccctgcaatacaacttaaactgcagaacactcttttatgtttgtgctaagcccctgtaccttcttttccctgccagaaacagaaaagagttggaagaatgtgttgaacatgatcatgctgcttgaagatttttcatgagttttcctatcagcttgtttacaaatctttacttcattatgtgtcttctttttctacttgtgataaagtctcctctttttctacctcctttctgatcaatactttaaaaaaattaagtaatcattgccgtgtgaaccaatatctaccaattgcattttattgttttgcttagttcggtttgctgtaataagagaaggttatgatagagtggaaagggcactgcggtcagaaggtccacatttaaggaaaaattccagcacttccagacttatcagcacaggccacttaaaattcaaagctggagtcccctgatttgaaaagtgggattcatgattactcctgccctgcagaccccacacaactcctgagaggaccaaattttaaaaatgcatgtgaagtcattgtgaaaactgtaaagagttatataaacctgatttcctagtttctctgcgaggatttactagactcaaagttaacaaaacaaacagaactaggacttgaaagcaatcacaagtctccttagaataatagtagccttttaacctatagagtcacaatgccacaaagaatttagacaggttgatccaattgagtagctagtaaatgtttgtaataacaagcaaatagtaattgttcagttttgctaaagcagagaaacttagaaaatatatcctaagttatttccatatttgaaggaaattggaacaaaaggagtaaatacaccaaagactacactaactaaaagaaccatgtgaggtcaatgatggcatatggaaatgtctactaatataaaatgggctttgtggttaatcaataatgccttaatagattatgggaaataatcacaccagtaaggaattactctggatcattaatagcagtagagatttccatcaatttaaatggcccttgaaaataacacataatatttacttgcctgggttttctttaagaaaaatatcgatttgaaactcagaaatcacaaaaacaaagaggctaaaatcagacagaatgtctttgctctattactgaaaccacataaaaaataaaataaaaaaaaaagcccttagcactagcagtgtcaattatccacattatttatcctgatatacaatcttgaaaaaaatctgcctattaaccttgtggaatgcattctcacagccattttgctcagcaggagcttacaaccagtcctaaattgttagtggcaattcccaggtttagtgtctccaaaggtaattttctccagttaccaaagattagagtcctcagaaaaatggggtccttaaagttaacatactgtcatcacagacccattttccaattcagaagataaatgtattttatttgctacctaagaaatgatagcaaacaacaggacacaattcatattgatttttcttccgaaaaacatcttcctaatcaatatcatttattctaatatataaaaatagtgttcatacttaaccagtgcattatgctgtaccctggtattttattattctgagttttaaaaaataacaagaccacaacactaatttaaaaataaaagaaatagcagtgcttgttaatatgccctaaaacggtgtttgtcaaagtgtggtggttcacacacctgtaactagaattaaccaggatgcttgttaacgttctgtaactccatcttagtgaattaactggaggggaatttggaaattgcattttcacaaagatttctggtgattcctgcgcacactacagtttgtgaaacactgccaagctagccagtggttcccaagtcggctgtacattatactcacctggaaaatttataaaaacaccaatggtcagacctcagcccagagcaattaagccagaatctatcggccatgggcagtgttgccaaataaaatacagaaggtatttctttaacatgcttatagtaacaaaataattcttgtttatctgaaatttaaatctaactaaacatcccatgttcttatttattacatttggcagcccaagttataaagctcaggcacagcaagatttttaaaaagctttcctttttgagtcaactggacagttgagattgaaaacaactgatactaaacctaggctctaaagatatcgaaagatatgactatacacaaactctcaggcattaggcgcagagttgaaacaatctagctcagaagcaaagtgaagtacccatcacagctccactatctcatatactcatttgttttccccaaaattttacaggtgttgactgatttttaggtaagtttataataaatgaaaagtatcaacataagactcatctttttaaaataaaacatcatttttaggaaatacttagaaaatactaaataaaatgagagtttccaaaaagttggtgtccatgatcagctaaattcttttataattggaaaattggcttctacagtcacaaatccctctttttggatcaccagaattcccattaggagaggagtcatgagtaacaaccacctctctcaatgccattcagtctgccttgaagcgttcacctggcagcagaaaattaacagcatttcctccttgcgaaaaagttaggagcctttagacattatccaattgtccaatgaatggggatccatgtggataaacgcaggcacaaaatcatccacagttttacacagtaagggagaagattaagtttactggatgtatgttgctgcagccagtgaagttagaataaaataagactggaaaaaaaaaaagcccaaaatttttggaaaggcagagtttccccattatggtcaccccacatttaaaacatcaacatagtctacacataaaaataatttacaataaaataaaacatcaatatatgaaccttaaaataacattttctcaagaagaatttcagcttctaattttccttaatatacatgagttaagattttaaagatgaaatttaaacaaagctgaattctaatcagataactgatttcaggagttactaaataaattttaacaagaatatatcttcataacgtacctttgtaaatgaagaaagaacacaaattaattaatatgagaaaagtacacgcccatttaagccttttttatataatttatctctgttgtccatgatttcagatttcctgaaatttccttaaaaggtatattcccagtatcacatcaacatatcatatcatatcaaacacttagccatcatcttgcttctgaaaaaaaagtgaaattctaaaactaccttgatatctattagcatatagctctagattttgatgataattaatccacttctttaaaatgtggtgtttaccaaagagggaaacataaatgaccagtggatgacttaaatgaccttcactgagttaacatggcactcctaatgaccatttgtcatggctcctggcaaactatttctcactaatataatgataggggagtggctcataggaacctggtgatttagtgtttacacactaaatccctttaaattaaaaataaactaagcacaagatgccacctcatttgaggttcacagtgtgcccattcctccctttttggtctaggagaacactagccctctgtgaatgcatgacatagactcctctggctaagatcctctagttaaagcaccctccaaaaagaagagccctcctctcatggatattatattcattattagcaaataaatatcattattcccagaaacaattttggaggacccactggggcttgtctcaattctaggcattataaaattcagtcctacactgagctcatcatcttatctctctttaggataaataaatgtgggttgcgagatttaataaataaatatacacgatgcccagttaaattcaaatttcaggatcagaagtgcgctgttctctccttttgaatgggagagtctaattggacattttacaattataatccatttactgaaaataaaaataaaagttcaaactgaactctagactacagaaatggtcattaaatgtgaaagcttcctatccccaccctatgagttattatcagacttgcagttcattaattcttgagatattcatggcttataattatcctagcttttctgtcaatataaaggttacaacttaataagagttaccacgctaaacctcttaatttttataaatacttcatctgtgttgtgaatagcattagtaaaagtggcttaaactgaatggcctaagaacatcatttgtggtttatcatctattatttacatttttaacatttaatctggaattacaagcaaaatagcatatattcttgttattttttaaaatattaaatcaccaataacatttccaactctattttttttaaaaaatcatattttggatttctctaaataccatgccatgctccatggtccatgaatatattcattaggactgcagccagcagtgtgcaaatttatcaataactctcaagtaacagaagtgaaaggctgctccaatttgaagtctactgacaattctctgaagccaaaaccttttagtctatcaagcatggatttattcatgatttttgaccttaaaaactttagggggagagtgttgaaaaatttaaaggtctaatcattgtataaaaactactcttagaacatgaaatactattctaaaatctgtacctaggactaagattgtgtaaaacaacaaaggaactcaaaattgactgctctctctcttctccctcatagcaacatgaacttttgtctggctcaagcccaatactatctaaagatatattttgatgttcccattaaaagtaagatggagacaacaaatattgaactgatagtatttgaaaaatgatttgagattgtcttatttggggataagtttacaaccccaggaaaactgcaagaagagaacgcctctaagagaagggccaaatgacatcaagatgctctgaattctgcactaaagaaagtctcagaattctttcccatatttacacgttgccaagtccagtgtcttcaacttgtcttccattatattgggattaataccttagagcattttttttttccattgtgtagtgtgcattaccttcataggggcaaagagaatgccccaaagcagattcaaagtgtataactcaggattaagaaaaaaggcttcaacgtttgcattttaccaagatagaacaaagacatcaaggagagtcctgatgggcaaaaattacagatccagatgaaatagtccagaagtctaaggcaaagaaaaactaggtaaaaatacaaatatttttctttacatttagagaagggaggaagacatggccatggccacctcatagtgataggggtgcttcaacatgtccttaaggccacacccaggatcattctgaatcatcagcacatatctgagataatgacagggatgggccagtgagagcatcctgtgcatccagtgggatagtaaagagagtttcagcttttgaaatagggctgagctgtctccatgtcagccttggctcttgcctagtagcgggcctttgtagaaaatcaaaagggaaaatgggacagtttccttcaacaagacgttttactaaactaaacttctcatacgtccaagagtgaagttctgggacttgctgctcctgacacatcactgaggacagatgactggcatttgcacaggaggtcagagagcaggaaccattagagggctggggctgttggaaaaagccttacctatgagatgagactgggaaagtctcccaagaagtgtctgtgttcaacgaatgtggatcagaaagaacaacagtgataataacttggagcaaaagttccaaggcagaacctaggtagcactattggagaacactccagagcctggtttgactgcctcagagacattatataaggagcttggagaagtcatttggggagttgaaaatgggccaaagacatagagggactaaaatgccatagtaactagtgtagacactctcatctcttgctgcccgaagtgtgatctatggaccagcagcatcaacatcatctgggaaaagatagaaatgcagattctcagggcccactccaacctcttgaatcagattctgcattttgacaagatccccataggattcttgaacacactgataattggagaagtaccactccagcatttagtggaaacacctggtactaaaactgaaggcacgctcaggaatctccattttcaacaaacatcccacgtgagacaaataagaagatggcaaataccaatcagtagtgaggagcatgttggtctgatgaagattagtaggatggatgtaagagacaagcagcaatcatttaaaatacactaacaataatgtagacatgatgatatttatgagtaaggtcagacaaccgattttaaacaacctctttgattctcagcttggcacacaggaacacaggatagattaagtatcaagaatccctccttgtacctagaaaattcattccaaagatagtacctccattccttcttcctccatccctggactgtagaaagcagattccccagctggggcactcagctattagtaaccgaagtactgctcatagagtacaagaaatagtggctgaagtgtggcaggcattctataaatgtggttcatgttgttgctataataacagcaattattactaatacctttgctatgcctcctcacctgtccagtttgctccctctaagttgggtttacttagctcattgagacttctaagaacctggatgagacaggcctggatttgaggcaaatcagcacaaaacttcagaatccagtaatctcctccttctcatcccaaggagactgaagccaggaaaaggagctgatgagttccaattaccttttcagaagatagttagaataggaataatcaacttactttacaaaatcagaaagtgtatacatcctcttttttcaagtatgatgacatggttatcctccaacacaagctctaactttcaagttttttttaaaatgacaatgatattaataatgatgaatgctgatgaaaatattctaccttgccaaattactttgtggttccttaaaaaccacaagctctacgaatctcatcatatcctaatgcattgctttgtacagacccaggaaggagaccagcctctatcattcatcaaagtgtccttcctaatgcagtctacgctcccttcagaagtccatctgcacacccatcaggcttccttctcactcctgtactatgaaagtgctgccttcagtagactttccccccatttttcccatttaaatatttataactgtaatgcagccatgccctagttcatcaatagtgattcttcttatattcaatgaaaaagaaatgtagaacattagtgagttagaggttggtctctcttgctacacgctaatttgtttctttgaccagcctctgagcttgcagctcacatcatcccaactgtgccacttggagggcatgaagtttcaaagaatatccagccctctaggatcctttatgtggtatcccagccaataatttggggagaaaaagtgttcaatccttttctcaaatgtacaccaaaataaattctagattaattaacgtttaaaataaagtgtttaaaagaaaatagagcgctaatatttccctgccttgagaaagacttttaaggaataatattagtcagaagccttaaaaagaatgattaatatgtttaactgaataaaaatataaaacttgtaaaatatttttaaagccatgtattattagtactattaaaaagcaaataaatatcttgaataaatatttgtaatatctgatgaataaacatgtaatattgtatatggaaaaagctgcttaaaataaataagaaaaatgagaaatatttgaaataaatttttaaaatctaaatggccaagcttataaataggatattcaaaaaagaggaaacacaatcaaccaatatgcatacgaaaagtgttaacctcccttgtatcaaacaaatacaaatcaaagccatgctataacacctatttttcacctactaatgtcctatatactgctagtgatagtataagttgattcccattctctagataaccatttgccaacatttaaaaaaactttaaaaatgtgtatatgcttcatgccgcaatgccacttgtagaaacatatcttaattaggggtagaggtgacgtctattaaagcaaccaacaataatgaacatgtatataatggaatgctttgtgaccataaaaatttatgatctagatctataattattaacttaaaggttgttgttgatatattgctatatcagaaacaacaagtttaatgaatagtatttttcttataatttattttgggtaaaatgaaaatgatgatatgcttatgtttgcagagggcaccaaaatagtattactatgtggctggtatttaatagcttattaattaaatattttcttttctgtattatataattttctataatacgtatgtattagttattgtaatgcatgttggttaaaaataaaaatatgtaaatatttacaatgcagaggggagggagagggagagagtcagcaaacaaaatattcggaaggggtcccctctcatagtaagaaggtaagtagagagggctcaccctttcagagcgactagttgcagagggaagagaggccatagtgggttgtctgtctcctttgcttcgagtcagattttattgctttgtacactttctcaactatacaaggaactattaataaaaagagttaaacatcaacattgctcacattggactgccagcaagtgagttgcctaatggtttatttaactaacataagtaatgtgtcactatattactgatgcaatattctgaagaacagtgatagctctacgtttcccttgttatgttagaagcactttttaaaattagcaaataaaaactatatatttatggtgtacaaaatgatgttttggtatttcatacattgtggaatggctaaatgaagctatttcacacatgcgttacctcacatatgtatgtcttttttgtggttagaacacttaaaatatgctctattctcttggcaattttctagtatacaatatatggcttctaactgtagtcagggtgatgtactatagatgttttgaacttacttctccatatctaactttgtatcctttggctaatatgttcccaatctcccttctcccagactctggtaatcactattctaacttcctgcttctatgaactcaactttttaagattccacataaaagtgagattgttcagtatttgtctttctgtgcctggcttattttactaacctaagtgttcatcaatggatgaatggataaagaaaacgtggcatatatacacaagggaatgatattcagccttaaaaaaaaaggagctcctgtcatttgaaataacatagttgagcctgaagggcattttgataagtggaataagttagaagaacttttgagtgaaccccacacctgtgatttttctggccagcctcttcgtttggccttccagaatactccatcagaacacattatcctaaccatgcctattttccttaagagctgcagcataaatggcagaatcactagaagccatgccacaaactggaataaaaccacaaaattaaagttttaaattaggaaagaaaaatcttcatcctttggaagcacaaaggtcaaaatgcactgagaatatcatggagacaatgaccacttggttcaaggaaatggtgttcattcacataatcacagcatcatataaataagctaatagactgtgggccacaaacctggtgaacaggcataaatgtacaggtcgttcttagcaggatttactgaccttgaaagtgagatggaggctgatttaacagaggcaggtcaaagagatcagtttccaaatagtcacttatctattcgtaaatgaaaatcatctttgaataaattagtgattctcttggtgcctgtgaggccccaaattattctggcttttcattgtaaatgttttgggtgtcatgatttcatttccctttaaaacacatcctttactagtaaggactttggaaccttgtgtctgaagttcagagaagctaccagcaggtggcaatattggtttattgagtaacatcacaggtatgtgtgggcacagactgcgggtagctccatggatactctccctaagatgtctagtttaattctttcaaaatacaaaactacttacacagcctccagcacttagttgagaggagggaactctaatcataaacgtatatacttatatagaaaggtaatgagaagcaaggttctcttttcaaatataaatcaaagtcaaaaaaaattataggtagtttgagtctcatggttagctgtcttattatcaatgttttcataaattctataatcagagcttacattcttccacatcctcagagatgatctttgcctttcttccagtcctgcacattctagttattgtgagatttaagcattgttctatgactccacaaaccaagtaaacaaagtccttaattatctctaagcaagggtgctgactacaatggtcaagaactccagccccagtatcaaacagccatgaatttaagttgttcaccacttacttgggcagagtatttattctcgttaaacctaactgtcttgctctataacatagtgttaaggatacacctgcctcataggattaaatgagagatcatgtgtttaaagtgctaagtttaaggcagtatgcctggcacatagtaaatcgtcactaatactattatcatgacttaatgcaagtccctgactgattgagtaccttttcttttgttttaatggtcagattttaaaaatggaatagttaacttaccattgcttgtacactaatcacaaaagatgcagaagggtaattatcaaagggatgcactctctcttctaaaactgatttcaatctcctctcctaactgtcctctcagtctgcacttttgcaattacagctcttatcaatgttgtattccattggcctgattcaccagccccttggctttccctgcagctgtctggcagcttagcttttttcccttatctctactactttaaggaaagctcttacttagcaggatcacttcttttcgttatctttccaaatattccaaacataaccaagatatactgaaatgactgcacacaatcattttattttctacaaatcccctccaactctatcccgcttcattgtctcattcctttgtttattcttctgccataattggccaggtcaggcagccagttgaagtaaacattttgccattaacctattgaccgcagaactttctgtgtgaaaaacctggcttgagagctccctcctctcctgtctcttctctgcatccttctccctgcttccacctttatctaacagatgcagcttaaagaaaatctagttataattccacttcaagatccattcaacgaagacacctgcattttatcctcattaaggatgtgctacaagctgaaaacattacagcctgaactacaaatagtgcccctttctttacggctgattacagcaacttggttgtggtagttggtatgcctctgtatgtttataacaaaggatatgagatggaattaactacatctagcttctgttatgacttactctacctatgctgaggcttgttaataatttgtaggactttcagaatcttaaccaactctatcttgctctgctagaaactattctaccagaaactgcaccctcccctccaaataaataaatcaacagcagggtgaaatttcttgcccagactgtggtcctcttaccactcaatattctccatgaacctattctgacactttccttccatctgagatgctgagtataccaatcccaatggtcagcccataaatagtaatagaactctaactcatgatccctataataatacgcctagaaagccaaaccgtaactcctaaagaaattggctcagaaaggtcaggacttgaccttcttaatgactgtcagcttccctattttttgtctccactctgctttcaacttgggaccaatccaaaaaagccaaaaatgatcccccaaacccatcacataagatgccccacctctggttagcctaccttcagcttccccatggcaataatgtccaatcagagcacaactggaactatttaacatgtatgtatttgttgaacaaagcttccgcatccccctgcctgtcttggaattaggcaagtgatggtggctgattcccttgctgtagcaagctgtgtgtgaatacctccacttattctgctttgaatagtctttgttattcccccagtattactagaggttccactgagacatggtctgcaccacccactgtttctgtccctaggtttcaatcaggtgcagtacccatggatacctcttacagcttgctgcttgtggcttgcatccatgcagatgtggaaagtcagcatgaggtctgaactcagctatcttttcactgagtcccttggctgtttattctgtttggtacccaagttttgttattgtctcccatttgtttgacatccttggcaggcctttcctactcaccctctttgctttatttcattcttctgtgtcggactgtctgaaagcgtttatcattagaatgagaatcccagggtagagcacaggcatgagtcctataagcctatagtttgagctggtctcacagactttcggttctctccagaccagtttccatttgtacaaactttgctgtgagtcaccaacaaaactggacgaggtcttttttctattctattttgtttttggggtcctgaagttttgctttgattcagacaagagttttgtccctgatgttcagcctactgtgtccagaattggtgggttcttggtcttgctgacttcaagaacgaagtcgcagaccctcgtggtgagtgttaaagttcttaaagatggtgcacccggagtttgttccttcagatgttcagatgtgtccagagtttattccttccggtgggttcgtggtctcgctgacttcaggagtgaagctgcagaccttcccggtgagtgctacagctcttaaaggcggcgcatctggagttgttccttccttccagtgggttcgtggtctcgcggccttcaggagtgaagctgcagacctttgccatgagtgttacagctcagaaagctggcacggacacagagtgagcagcaggaagatttattgcaaagagcgaaagaacaaaacctccaaagtccagaagaggacccgagtgcattgtggctgcttgcgcagctggcctgcttttattcccctatctggccccacccacatcctgctgattggtccattttacagagagctgattggtccgttttgacagagtgctgattggtgcatttacaaacctttggctagacacagagtgctgattggtacgtttacaatcctttagctaaacagaaaagttctccaagtccccacccatcccagaaacccagccggcttcacctgtcactggcatgcgtcgcgggactttgcggcacctagccagccactctggcagcccagagggagctcgccccccagtcaagcccagcaggtgcctgccggctgtgccgctgagtgcggggcttgcggagcccgcgcctacccggaaccgcgccggtggccacccgtaagccccagctcccacccgcgcgtctccctccacacctccccgcgagcagagggagccggctctggcctcggccagccccagagaggggcccccacagctcagcggtgggctgaagggctcctcgagcgcggccagagcggacgccgaggccaacaaggaaccgagagtgagcgagggctgctagcatgttgtcacctctcactaccaggggatatacattgtcaggtctgcatttataggcagctgacttgttgaggacctgagacatgaagtacacaagcattacttttgactaagttttggcaggtctcatgaggttaagactaggtcttctcctccaagaaaaacttctgcttcttttatgtactgtcattgcagtcgtaactcttgagcatagctctctaaatggcacaagttcacaaaaaaaaatattgagaccaaaggctacttcgacttgaaaaaaaatgttcatttgagaggtgccttaggaaaaaaaaggaataagatttctcaggcctaaggagcagcgtttttctcttgtgcagaggtctccaaatgaaattctgatttcttcactaaaacttcttcactaaaagatgctttggtctaggctaaccctcggtttgacaaacttaaaaatcaagcgagatgcatttccctagtaaatccctgttttcctagtccttcagttgcctccttatatccaggtttcccttttgcctcttcccccttcattatattatctctcctgccactcttccatcatctcctcccttcacttctccttgtctggactccctacattttccaaatgattctcctaaaaccctaaaatcccagttgcctctaaagacccatccgtcctagtcccaagtggtcccaggcatgtaggcaattctagaatttaggcctcagatctgagctgaattaaaagctataattaaggattttcctaactccacacaagactagcacgtactcatggaataatttagactattttgagtgcctacaacccatagatacttgacctatgacaacttaaatgtatgttggttggaacctcagacactaaatcctaaatgacaaaaatggaccggaatgactcaaaaaggagacctagatgatccctctttccacaataaacctcagggtagaaaaaaatatcctagtcctgaaacagctacagtaaaaatagattgggctataattcaatcatgcaaacagagaaaacatgacactataggatatttgtcaatggattacatgtgaaattggagactcaatttagaaacagaaattagcataagaagtagactcttttacctgagttacaatatcatacagaacatttttaaagggcttcagaacccaaacaagacaagacccaaaataaacttaagagacctgcagatcaaacagctaggtagctcactttctgacccatcacctaccgaaaaggatacttgcaagtattaaaaacagaagagacactggaaaaaaggattgtcccatcatgcaaaataaacaccaagtcaaagaaaaatctctcaattcagatctgtgagggtaatctgaagaaagaaaaagcacccaatatcctaccttactgtaaacactcaagatgaattaactgtaatatagatggtcaacctgctggcaggtacaagagctactctgtcttcattacaccctgttacctttgttcagcctcttccttagagcaaacatacaacataggtggtaggtttttcaaataatgcacagattgttcctatatctcaatctttaactgtaatccttgggctcttgagtaaaaaacattccttccttctctgtgataaaatccctgaaattttaataggaagtgacttactttgcaaattaaactgtagtatgaaatgcaaaccagaagaactatttcttgaggttccagagtcctcctctattcattatcaaattgtgtctgctctggtatgtctttgcctcctccattacatttgatgcctaccacagataaagctcctgatatatggattagtttcctattgaagctgtaacaaattaccacaaacatagtggcttaaaacaacacatatttattattttacagttctgtaggtcataagtgcaaaatgggtctaactgggctaaaatcaagagtcaccagagttgcattagtcctagaatctcacagggagaatctgttcccttgcgtattttatcttttaaaagccacctaaattccatggctcatggcctcttcctccactttcaaaagaagcagtggggcatcttgaaatctctctaacacaagccttcttcttctacttataaggaccactgtgattatattgggcccacctggataatgtaaaagtcaactaattagcaatcttaattccatctacaaactgaacccccttgacatataggatgacatagtttctggtcagtaggaggtgaacatctttgaggggctattattctgcttaccacaacattttacctgacattgcatgggctaaaatttctgctgatataggaaaaataattagagggaaatctattaaacttcagacagattctaccagacagttatccaaactcccccaatatccaaaagcaaaggaaggacttaaacctatagataaaagccttatatcaaagaccttcccatactctacactagcctttgtaacactcccgttctgccagtaaagaaaccaaagaagtgagaatattgatttgttcaagacctcagggccatccacaaaattattatccttaatttccccatagaatgtaacctaactaccatcctctcatcaattccaaatgccagccacttgctgcactgggacagatctctgctctgcccttttcagagtgtctgtagtgaagtcaatgcctttataccttcacctggggagtgcaacaatatactctgacagtcatgccttaggggttcactaaagaccctcctattttcctagattctcaaataagacttaaaagacataggtttcccttctgattcagttttgatacagtatgtagataatctcttactttgttcacaggacaacaaagcctgtaagaggaattccacttactctcagtcttagcagaaaaggacataacatttcaaaaaataaattacaattatgtcaaaatagagtcaattatttagggtatgacctatgtataaaggggaaaacatactctcattataaagacaattcaacttgtcctggccctctaataaatgacaacttagagaaattctaagtttaattgatactgaagataatgagtgccaaacttttctgggattgcaacatctctttatgaattgactagggcttcaataaaagatactctcctctaagaggaaaaacatgaacagggcttctgtaatccaaagaaggctctttaagagcctcaccttctctaagtacccttaactacaaaaagctcttttatctatttgtgcatgagtaatctggacaggttgaggtttaaactcaaattcaagagaagcatcagaaacacactgcttactataactgcacccatgacccggttgcacagacttagcctccttgtctcaggacaatagccactgctgcaaaaattgtcaatgcttctgctgaattagttcttagctccccacttgacttcatggttccttacacagtacagacattactactgactaagagcaaacaatgcttttcagccagttggttaacctcttatgagactctgttactgtctccctcccacattactaaaattcaccactacagtaccctaagtcctcccactctcctgctcctaccaaaagaagggaaactttacaattatcttacctaagtgaaggaactttatgtacctcactcagatttgttagagattcccattggaaactctcacctaatatgatttgttggcggatgtctcaaaacagaaacttgaggttatcaaacaggatatgttatccctcactaatttaaggtctcctttagagtacacttggccctccacatctgtaggctcctcaaccaagaattccaccaaccacagatagaaaatattcaggagagttttccctaggttttcttcaagtattgttatagtatcaggtctcacatttaagtctttaacccatcttgagttgatatttgtatatggtgagagatagaggcccagtttcattcttctgcgtatggctatccaattttcccagcatcatttatggaaaagcgtgttcattcccaatgtatgttcttgtagactttgtcaaagattgattggctgtaagtatgtggctttatttctggctactctattctgttcattgatctatatgtctgtttttatactggtaccatgccgttttggttactatagctttgtagtataatttgaattcaggtaatgtgatacctcctgctttgttctttttgcttgctttgggtattcgggattttttttttctttggtttcatacaggttttaggattttttttctaatttcatgaaaaaagacactggtattttggtaggaagtgcattgaatatatagttttgggtagtatggtcattttaatgacattaattcttctgaatcatgagaataggatgttgttccattttttaatgtcatctacaatttattcattagtgttttgtagttttccttgtagacatcgttcacttccttggttaaatatattcctaggtattttgaggttttctgtggctataataaatggggttaccttcttgatttgattctcagctagatgattattggtgtatacaaagtttacttatttttatttgttgattttgtaccctgaaactttactggattcatttatcaaatctagttttttggtagagtcttcagggttttctagatgtaagattatatcatcagtgaatagggataatttggcatccttttttttccagtttgaatgtcttttctttcttcttgcctaattgctgtggctaggacctccagtactatattgaataggagtggtgaaagtgggcatatttgtattgttccagttcttagaagaaatgataggcaacgaagattttgaagggtggaggggtgagaggggtgaagatgaaaagttacttaataggtacaatatgcattattctggtgaaggatacactaaaaaccctgagttcgccactatgcaatatatccatgtaaccaaattacacttgtaccccataaatttatacaaatagctttttaaaaaaattagaaaaaataatacaaataaaaaatacagtaaacaaccatttgcatagcatttacatatattaggtattttaagcaatcatgagatgatttaaagtatagtcatgcattaattaatgagggggatactttatgagaaatgcattgttagataattttatcattgtgcgaacattacagactgtacttacacaaacctaggtggtatagcttactacacaactaggctatgtggtacaccctagcgctcctaggctgtaaagatatacaacatgttactatactgaatagtataagtaattgtaacacaatggtaagtacataggagaggtacagtaaaagtatggtattataatcttagggtatcactgttgcaaatgaagtccgtcattgaccaaaacattgttatgtggcccatgactgcatacaggaggatatgtgtagattatatgcaaatattacattttatataggaaagttgagtgtacttgaattttggtatctgtaggaggagtcctgaaactaatccccagcagataccaagggaggacactctatactcctccaactgaggtaccatcagctcaggtggcagaacgtattatgcttactagagcttacaatctaacaaaaccctagaaagtaaacatgcatacatagagcaggtatgcttttgcagtagtacatgactttgggatgctttgcaaccaaggaggtttctcatctctgctggaacttccatcaaaaacagacaggaaacttttatgcagtctaccaccaatgggcatttaggttgatttcatagctttgctattgtgaatagtgctgcagtgaacatttacctgtatgtgtttttatgcctaccaggggttgtagggtgggaggagtgagaggatctataaaaataactaaagggaactaagcttaatacctgggtgatgaaataatctgtacaacaaacccctatgacccaggtttacctatataacctacgcatgtacccctgaacttaaaagtttaaaaaaagaaacttttagatgcttcctagggaggtgactattacaaaggttgaagcccatacaaaaactgatagtatgaaagtttggggaaaatgctatagcagatcattctgccaataagcaggcttcaccaaggttatgagcctaattaaactctcaaagaataaatcccttgaaatattcaaaaaggccgttatgaaatatcaatgttaagttcctaaaaagtcctaaaaaggaagaatggaaaaactctggttgcacatttcacacagatcatctctggcacccccaatgaggacactggagacatgaataacttccaatggatatgaacaaaatttctctataaaactactcatcatggtacagacaaattggttactatcttaaatcatcattggtggggaagatttatggactgatgaggctatttttagatcatgtgtcacctgtcaacccaacagcatcttggagaaactataaaggtggatgtgaaacctcaagaacccttaacaccctcagataggttttgtccaatttccattctccatgaaacttgtatgcctattttcaggatcggttgaaacatttccttgctgaaaagctacagccttcacaatcagtacaaagctccttgataatgcatttctaatttggggcataccaacttttataacaagtaaccaaggctcatgttttatgggagccattgtaaaagaaatttgtaatgcattgtcccttactcaaaaatgacactgcctttattactcacaattttctagaaaagttgcaagaaccactagcatcattaaaattagcaagctttctgaaggacgtgagcctcctttgggaggccaaagttatttccaccagcacttatggccatatggtccacctgctcagagaattactggttatctatctatgaactggtaactggaaggccccttcatttatggacaccacctacagtattagactaccctgctacacaaaaatatgacaaaatagcaaaagaggctcatgtagtatactcagttttatcaccaataagttaagattgacttcttaacttgtttacaatcctttcctacacagcctctttatgatcttcaacaggagatcctgattattagaacagacattagaaaaaactgttcttgaacctcccctgtaagggaccttatcagatacttttaacaacaaatacatcattgaaactccagagatcaatccttggattcatgtttcataactaaagaagcaattcaatattctatacaactggaaggctactccaacagaaaaacttaaacagaattcttagagatattatagaaatagttggtcttcagaagcagatggctgatccaaaacctccagaaaaagatgatcttggacagtagacagcttgcacccaatacatccaacctaaaacccctgcattcttgtttgtttttcaatcttcttacctgttaccactctccttattttccatagagctctgattgtcatccactaataatggttctttttctcttttttttttgtctattataattaagtcagaacatactcattctaatgccattcttatattttttttttcaaaaataagccactgccctcaatattacagactgctgtataggtcaaccagaaccagaacccctgataaaaaacctctgagcaatcctagtctcatcaaatgataccccagcaaattataatcagtgacatttccacttgtacctacatggacaaatgactttaaacaaatcaacctaagactttgctgttgtctctctataccagaaaaagaaccaattcttactgcctgtttatcagactctatataattctaaatttgaattccataatcttcactggacaatgggccaattacttgatgccaggaagacagtaatagagattcaaataggtaaactcagctaatgtgaggccttggttccaacctcatgtcatgaataattctttttgtccatggctgtccagttcgtgacaaaaattcctggtctcatctgcctcaggctaacacctcaagtctttttggtacacagaggccctgattctataaatcatcaaggctggaaattctgactcaaatacaagttccaaaatgaggccacctttgaagcattctatcagggagaattactgactcattgtttatatgaataatcagaacagtgttcccaacaccagaaatcgtatacatagaaaagactaagaaatttaacattaactctaacagaagttattaacagtaccaactctgccctagatgtaatacacatcagtcttaactcatcagcagtagtaatgcataatatcattgctctaatttcttgttggctagccatggtggaatctgtgccaatagtaatacttcttgctgtacatgaattaataaaacaggcaaggtagtacaggctatatgctaccttatgaaaaagctacctaaatctctaaggtgatcctcatgccctgtagaaatttttctcacagcctgaattgggcaatttaggttcttggacccaaaacatcttataaggactataaactattcttctttttgtcatagtgctcatgatgctgatctgttgcatgctatctagagtcttagatacttctgtgcagccactctcttatcagatgatagccatgatgataacacaacaaaaaggtcaagatcttgggaaatgatgactatatgtacaactgaacaatccgtaaatggtgaaggtcttaagccttccatgagaatgatgcaaaggtgagactgagactaaacatacaaatacacaaaggccagatttttatatatatatatatagtcacaatatatgaaaatagcactctaatgcacaatctccacagcaatgagcctgggaaaccaaaccacagtctgcaggcttcagacagcttccctacattttgtccctagtctcaactcagggccaaaagaaaaatccaaatatgcatcccaaaccaaacacgtaagatgccccacttccagatggcttacctccagctttcccatgccaagaatgtcctatcagagcatgtatagtatctttgcttttttaaattcaatataaggctttaccaccctcctgcctatctctgaatctctgaaaagtgcaagtgatggtatgtggaactataacaaactctgaataaatagtttgttatcatttaggtagttttaatttattttcacacatccttgtacaatgtccacaggcaacccagaatactaaactctagcaagtgtacccataatgtaggaaagtaaatagaccttaaaatcaccagttctgatattcaatatatatctaaccttggaaaagattgttaatatctctaagtcctagtttcctcttctgaaaaataagagtaatgtaatcacctaaatggatttggtgtaatgattaaatgtcatgatgatgatgatgatgatggtttctggtagtagctatgttcttcagatgggatggtaactgtgtcttgctgtttgctacctaatgtgagatagtatatgattttgtgtgtgtgtgtgtgtgtgtgtgtgtgtgtgtgtgtagtgtagcgtataatttcaagcatatacagaggtacacaaatagtatgacaaatctcaatggattcatcacccagttgcacaaattatcaactcatgggcaatcttttttatccatagtccttctattcacgcttccattatattttgtttgaagaaaatcccaaacatcattatttcatttgtaatatttcattatatatctttaagaaataaagactcttatgaaatataaccacattattatactcctttaaaaatccttaatatctaatatcaatttctcatgctatgaatctaatatgatgaaaagttcaacattgatttatatacacttcaattgtttccacacatttatggctccttttcttcatttctatttttctttaaaatggtgttcataaaaatgtatggttactaactggattacttctatatttttgacaaggggcagaatttggaatacaactgaattttgtctccattaatacctaccttcactacctttggtgaatattccttatatcttataatttcttgctattttaatatctaaacaacctagagtaggctgtgtaatatttactatttagctccttctagtacagtgaaggaattacaataaaatgatactatggagaatatgcatggggcttcacttaatcaatgtcataaatatccatttaaatattttcaaaatatttaccagttcccttagaaataatttacttgaggggtgatgagttcttgcttgtctgattcatttgtaaggttcagtttatttactgaggattatcgatgtacagttaccagtaaatttagaaagtatcctgtaggttgcatatttacgaaaagtccttccctatcatttatcatcctctaaacacatcctaaccacttttgctatcatcagttttgagcaattgattttcagaagcagacatttgaggggagtggctgaaagggaggtcgtttgagcattgctgttttatgagtcaataacccacctcaatgaaaaagaattaatttcactgaggtaagtaaaatgtccttttaaaaggataaaatgaaaatatcatacattcattctgtatagttacatcgttagattttctatttttaaaaatttcctctggacacactttattttcccaaactatagtaaataccacagcaaacaaaaatttttgcaagccttatggaattaaaaaaacaacacttagaatcaaaggacattcaactagtgaattattgcacataagtcttaaacttctttgactctttttgtgaacagcaggaacagtgaaattaaacaaaaaattattaaaggatttgtttccaactggataaaaaggaagatggtaaaggaaaaggaatcttctaagaaaactgtgactctttaatatcttaatagaacatatattagtcaaatgtaatattaacagaaatgtctcatttgtaccagtcaaacaataaaattggcttctagacgagatattttcattccataaatcttaggaaacgtaacttgagatatttagtaaaagcatgccctaaaacccgttaaatctaaatttaattttctgtggtattggctaagggtttgattatcttctttaagtgaataaaatcaactgttctgttaaatattttccaggaaggaaaaccagaagatataattgcaggagacaaggataacctcttcttgcttactgtcattaaattaaggtttagaccctcaatgcaataaaaaaaatcaaatgtcaaatctttcagctataataattttatttttcctggtttattcagtctgcctcagataaaatctgtaaaagcgaaaatgctctgagtcatacatttaaaattttaaaagttgtaaccacatcactcttaccagaattaatcttggcactgtgatgaaccaaggtaagtaatttttctctagcattaagattctcttctatgctaaattccagctatgttcaaacataaggatatcacatctaattattaaaactttgacaaggaaatgatagtagtaaggtgaatgactcattgcctaatactcagctgtcccatgtcagcaaacccattcattcttggcagaactggaggcatacttcagtctacaggtataccttggaatatcaatcaattagggattccttccaaatccaattattaccaacccctgtcacttccaccttctgagagtctctctaatccatcccactgctaataccccagttcaggcccccttcagctctcacctgaactgcaactagggcggccatctgagggatctcccgtttctgtgtctacccagccagcaattgatccttaactgaacaggagatctgtcttcccagagaacaaatctttggatggcaaacaagcaagagagtcacacacaaaatatttcacaatttagtttcaccatagtttatcatattatcgtcccctcactctcccctttctcactcccttcctattcagacagacacacatacacacacacacacacacacacgtgcacgcgcaaactccacattaaccctaatctcacaacttcccagatatagagccactttaataacctttgaaaccacattggactcattttcacattcctacaaatacactcacaaagcattgtaaatatttgttgtgtctattgcctctctgctaaactatgaatttcatgggggaagtaatcgtgtcttagtcttcatcatattaatctctttgataaatattcatcaaagcgaaactaattctaacaaatcaatgtaatataataaatattcaataaataaactatgaatatttaagtattcattaaatgttaaagatgccatttcgacttcatttaattttattggaatttatgttaaaatttgtaaaatatgagtaagaccttagctcgttcaatacaacaaaatacattctagaaatattaacaatgtaaatagattttttaaaaaaactatagaaatactagtaggaaataaaaagtcacatttatatcatgttggggaatggaaaagacctttctaagcatgaatccgaaggcaaccatcaataaaaagaaagcaatatcagctttttcaattaaaaaaaaattccatagcagagttatagcaatataaccttcagcaatgatggaaaaattttataggtacactgtctaatacagtagcttctacccacacataactactggatgcttgaaatttagctagtaagacttcctaactaaatttttaattttatttcattttaggaattttatttcatttaaacaattcaaattacatttaaatttcatagccacttgttaatggctattttttgaacagtgtggttctatcagtttaaataaaatcttctagaaagaaagtaaaaatgcaaaccacaaaactgaaaataaaatatttgaaatacacctattgaataaatacattatatcttcaaaacataaactgttcttacaaattcctcaaaaaattatcttttggaaaaatagttacagatgatatacaaaatgagaaatatagatggctaataaatatatgaaaagcattcaccactcactactaatcaaagaaatccaaattgaaacaatatactgactgctgtcacttcttcagcaccaccctatcttcacctcatttccattggttagatttgagtctatccattctaccttttcttaacaacatctttatcttccttaatcaattatttttctggcacccacctgacaaaaactgaaccttggataaattcaacagtccacgtcatgaactagagatcacataatagaaaaccatatgagacagtaaaaccacggataggtgtggtcttgccacctcattctcagcacagcctggacatcctctacatgttctttaccagttctttctctctctctctgtttctccacactggctgcttaaaccctttctgctctctcaaatttccaaccctgccatcttcctcctatgagctgaaggcctcaccactgcttcacaaagaaattaaagaccatcctagggcacggtggctcatgcctgtaatcatagaactttgagaggccaaggtgggcggatcgcttgaggccaggagtttgagagcagcctgggcaaaatggcgaaagcctgtctctgcaaaaactacaaaaattagccgggcatggtggcacacacctgtagtcccaactacctcaggaggctgaggcagaagaactgcttgaacctgggaggcagaggttacagtgagctgagattgtgccactgcacttcagcctgggcgacggagcaagactctgtctcaatctccaaccagtataaatgacacacagttattacctttctactgatcccttaaacttccccaactattaccacagatgcaatgtcaatatttatttcaccatttgctggatttcaccctttgtttcctatctcctcttttccttgtattttctattctcttcatctaatgcacccatccttcaagcatttaaatataccaaattctctcctgttttgaaaagacacatactgcagtgccttaggaaatcagcctcaaaatccgagctctaccattaccgctgtgtgatcatgtttggcccctgtcatgtttccctttctgtatctacaaaagtggaataacaacaacattccatccatagtatagttacgaacagggaatgaaaaagtttccacaaagcacttagcatggtccctggcatatgataacctcttggaaaacatcagcaatcattttcactttttgaaatgattttgagctctcctcagcttcatattctttccagccatcccccatcactctccttcctttcagagcaattcttttttcttagctaattttagatttaaagaaaagtttccaggtactacaaagagttcccatattccccttatcctggttcccctaaagctaatacattgcataaccatggtacaattatcaaaactaggaaattatcatcagtgcaatactatattaaattacaggccttttccggatctgaccagttttttcataatgtaattttctattccaggatccagtccagaatcccacattgcaactgtgatttctccttagtctcctataatccatagcaattcctttctctttcccagtcatgatctcaacacctttgaaaataactaatcagttatttggtagactcttcttcattgggggtttgtctgatatttattcattattaaattttgaaaacttacattttttagtaagaatgccacagagctgacactgtgtccttctcaaggcatcatatcaagagatcatgatagcagtatgtcacaggaaagtgttttgtaagaattatatcctctcactgactccatttcatttcctcttgcttctcaatctactgttcactggcctcagtctccatcagtccattgaaactgttctggttaaggacaccaagaactctcttgtcatttaaagtttctttaaaagaaacttctcaagcctttactcctagaccacatagtatttttgacactgctgaggactatcttctttacacatgcatttagctgccacaacacatttgcatgatttaccactgattttttattttatgagtgcttacctgcactcaggcccttccttccttcctttccttccttcctcttttatttttctttcttttcctctgtctttctccttctctccttccttcccttcccttccttgtctctctctttctttctttccctccttcattctctcccttactttagagatgggatctcactatgttgcccaggctggagtgcagtgtctattcacaggcatggtcatagcacactacagcctcagactcctgcggctcaagtgatcttcctgcctcagcctcaaagtatctggaattatagactcctatctcttagtgctttcctcagtcccctttcctggctccttttatgataaactacctctgaacgttgagagtgcttatctctgactacacattcttcctagattaatgcatctacatatctggttttacttgctatccagatgcagacaattcccacatcaatgccttcaacacatttctgtctcctagtcttcatcccatatacacaactgtattccaaacatctctaagggatagcctacaggaattacaaatggaacagatcccccaaccaactctactatgattctaaagttgagccttctaaaatatgatttattttatgccaccaaacctactaagccacttatacatataaacacaacaaagtagacagtaggtaaagaatgtcatatggtctttgaaataagattttattaatgcagtctaagcctgcaattagattttgtgatagtcacatcatataactgacacataagctgaccacaaaagaaaagcttctattttaaaaataaacatatagccgtagctgtttttccaatcctgtaattgtatgggtaaaatttaggacatgctacatcactctgtttaatttggtcctcattccagtctgacataatttgggatccaaatgcagtaatccaactagctgttaaattaagatacactgagcaaacactactagagatacagaagtgaggcagagtattagttgtcccttcaatccattcttctctttatccatagtattgcagtttaatctaggtccctggccattatctagatgtgaccctgtctaagataaatataataggggccacatatgtaattttaaaatttatgattgccacattaagtaaataaaggtgaaattaacttcagttacatatctggtttagccaatacatccaaaatattatcatttcaaaatgttatcaatattaaaaatatttagatattatgcattctttttttcattctacgtttctgcaatcaatgtgtatgttaaactcagaacatatgttaatccagagcagccacatttcaagggctcagtaggctcacttgaatagttgagaggtagagagactgcatttatggtacagcagcttaaaccttaactcaatgtacacaagagttgaacaagcaaccacattccaggtcctaaatttgccttctctcctagctgcaaatttggtggctggtggatttccatatttccatatataagataatgtgtttgtgtgtgtgtgtcaaagcagaggttcagggagagagaaggcaatctctcttaaatctgtatttgcataaaaataacacttttgtttagattccatgttaccagtcaataaatataggatatctaaaaattattttattcatttttacataaaactaaagaaactgttattcatattaaaatatggtcatcactgttattattattatttcttaggttgagataagcattgtttatccttcaattagtcatttcatgttctccagtggcagacagcctgggtgaatttatagcaatgggatgttgccaagtttgtttcaattactcccttagcattgtgtcacaaaaaaagtatatatttttatgtatgtatcaaagtgcacatgagaaaggaaagagtcaaagtcaatggcaaataagaaaccaataaataaaatgtactgtgctttaaaactttgttgatccacttcccaggaagtcattagtgtctaataatggcaggtttctccccactgcccattcctgttgactgggggaagggagccttgtgagtggagaagagggtatgctacctacagaactgtgttcacagtgttggtatacttatgtgtcctaccaactgtggctaagcccatggcaggctccaagctgtggatcattttatctttctatttgtcaggtcacagtcatgaccactaatggcacccatcccaaaagtatatgattcttcaggaaatacagcttgagataccaatggaagtatctttttaagcaaaaataggaatataagattttaaaaattattttcttcaccttcttggttagtgactaataaattttttggaatcttttggctttcatgaactgttagcagtcccattatattggctctttcctccctaactcatatgtggtaaaattaaagaaggaaggaaaggaggctgaatgaccattggtcatgaaaacctcaatattccaaaactctctcaaagagcctctcttcctcaggatagtagtttgaaaacagaaaatttgggaaggccacttgggataatgtttggtgtctgttgctgcatcagcgtttacaaagtgagtatccaaacatgtactttttttgttgtttttttcgagacacagtcccattctgttgcccaggctggagtgcagtggggtgacctcggctcactgcaacctccgcctcctgggttcaaatgattctcctgcccagcctcctgagtagctgggactaaaaatgcacaccaccatgcctggctaatttgttgtatttttagtagagacagggtttcaccatgctagccaggatggtctcaatctcctgaccttgtgatctgcccaccttggcctcccaaagtgctgggattacaggcatgagccactatgcccggccccaaacatatacttctttaaaatgcacaaaaactcaatgagtgttattttccttattactattgttatacctaactaacaatgaggaaatctaaggtgtagagacattaaatgacttgctcagggtcaaaagctaataagcggcagattaccaagatttctcaattcaagtccagagtttccaccatgaatagcctcagaatattgcaaaaggctatgctttaggaatggtacttaatagtgttaaaggactgggtaaaataagataacctaccaagaaaaaaagttgtaacttcaattgacaacttacaatatgaaaaacctaaacattggttaaaaaaaggaaactgaaacttttttttattattattatactttaagttttagggtacaggtgcacaatgtgcaggttagttacatatgtatacatgtgccatgctggtgtgctgcacccattaactcgtcatttagcattaggtatatctcctaatgctatccctcccacctccccccaccccacaacagtccccagagtgtgatgttccccttcctgtgtccatgtgttctcattgttcaattcccatctatgaatgagaacatgcagtgtttagttttttgtccttgcgatagtttactgagaatgatgatttccaatttcatccatgtccctacaaaggacatgaactcatcattttttatggctgcatagtgttccattgtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatttacccagtaatgggatggctgggtcaaatggtatttctagttctagatccctgaggaatcgccacactgacttccacaatggttgaactagtttacagtcccaacaacagtgtaaaagtttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatgtccttcgcccaatttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagtagctctttagtttaattagatctcatttgtcaattttggcttttgttgccattgcttttggtgttttggacatgaagtccttgcccatgcctatgtcctgaatggtaatgcctaggttttcttctagggtttttatggttttaggtctaatgtttaatttttgtattaattgaattaatttttgcataaggtgtaaggaagggatccagtttcagctttctccatatggctaaccagttttcccagcaccgtttattaaatagggaatcctttcccccattgcttgtttttctcaggttcatcaaagatcagatagttgtagatatgtggcattatttctgagggctctgttctgttccattgatctatatctctgttttggtagcagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatattttcttcccatccatgaggatggaatgttcttccatttgtctgtatcctcttttatttcactgagcagtggtttgtagttctccttgaagaggtccttcacgtcccttgtaaattggattcctaagtattttattctctttgaagcaattgtgaatgggagttcactcatgatttggctctctattggtctgttattggtgtataagaatgcttgtgatttttgtactttgattttgtatcctgagactttgctgaagttgcttatcagcttaaggagattttgggctgagacaatggggttttctagatatataatcatgtcatctgcaaacagagacaatttgacttcttttcctaattgaataccctttatttccttctcatgcctaattgccctggccagaacttccaacactatgttgaaaaggagtggtgagagagggcatccctgtcttgtgccagttttcaaagggaattcttccagtttttgcccattcagtatgatattggctatgggtttgtcatagatagctcttattattttgagatacatcccatcaatacctaatttattgagaatttttagcatgaagggttgttgaattttgtcaaaggccttttctgcatctattgagataatcatgtggtttttgtttttggttctgtttatatgctggattacatttgttgatttgcgtatattgaaccagccttgcatcccagggatgaatcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattagaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttcggagggtgtatctgtcgaggaatttatccatttcttctagattttctagtttatttatgtagaggtgtttgtagtattctctgatggtagtttgtatttctgagggattggtggtgatatcccctttatcattttttattgcatctatttgattcttctttttttctttattagtcttgctagcagtctatcaattttgttgatcctttcaaaaaaccagctcctggattcattaattttttgaagggttttttgtgtctcttcagttctgctctgatttcagttatttcttgccttctgctagcttttgaatgtgtttgctcttgcttctctagttcttttaattgtgatgttagggtgtcaattttgggcttttagtgctttctcttgtgggcatttagtgctataaatttccctctacacactgctgtgaatgtgtcccagagattctggtatgttgtgtctttgttctcgttggtttcaaagaacatctttatttctgccttcatttcgttatgtacccagtagtcattaaggagcaggttgttcagtttccatgtagttgagaggttttgagtgagtttcttaatcctgagttctagtatgatcgcactgtggtctgagagatagtttgttataatttctgttcttttacatttgctgaggagagctttacttccaactatgcggtcaattttggaataggtgtggtgtgatgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtcactgcacatgagatgggtttcctgaatacagcacactgatgggtcttgactctttatccaatttgccagtctgtgtcttttaattggagcatttagtccagttacatttaaagttaatattgttatatgtgaatttgatcctgtcattatgatgttagctggttattttgctcattagttgatgtagtttcttcctagtctcgatggtctttatattttggcatgattttgcagcggctggtaccggttgtgcctttccatgtttactgcttccttcaggagctcttttagggcaggcctggtggtgacaaaatctctcagcatttgcttgtctgtgaagtattttatttctccttcacttatgaagcttagtttggctgaatatgaaattctgggttgaaaattcttttctttaagaatgttgaatattggcccccactctcttctggcttgtagagtttctgccgagagatcagctgttagtctgatgggcttccctttgagggtaacccgagctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggatgttctcctggataatatcctgcagagtgttttccaacttggttccattctccctgtcactttcaggtccaccaatcagacgcagatttggtcttttcacatagtcccatatttcgtggaggctttgttcatttctttttattattttttctctaaacttcccttctcgcttcatttcattcatttcatcttccatcactaataccctgtcttccagttgatctcatcggctcctgaggcgtctgcattcttcacatagttctcgagccttggctttcagctccatcagctcctttaagcacttctctgtattggttattctagttatgcattcgtcttaatttttttcaaagttttcaacttctttgcctttggtttgaatttcctcctgtagctcggagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagctttccttctaacagacaggaccctcagctgcaggtctattggagtttgctagaggtccactccagaccctgtttgcctgggtatcagcagcggtggctgcagaaccgcggattttcgtgatccacgaatgctgctgtctgatcgttcccctggaagttttgtctcagaggagtacccggccgtgtgaggtgtcagtctgcccctactggggggtgcctcccagttaggctgcttgggggtcaggggtcagggacccacttgagaaggcagtctgccctttctcagatctccagctgagtgctgggagaaccactgctctcaaagctgtcagacagggacatttaagtctgcagaggttacagctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgccaccttgcagtttgacctcagattgctgtgctagcaatgagagagactccgtgggcgtaggacactctgagccatgtgtgggatataatctcctggtatgccatttcctaagcccatcggaaaagtccagtatttgggtgggagtggcccagttttccaggtgccgtctgtcacccctttccttgaccaggaaagggaagtccctgactccttgtgcttcctgagtgaggcaatgccttgccctgcttcagctggtgcacagtgcgctgcacccactgtctggcactccctagtgagatgaacccggtacctcagatggaaatgcagaaatcacctgtcttctgcatggctcacactgggagctgtagaccggagctgttcctattcggccatcttggctcctctgaaactgaaactcttataggcaaataacatgtctataagtaaattagtttcttgaatgttacacatttgagctgttaagcttgttttctgtttcattttaagagtttaaatctctgaaagtttggtagaatatatcctctattttcattttcaagtgtgaaagccatatcaataaataagtgcagacttatataactgcaaaaatgtatcttcaagtatttattgtgtacctactatgtgccaaaagctcagtgtgcctcaagcttggggacagaatcatgactagaactcagatcattgtccaagagttagtacgcaacatagtgccatcttccaaaaaaaaaaaaaagaaaaagaaaagataaagaaagaaaagaaagaagtgccatagtggactagatcccttatctactcaggcctgtgatctagaatgacaatagtacatactggaagaaatgatggttttatgatatcaattttataaagctaggaatgtgcactcaaacatcgtcttacttgtcttaacaactcattgtaaatgccttttctttgaattcatttaagccacacttaaacctatctatatattctgtatctaaactcactctctattcagatgaagccaacaaaaaaacaccccaatatacataataaaacactataaagttgagttaaaatagcaacttttttctatactacaattaatatgtttgcctactttttaaaaattgtttaacctagacttacacattatgtcatcaaacatagtcatagtactaagaagagattcagtataaaactactgttacaaaaagggatgagagagtagctgcaggctttcattttgctaaaccacatgactatccttctcaacagaatgtagaaacctgcacttttggtacttttattttacataaaacattcttctattagtttatttttctaaagcattttgcagttattccctggctaatagtaataaccaagaattaaaagctacagcatatgttgaatagctgtattacaccataaatcacatttactgccatttgttaacatgctgttttaatttcagaaaattcaatgacagttcatgaattttgcggaatctcaaaaataatgacatgattttatgttgaagactaaagggatgttgtcaattttaatgtgtactgggaggtcacatggtattctcaaatttaatggtaaagcaaatttagttaaccctgcagaaacataaggagtcttgaacaatcagtctcttggctagccaagggcaaatgaggaatgaagacacttacaagtttaaatccaacacctgagggtgctttgaaaacttttctgcaccaaatgcagctggtggaaagagatactcaaagggtaaggaagaggcggtacaaagatagctgataaaaggcaacagtcacagcagtagaaaaatttagacaactatttgcgagaacttatcatctgagtaatcattctttgcaccccaggtctttattcccaccctcaagaataaagttaactccagctatgtccagatacaggtagttttgcctaggatactagttatcttagtttgttcagtctgctataccaaaatgccatagatcagatggcttaaataacagacatataattctcacagttctggaggctgggaagtccaaaatcagggtgccagtatggtcaggctctaacctgatctgctctttctagcttgcagatggctgccttcttgctttatcacatgagagacagagaggaagcccgtgtgtctctttctcgtcttataagcacactaatcccatcatggagccccaccttcatgacttcagctaaacctaaacctcccaaagaccttgcctgctaatcctatcacattgaggattatggcttcaacaaacaaatttgggatcagggaggacataaacattcagtacataacaatggtcatcaacctttagggtgcctaagaaccacttggggagatttagtaaaaatgcagattactaatccttcaacatttgtgattctgattcattccatctgggaggcggacagaaaacactttcaaaagcagtccaggaaattctgatgtaagggtccactggccacattgtgagaaattctgtcctggcttagcttcaagcagaagggattgcttgcaaagtgcctgtgctgtgcctcaaagactgaaagaagtgtattcagagatcagactgtcctacggatggtaaaagccagaaccaggaggtgccaacagaggtgctcccacataaatgtcaaccaaatggtgctaggtaatatagatgtactcagtgtccaattcccatcctctcccccattgccatggcctttagaaaactatctttgacagagaggcaaaaggaaaacacctggctagaatcctcatatccaatctaaaaataagattttaagatagattttaaggggaaacaatacatgggaattcaattgtgcatatcctaatggagtcactctggccaatgagagctcaccctgagaaagagggcctctcccttacaatatgataacaaggaaaagtcttttgaaataaacaataatagtaataataacaataacaatcctatgaggattatattgaagtccatgtagtgtttttccatttatcagttccttttgtcttctgtgataaacatgaaggaaaatgtatggttgtaaatggtttcaactaacaaaacaataacattcagaaaaaagtcatcaggagaactgatttttcagttgtcctaaagataatgcagtgtagtcagattaaaaaccctgaattgacaaggctttaatagatttaacttctggggcttactttttaaatactgaaatcacaaacttcaacagcttcaaagtgttttgcaacaaacatataatgattattttaaaaacgattattgtttataagcttaaaaaggaagcagcaaaagaaacagcattataggctgggttggggctcacactgtaatcccagcacgttgggaggccaagctgagaggattgcttgagcttaggagtttgagacccggtctctgaaaaataactaaaaaattagccaggtgtggtggtgtgtgcctgtattcccagctatttgggaggctgaggtgggaggattgcttgagcccaggaggttgaggcttcagtgagccatgcttgcaccactgcactccagcctgggtgacagagtaaaactctatctcaaaaaaaaaataaaaaaaaaaagaaaagaaaagaaaaataaaacagaattataacactgagaattaaaattacttttaccatgtagcgtatttccctacaaaaattcaagttgtcctttaaatacaaatacatgaaactactgatgtttcaagtaaaataaaaatgaatgtcttcatagcactgtttgttattaagctatttccatactggatttatgcaagctatgttttactaaaagaataagcaagtagaaaataatgcataattcctacaggccactcttctttaaagatgaggaccttcttgataccaactgaaattgcctgtgtcaatgattccggtgaaatatgcctcagtaaagatgggactcaggaaatataataaaaatctgtcagccaagttccaagtgcctaggaactggtcatcactggcacattgtagagcagtttgataagcattaaaaaaaagtttgtagtgataaatgattaactattgttgaaattaaattgaatactttcatctttaaaatccatttaatttctttaaagccataaggtttttcaaaggttaagatttattatggattttggtttcaggtgattggtaagtaccagcctcagaatgccatttggcacacaaattgattccctcaggaaaactaaaattatgtggataatcccatctctatgtcctgtctctcaaaaactttagaaaattaattcaaaggacagaagtgtaggttgttttcaagcaaacaacttcaaagtgagtacatttttctcctttaaaatacacacagaaactctaaaagggtcaggccatcttcaagggcagaatacttgttcaacatctagatataggctgctaaggctgatgaatgagaatggaagtaagagaaaaagctgacaatcagtcaagggtatcatcccatatttttaaaaaattccttctttggtcagttcattccattttgatcaaaagcatcatgcaaccacttgtttaacataaggaaaaaaaatctcaaaatataagatgaatttcacattactgaagctcacagagaatgaaatacagtttttctagaaccttatattaatttcttggccaaaattaagtcctctcgaaggttaaaaaaaattgcaagactcatcagttatggcagccaacagatcaaatactcatttactcattgtatataagaaaatggtgtatttaaacattcaacaaataaataaagaaaacaaaaatttcctgggagcaccaccagaagaatgatgatgtatgttggtgatagccactgaacttgcagctgaatacctggttcaaggtggatcatgccattctcctaccttctgtgtcacttaaaagaaattcaaattccataacatagcccacaatattctgctgagctgccccctgcctctcttttcagtctcatcacctattctctcctcctcattcacactggcctcccttcaatctctccagttcagcaagcttcatcctacttatctagcactctctggctcctcccctgcctcgtactcacctgctgtctcctgctcatctttcaggtctcagactgcatgtcactccttaaattcagtcattgcctgccccacattctgaatcaggtgctctattttctttcagagtatgctctattcttcctttgaaacatttatcaacacagatgattatacatttgtgtaattattcatctaattactctttccctcattagaccataagatttctgaagtcttatacatggtaactagcacgtagtacaaactaaacaaataatattaaattaatgaaatcccagttctgacaattatattatcttaggtaagtcatccaatttctctgagctttattttcttatctataaatatgggcattaatctaataattttatatattttaacataataggaatatattcacttttgcaaattggaaagcaccactcagatttaagacattatttttttttcttacatcaagattatgaaccaaagaacttttaaattgatcattatagtcttcatttagtcggcataggcatatccagaaaggcctcacatttagtactaataaagcttggtgtttaaggaatattatagacaatgaataacaatgattccttgtaatttacaactgaagttgatgccacatcaggtatatcaaaatcttcgttaagactatttcctttaataaagtttatgctaccatgttacataaaaaggaatcaactggtattatttagttgttctgtttatatggactattttagcaatttagaaaagatgtagggtacatgccactttatatgcaaatatgccttgacaactgtatgaataaacaagaaaactgtaaatatactttaaaagccaagatgatacaaatggccattcatgagtggacttactgtctaagttatttttccaagagtggaaattcattcatgttgatacacgcaattctcacttcattccctcttccaatgacaaggtgaggagatctatgtctagagcactttttatctaagtgaaaggagccaacaagtgccagatgaacatgactgtggtctcatcttttttcaccttaacccactggcctaacgggcctggacagcagaagatttgtgatgctaaaagaatttacttctgcctggatattttagggatttgactcctgtcaggtattgcaacaaagtcaagtgattcaatttaccaggcaaggacaagaaatggtttcaggaaaaaccaaggtgatgaactattgagcatccagttcattagctgtcatccatcttgacatcttcatctttcaagcagtactgcagaaaatcaaagacgtgtagtgcttcccttaaaaaatctgagaaggaaaacatatcctcttaaagttaaagagactgtgaagcctatttcaaatggattatgaaagataaccattgcctcaagtctgaaaatcttgatagatactccattgtaaatactacctgtgcccttaaacacactaatcttaaaaataatatcattaaaatatgtactgcatgaactgctagagtatttttagcttattctaatttgatgcattgtgcattttaatatgcagtaatagttacatgacaaataactgaccttttagaaatagcatcttgggggaaaaaaaagactcaagaaaaaaagtgtttccctgaaacatcagccaataaaacatgggcagtaagactccagtgacatagccaagtactggtaatatcaccttccttcttttgtttctctgctctgcttattcaacactgaggtactgaaactctggggtttttgcacttatatgcagagtttcctggaattaaagagtaatgtaagcaaccaaagacattaaagaagtgattcataaccttccccacctactattctttatcaaggggaaagtgttttatttcaagttcttgaaggcccctagaggtaaaggtgaggtgaaaattatgcttttcttctatatcccacatactactttattaatgctaagaagcactgtaatgttgccttttaattctctgctttctgaaacactcagtgaatattattccagatctgtagttactaacaaacaaaataaaattaaagactcatacattgttctctcctgaatttgccatttaaaacatctaagtcaggctgtgaaagaaaatgttaactcacggctcacatcatataagcaactagaccacaaaacctaaaagattaccatggactctcagaagcctttgtagtcttaaattattggaggacaactaaggaactattcaggtgtacgctttgcccatcggggaaagccctaggtgcaggtgactgaatggctgcttctgaagaacggcatttggtatctgagtaagttcctatacctacaaattacttgcaagcccttcagcctgaaatttcccaatatattattaaaactcttattatctccacactacttgctgctaccaccactaccaccatacactgcatgatttttggccgggaactataccaggcactttacataaggcacacatgtaacacccgcatcaactgtagaaagtaggggcattattatattcagttgatagaaaacagaggcaggtaagatgttctaggcttctgctaagcaaaacatggtccatggaatagcagctacaacatcacctgagagcttgtctgaaatgcagaatctcaggctcaagtccctgatctaatgaattaggatctggattttaataagatatccaagtgatttatatgcacatgaatattgagaagcagtgctttgggtaaatggaatcactcagactcaaactcaggggtctctagctcaaagatccagatattaaaatagtcagctcttcctgaagatgcaagacatctaaagaatgtaaaacattgaatacattcacatttaggaccaagtttttcatcagctgagaaaatctgatactgagaattacaaatttgagacgagaaaacgatgacctgggaataacagaggaaggagatacctggtaagggaatagaagagagccactgggaaaagaaattgggcttaaaacacactttgtgcattttggtttgtccatttcagtttggttaagggagttcttagccaaactgaacagagttttgactctgttcccaaaactctcggctcacctgaagtggtgcttgatatcagacaaccttactggggagctcaagagtgcttaattgaattattcacaagatcactttctcatgaaccaaccactccatatccagacatccctttgctgaatgtacatacttattcttcaagttcttacatcaatcagcccaatatggagctttctagagatactaactgcttaactaagtctgataaatgaaaacatctgtatgggtgaaatttttttaatgcaattttagttgttttttcaccaccatatataataaatcaaactatattaatccatcaggtatccatctgggatcagttttgatggtattcaagcctgataggtaattaaaatgttatttccatgcaaattgcatctgatcttgaaaacagtttcccttaacctgaaattggctaaacatttctctgcagtcttaaattatccaaatttccaagcaaatatttttgtttccataatagaaagggaaactgcaggtcattcatgaatcaagttatcataattaattaggtttagctctattacctttttatttaaaagctaactggatactactatttatccttccttttgtattacagtatttcataactgactttcatagtatccactctaaaatttgttaacactttgatgatacagtattttcatcttttattggaaaagaatttattgctactttcaagcatagtttttttctcattcattatattgttatcataaccacgtggcttataaagatatgcagacactaatgttatatcaatacttatgtctttggacttttcatttaaaagttaattgttgactatgtatttttttattgtgcaaactttcccaaattccacaccatagcatgacttgctaatgaatatatttacaccaagaaaataaaatgaactttgtataagtttctaatataaataaaagggaatacttactttcgaaagaaagataatttcctatcaatttaataattttctttcattttaacggtagaaattatacaccaatttcatgtcacaaaagaggttagagcttgtttttataaacaatgtttgttagattactcttgcccctatcagaggaagatctgaaaatgtaacaaagaagatatatttcatttttgtgcaaatagacatgtatataaagattaaaggctctgacagagcctaaaaatgaagtcctttatttaatgtactagaataatgcatgcattggcagtatgccagctttaaaattgacatagaatgagccttaacttctcctgcatgattcactatcaggaccagaaagccattcagcaatgcttgtcatgtcttgctatataacaaaataacccccaaattttgtggcttataataacaacaaccatcttatcatctgctataaatgtgtgggtcaagaattcaggaagggcctgcctgagaaattatctgtgccatatggcattaacagaagtcacttggaggtattctgctggtggtttggctcctccagagagctcaagtcagctttacctacatttctgcagtcttggtggtaatggctagaagaatgggctcagcaggacaattgaccatagcacctatgctagcccctctgatatggtggcctcagagagtggggtatcttttcatagagtcttggatagaaggtataagtcttctgacttagcatcacaagtcccagaatgtcacttccactgcatttactgactaaatgtaacatagatcccaagacagaaaatgaacatgcattaggtaaaaataaaagaaatctgaatgaagtctggcctgtattttatttttatttattggattattatttttttttttttgagatggactctcgctctatcacccagactggagtgcagtggtgcaatctccgctcactgcaagctccgcctcccggattcaccccatcctcctgactcagcctcctgagtagctgagactacaggcgcccccaccaagcctggctatttttttttaaatatatttttagtggagatggggtttcaccgtgatagccaggatggtctcgatctcctgacctcgttatctgcccgcctcggcctcctaaaatgctgggattacaggcgtgagccaccgtgaccggccccagcctttattttcaaacaaatgttgttgagaggaataaatatgacagtgtggaataaaacagaagctcacacacctacattggcagaaaaagttagatatgatcaataaattgttaaaccatttaacgtttttgccagagaaagaacacaataatttgaagaaaaaatttaaatatggtttctctgcctacaataaaatggaatagagaagagaatactcactaaagagaacaaaggtcaaatagcaagagaaaaatacaaaggcacagccagctgtagatccaggaggacaacaggatggtcctgagcagaaggataccagaaagggatgtttaagaggcaataggatactgcaaaccagatgagtctttatagtttctttagctgaccctgaaagcaagtgatttctaagttacaaactgctgaagagaagaggaactcccacccaaaactatatagtaagaagaaaaagacttgctaaataccatttaacttctgaaacaggaaagaatcactacatatttgtgataggcagactaatgcctgccaccaaagatgttcatgtctttctcccttgaacgtgtgaatgtattatgttgcataggagaattaaggttggagatgggattaagatggctgatcagctggatttaaaataagaagattaccctggattatctcagaaggcccaatatgatcacaaagctcctttaatgaggaagagggaggcagaagagccagaccagagagcaggcataatcagaaagactccattggtcattgctggctttgaagatagaaggtgtccataagccaatgaatgcaagcagcttctagaagctgaaaaggacaagaaaacagattctccctagagccttcagaaaagaatgcagtcctgctgacaccttgattttcatccagagagacccatttcaaacctctaaactccggaactgtaagacaatacgcctgtgttcttttaagacactaaatttgtggtaattttttacagcagcaatagggaactaatacaattgtgaaaaatgaggggaattggaaggaaaaaaattaaagcatttaatttgcaaacaattgttcaaacatgataaaaatgataatgagacttacaaaatatcttacaaatgaaagaagataactttcctgaaagaagataactatccataacacataatgattgacataatcctgtgagggtcatgacaaatatgctctatgaagtgttgggatttcagcttcctgtttcatttcatgtcagttttggcagatctggacttcagtaactagcagtgtgcctagtacatggtagaagctcaataaggactaaatccattatataaactaaaggggactataaagtagaaaaaaaaactcattatcacatatggcttgtgagattaggcacatagcaaaggaaggaagagagaagagagctaaaattatttggaataaaaaaagaaatccaattgagatccaagtgaaatgcaaatacatttctagtgagacatttttaaccattgacgaagcttcttagtttcagttgggtcttcatagcatcctgcaaaaatgcatggcaaagatacagctgaacacccaccagctgaagctgggctgtgattgttctggcaaacacataacccagagtaaatattgtcttgcacgaagaagtgaggaggtggattaggcattgtaattaccatttgctgggtatttggcattctttttaaagatttaatcatttagatgagacttagtatcactaaaaaaggagtcaatatttctgtgagccagggaggaacagcgctgctgttttccttctgctcagctgttacatgtgcctacagaaagacaacttcacctgctacttttttattcaagacagcacagataaagaatcatgagcagtaacttctttcagttcttttttcttcctgaacacactgtgttctcatctattattgatcagaaagtgatatttaaatagggtggcaatttataaaattgcacagggatgttattacattatcttaattaattttacaaccagcactcactcactgtcctttatagtacatctaaagaattaatgtgctgattaacaatagccaagcagactcagatagtagctttcagataagaacttctgttaatcttctgcttgtcaattggaatctactgacataaattgctttaatctgagttcctggcattaagcatttatagaacaacattttgagacactgattattgtaccattcctttggggcagtgcccctaaattttagtgtacaaaagagcatctggaatttgttaaaatccaaattatttagccctttcagagagatcctaattctttaggtctaatgtgggtccaagaatctgtatttttaacaagcattctgaaagtgtctgagccatggggtgaggggtatgtaaccaaacttgttttgcaatcgtatataaatatggacaatatttttgctgaaacttttcttcttttctttaaatgtccaagtccttatgtacatgatctcttttagtcctcacaatgatcttgtgaagtaggtattattatttctattgtaacaaagagacaaagggtttagtcacttgctgtctgtttgctcaggctgccataataaaacactatagattgagtggctaaagaacagcagtgtattctctaacagttttggaggcttgaagtccaacatcaggatgccaccatggtcaggttctggggagagctctctttctggtttgcaaatggctgccttcttgctgtgtgctcacatggcatttcctctgcacatgcatggagagatagagaaaatgatctctcttactcttcttcttataaagccaccaataccattggattaggacttcactcttatactgtcatttaaccttaataagctcctaaaagctctatctccaaatagtcacattggaggttagggctccaacatatgaacttatttgtgagagagggcggaatttagtccttagcccttgcctatcacaaatagtaagtgggatccaggatttgcaccctaattgccctgactccaagcccacaccatctctaccttaccttgcccctcttgccctctgggccattagcaagaagtagtgatgggctactcagcaacagaggcatggaggttggttagatgaatattcagtcttccattaactgagaattgactttaatgtaatcagatcacttcattaaactttaagggctgccttatatctggtgactatgactattttattcctgcaactttattactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaataatctatcctctcctcactgatttttaatgccatcccattaatttgatgttttatatggtcagtttctgagatctctattctgttttgtaataaaggtacaaaaataataactagatatcttataggcatgttatggctattattgctactttgatttttttgaatgtaatatttttctttgcttctgtattacaaaaatattcttaaatgattcttatatacaacaaaattattacttctaaaatctgtcagtaagtgctcttggattttctatgtacatactcatgcaaccattttgttctttattttccattccctacatacttttcttaactttattgcataggctaggacctagctacaataaatattaactgactgcatgcatccttgtggaagaaagcagcatttttactactaatttaatgctttaaattataatattagtatatttagatgttctcttcctatgttgatattgaaaatttatatttagaaaatcgttcagttagtctaagatttcaggttatttagcataacatgttcaaattcttctctcagaatttaaaaatcttcactagatctgaaatgatatctttttttatttctcatattgcctgtatgtgttaatgtgtgctttttaaattgatcgattttgccatgggcttgtctattttaacatccttttcaaaaatccatcctttgtattttgttagtaatttctccattctttctgtttgctattgtattactttgtgcttcttcttgtatgcttttccccttcccactttcattagaggttctctgctattcctcctctaactgcttgggttgaaccttcttttatttagttccaaatgatctatttcctgatatgtacattcatttttggaaacttcaattgaagtgatcgctgtatgccacaagtttttatatatactatgttcactgatttagttacaaatattgtttgatagctatttaacttgcttcattaactcatgaattatttagaagtccatttttaaatttccagctatatggggaagttggggctattttttatagttggtgccacattttattaaacttatttcatggaattttgtgcttcttcttttgcagtcatctagagtaataataccaactaacatttttcaagtatttaccatgtgttaggcactattctaaacagttaatatgttttaacttgttaaagctcacaaacgcacaaggtactatgatgatcagtaatttacgaatgaagcatctgagccatagcaagataaagtaacttaaccaagtaacacagctggcaagcggcagtgctaagacaagcttagtcaaacccatagtctgctcctataaccaccacaaaaaaacctacctctgaatttagtgtgctcgagaaaatggatatttgcgttttcagagcatgcagtcatacacgcatctgtcatatcagcttcagtgagttattgaagtcttctatattttttctaaatattttcatctaatttattaatttctgaggtaaggtgttaacatctcctatttggatagattcatcttattttgttaatgttttgctttgtacattcattttagttcataatgcatatttgatatctttattaatatttctctttatctttactaatggttaactataaattctattttgtctgatattaatttactataccactgttttttctttttgttctaatttacctggtatatcatttttcatttttaattattatatatataaacatatacaaatatatacttggttaacttactttatcttgctatgtgtggctttttttttttttttttgtagagacaaagtcttgttatgttttccaggctgttcttgaacacctggcctcaagcaatcctcctgcctcagcctcccaaagtgttgggattacaggtatgatccactatgcccaggacatcagtacctttaaagattaccttcccatttcattcctatccatttcacagtttcactgtgatgtttctaagtgggcctggttgttccttcagtctgggaattcacttctctactacatacagttacctacttggctattgcctctccttcattatttctatactcttattctggaattcctgctttagattttttttattctatcctcgacagctctatttccatatttctaggtctacgtattccatcatgggtgatttctttataattaacttcaaactcactaattacttaattagctgtctggtccattgtttgtccaatctattgataattttatttctagaaatttcattttagttcttcataactgcctacgaacctttaagtctatacttatatacatatatacctatgtatacatacctatatatatatgcctatatagctttaagtctataccttttaagatatcaaatttattttttaatgtctcagattattctatatttctagacttgattatttgctgattctacttcagactgattcattttctgatattgcaattttttttactatgagctgttgtgtttttattttgttttggcagttgttttgcatgaaaccatccctacaagaaatcatttctatagtacaatcagtggtctcttctgctgggaccccatatatggtagcagttacaggccaagttttgcattattttctctgtttgggattcctacacactattgtgagcatagtgtaaattcagagcctactctggtacagggcacagatgtggtcttgccaacccatagccctggacaaataaccagttttctttcagcttcctaaggctgtggagactttttagtactgtgtttgtgagctaagcagaatcctagctctgagatttgttcaaggagcttggctccaattccaaacccagcttcagcatccagtattgatttcccatgtcaacttttgatacttcctgagctctcttcactgagtttcttctttgtttataaaacttggtgatttatcttagttttagcctttcttggtattggaatttttaatatcatgctttttccagtgtttacataattttggcatggaacaaagaacctttgatgtcacatcagttcttcatatcacttttggtgtttccaaagatcatccttaggctttattcttctaatcaagaaagaacttttattttggtaacagctttatagagatatacttcacatgtcacacaattcacgcatttaaaatgaacaattcaatggcttttaatatatacatagcacagctcatctatcaacataaccaattttagaacgtttttattacccaaaaagaagccctattccccttacataccactcttcaatcatcctgttcccgtcccttcaccatccaaccctaggcgatcactaatttacttttcctctttatagatgcacccattctggatattccatataaatggactcataacaggtggtcctttgtgacttgtttgctttcacttagcatcatgctttcaaggtttatcaatggtgtaacatctatgagtaatttatttttattgccaaataatattccattgtatgggtatgccacattttatttgcctgttcattaattgatggatattcgacttgtttccactttttggctaatataaatgatgctgtcatgaatattcatatacaaatttttgtgtgtatgtgtggtttcaattctcttaggtacacagctaagagtagaaccggtggaatatatggtaactttacttaactgtttgagaaattgccagactgtttttcaaagtggctatagcatcttccattcctgccagcaacgtaggacatttccaatttttccacatccttgccaaaactcgttatctgtcttttttataacagccatcctggtgggtgtgaagtggtatctaattatggttttgattttcagttccctggtgactaatggtgttgagcatcttttcaggtccttattggccatttctatacttttctttggagaaatgtctgttcaaatcctttatccatttttaattgggttgtcttttattgagttgtaatagttctttatattttagctacaactgccttatcagatatgtaatttgcaaatatcttctcttattctgtgagttgttctttcactttcttggtggtttcctttgaagtatgaaagtttttaatttcaatgtcccatttatctattttttccttttatttcttatgctttttggtggcatgtctaagaaaccattgcttaatccaacatcacaaagatttatactttttttcctaagagctttatggctccagatcttacattcaagtcttgaatatactttgactcaatttttttttttttttttttttttttttttgagacggagtcttgctctgtcacccaggttggagtgctgtggtgcaatctcggctcacagcaacctccgcctccccgattcaagcaattctcctgcctcagcctcctgagtagctgggattacaggtgcatgccaccatgcctggctaatttttgtatttttagtagagatggggtttcaccatgttggtcaggctggtctcaaactactgacctcatgatccacccacctcggcctcccaaagtgctgggattacaggtgtgagctaccgcgccctgccttgactcaatttttatatggtttgaacacagtggtaatttttaaagtggttatcacctgtaacagtcttctctaaactaaagatctgacaagaaaatgacatgatttggggcgtattatgcataattggtatcacagcaatattaggggatatgagacatcagccttcctgatacttcgatctctttaaaaagcatggaattataaaatcttagttcaaagtcattggtctcttacatatttccaggtgtgtgttttcctatggttaacagaactaaaaggagacattattgtggcaattttgatataaggaggtagtgctgtcccactaagaactaaacaggtcagcgagttctcaccaatctgagtcactagtatgaagggctctgaggaaataaaaaactcatttacataggctaatttcttacactgccccgatgcagccttgttccaaacattcgctgttgtgatttacaagaaaagaaaaaaagtagtaaattgggcactttcttacccaaaccactgtaggtttatttgacatttagttgtattgactggagacttttataaatttctggaaattgatgtcaatattttcaagtaatgaatcaccagcaaagaagaaaaagcagaggtgctttataacatggtaaatcccagtaagtaattcttgtctgcatttctttctatattgcagtatcaaaaaaatgagacattaaaggaggaagagagaaaacgatcctatcaaaacggtcagttggaacaaaaaataacaataatgccaacagagaaatgagaggagtgaaaaaagcagaggaaagccagagaagaacagaaatgagaggacagaggtgaaaggaggagacaagacaagaaacccaggaaaagatgttgtcatctacctgctttaaaaagtgtgcagtgtttgaaccagggccaaggtcttaagtgggattcaagcaaagtaataaatccataatgaatctaaaagtatttataaagtacctcaatattagtaacagcttacagcagaaaaaaatatatgatcaggacctaaggatactttctatcataaaatgttaatcagagaaaaaatgaagtgtgaaaataaaggtgtgaactctagcagagagcatggtaagacatagagcttggctggtaccctctgggcccccagctctcaggctggtgggtgagctgagtgctctcaggcacagggccaggcttagaccctgatggcagcaatccccatcctgcctgtgacctctccaagccagacccactgggccacagctgggcccccaccatgcccagagtaaacaacactactgtgtgaagggcatggaaggctgggaagaacacggcaaccccaacccaacaggggcatcaggagttgaaagagtgggccagtgtggactcgagctctagctgctcagcctcaggctaaggagctgtgcagatcacagatctgaggtgaccactgtgtccctagtgaacaagatgccactctgtactgtcccttaaggggcctagaaaatgagctgagactacaaaagttggttaatcaacaccagaccttgatgttggaagagagaaatggtagaacactgtgccacacttggccaacaggatgtgtctgccatcctttgggaagattaagtagacattaatagaagaccagtgtatatacacataactcagagatagtgcacgttttgttctagactaccacaataaagtgagacacatgaaatttttggtttcccagtatgcatacaagttacgtttacactgtattatattagtctgtgatagcattatatcagaaaaacaatgtgcatacctgaatttaaaaatactttattgctaaaaatgctttcagcatgagcttcagcaagtcactttctgctggtggaggttcttgcctccatgttgatggaagctgaatcatctgggtggtagttgctgaaggttggggtggctatggcaatttattaaaataagacaacaaagtttgctgcattgattgactcttcctttcacataagatttctctgtagtatgcaatgctatttgatagcattttacctacagaaaaacttttcaaaattggaattcaatcctctcaaatcttgccactgctttatcaactaagtttgtaggaaattataagtctttgttgacatctcaacaatgttcatagcatcttcatgggaaatagattccatgtcaataaaccattttctttgctcatccataagaagcagctcctcatctgttcaagtttgataattatattgcaacaatccagtcacatcttcagactccacttctaattctagttctcttgctatttctaccacatctgcagttacttcttcccctgaaatcttgaacccctcaaagacatttataagagatgaaatcaatttcttttaagactattttgccctcctcccatgatatattgacttatttccatgaatcatgattgttcttaatggcatctagaattatgaattttttctagaatgttttcaatgtacttttcccagatccatcagagaagtcactatgtatgggagctatagccttatgaaatatacttttgtaataatcagatttgaaagtcaaaatcactccttgatccatgggttgcagaatggatactgtgttagcagatacaaaaacagcattaatcactttgtacacttccatcagagctcttgagtgaccaggtacattgtcaatgagcagtcatactttgaaagaaacctttttttctgggcagtaggtttcaatagtgggcttaaagtgtttagtaaacaacactgtaagcagatgtgctgtcatctggctttgttattccatttatagagcacaggcagaggagatttagcataattcttaagggccctatgattttcagaatggtcaatgagcatacgctttcacttaaagtcacaagccgcattagcccctaacaagaagatcagcttgtcctttgaagctctgaagccaggtattgacttttcctcatagattaaaaaaaaaaaaaaaaaaaaaaaaaaaagtcctagatggaatcttcttctacattgaaaatctaatgtttagtgtatccaccttgatcaatgctcctggctaggtcttctggaaaacttgctgaagtttgtacatcagcacttgctgcttcaccttgtgcttttctgttatgtagatgacttctttacttaaacctcacgaagtaacttctgctagttattttcttcggcagcttcctcacctcgatcagccctcaagaaactggagggaattagggtctttctctttattaggctttggcttaagggaacattgtggctcgtttgatcttctatgcagaccactcagacttcctccatatcagcagtaagcatggttcgcttgcttatcatttgcctgttccttggagtagcacttttaattttcaagaattttccctttgcatctacagcttggctctctgtttggcgcaagaggcctacctttcagcctacatcagctttccatgtgccttcctcattaagcttcatcttttctggttttttatttaaagtgagagatatatgattcttcctttcacttgaacatttagaggtcattgtagggttattaattggccaaattccaatattattgtggctcagggactaggaaagcctgaaaaaagggaaagcaatgggggaacagcaggttgctgaagcagtcagaacacacacaaaatttctcaaccagagatagggttcgtagtgcccccaaacaattacaacagtaacatcaaagactcctgaaaacagatcactgtaacagattttacagtaaagaagtttgaagtattgtgagaattaacaaaatgtgaaatcaaaacactgagtgagcacatgccattagaaaattggcactgatagacttgcttgatgtagggttgccacagctcttcaatttgtaaaaaatgcaaaaactgcaaagtacaataaaacaaggcatgcctgtagcatatgaaagagctgcactcaagtttccccccattttttgagaggaaaacttattttgctatatcttggccttctgtatgtaaagaagttctaaggtatgttagaaaatcccacatcttgtaaatgtcttatttaaaaagaggaagaaagaagaaatcataggaaagaaatgtcttctgaaaatgacttttggatatggaattgtgagaccatctctagaagtgacaccaagagacacacaagtccatgttcactcactgggttttagaggagatggaaaagtccacaaaaatgaatagaatcgttctctataagcctatgccaagctggtcacattttgaagatattttcttattatactcattgttctgtgtatgcattttattcctaataagtgtacaaatagttaacaatgttaagtacttttctgaaatactgagtctttatagacgttccggagtgccttatacatgtttaaggtagtaataaaagagcacattttatgaataaccttgataaaattcatacgacatttgtcttttggaaatgaaataatcaaatcacctttctgagcagtatacattgtatgtgtgcactggttcagggaacaaggcagaagaaagaagaggaaaaggctccatgccagtcattttatagtaagccaagattagccatcttatcctgaatgttctgtgcattttattttactttgttctctatgtggtatacataatgaacaaatgagtcaattttacaacatcttgtctttctagttgttaaagagcctgccaatatatgaccaaagtagagtttgtaaactattttgtacattttgcgttatatggtaaagactgtcttctgaaaacaacttgagaatatgaaattaaatccatctctaagaattatagatacttgtacacatagtaaatactagaactgttaaattaaaagcaaagtgttcagtaaaagagacaactttgtggttgatcataaactaaaatacttttaatatatatgattcataagatgtcttacgtttgccggttctaaacatcctttatattttatcatttgcatgaagaatgtgcagatattgccagcccacacccagggaccctcacagagtaaacttgtgtatgtctataagtgatctgggtgtttggcttgtgtcttggcatgaaagctactcctgctcttgatctttgcatgtgcataggatggaaggaagggaagggactctgctgttctcaggagaacttcaactctatgtctttatttttgaggatgagcaaactcttcaaagggctgttctgccctatctcttattttctgctttcctaacctttccccatttcctcttcattctgaagtgctaagaacgtttgagaagctggaggacacatgcttagaaccatagggaaaaagccattcacattccattgtgtcatcagcccagacctctttgtcttacccagaggccacttcccaccaccaaaaggaatattaggagtattaattctttccgctactaagacgttgtttagggtaccctaaatagcagtcatcgaaataaatgaagcctctattttaaagttaaagggacactagcactttaagctgtttggtacagtgtttttaaagtatggaaaataacactcaccttcttttgagaccatgttaacatttttgaaactgtgcattattcttttcagtagataatacatttaaggtcagaactatgctagaatatccagattccctgcagttggtgttctgccactgaaacctcaaaaccagatactctcagcagtgtactgcatatattacacaggtgcatcaaagatttatcactcctcttggtccacctccgggcagcatttcatcatcgaagaaaataaactcatttgagccgctctttaatttttaaaatgaaaatctatatccatcaggcatatgtcatagtttcagagtaagaaaaagaagataacttttgtgaaatgtctttttttcctataaacacaattacaaagcactcaacttataaataacatttattttatattaataaaaagaatttagcaaattcccagtattatgctaggtgttcatactctctactccagtttaaaacacacacctgcgcatacatacacacacatacagttttaaagatgcatttttcctcttctggaatgtgttactattgcttcacctttgataactttcattggggagcacttttcaacttaacttgtgtctgcacagtacattcaatgtggctttctgatgaaattgacaggtcaattcaaaaacaaccatattcattgcaatttttttctattccgaacatgaccaaatccaccaagcatattagtttcccttaaaactaaagaactttttaaaatttaggcttgagagaagcgaaacttattttaataactgaaggaaaaaacggttgatgcttataaactgtgtatcagattttggcctacgtgttccatatctatattatctaatttaactctcacacacccttaagatagtaggtactaatattaattcctgcctgtgtaacctaccattcagagagtaaaataacttccctaaagttacctgaacccaggaaatctagctccaaaatcaaatgaccaatccctatcctatacaacctctcaagaatgagcacatgtagaggagaataagcagaaaatatcattagttcaaattaactggatgtaattgagggtgaataagccaaaaatgtgaatctctaagtacctggctttaccttttctagagttttctttgtcttgagccatattctatgttcaggctctcaacatggcaacctattgggctgagacagatagaaaatgcatccatgatctcaaaaagtaattggcctcacctatcccgaatgcataaaaagtctgctaattatgacagaattatgtggacattcaattgttttttaaattttatattctaagtcaatattttgtaaatattttagaattagtaagtagtgttattcttaatgggttacccctgccatgaatattaggaaaaatatatataaatgtaaaatttgcctgcatacatttttgtttctgaagaagtgttagtcactttcattctttaaatatcatttgtgttgtcaaattcccatgttttttagctttgccctctttcctgagtttcttctctaactgcctgatggaattcttcacctggatacccatcatgctttcagaatcaacattcctgcagcctctaaatcattttggattaaatgcattctcaatgattataaaggaggtgcatgactggggtaaaataaaactttttaaataataaattttctgacacaagttcagatgtgacttatataagtcattgaatcctaatttcagtcatcaaatatggaattcatccagtctactagcttcattttacaaacgaagaggctcagatcctgacagaaactgtgacttgttccagatcatcatgaatttgtacctggactgcaactagaatctttaatcctgatttttttaaataataatgatggctgttatttttccactgggcataccatgactcagatgccatactgacattttactttcattatctcatttaatcctcaacacgaccctgtaagtaagcatttttattcccatattacaattgaggaaagggaagctatgggaggtgaacctattcattaaggttcacaaagctagaagagtcagaatcccaaaccatgtctgtctcactccaaattcccttgcttcagtaagcttctctaggccaatgttccttctgcattgcccattttcttcctatgaatgcaaattacataaacatggaagtacatttgaccattttaattgtttaacagtccatgttgcaggaccttccacaatagaatcaatgtattaaaatgtgtaaatgaccacactttttacacaaatgctatgaatccttaaggttttccaatttataaaatatgtctgcaaagcatactttatgatgctttgtattctgtcagtaattggatgtcatatatttaaattctattaaactgcttattaaaatgtccagtgcctcttttcttgcatggccacaaatattgtcactataaatcagcacctttcaaagttagtttcatgacaactcaagatacttcaaactaatttagaaagtctcaaaataattcaaaaataattcatttagttaacatattttgtaaatatacatattctatatattaacttgaatgtggaataagtcaaggaagagatatcaaatgtctttaaaaggtattacaactgtaagtaatcaaagaaggaaaaaaaaaaacaaacagaataaactgttaaagggccagaatactaggaagaacttaaataggtagtaagcaatacatacttcctcacctatataatatcaaagagtttgggatacccacagaagggactgtgaaaacctcttagaccatcctccgcattggtgtctccttaaatcaatgggataaatactgaaaatcttgtccaatagcaatccaatttaagaagtcaccataggtatgaatagcaaacaattatatgttccccatcatggctaaatgtatcttgtgagccatctacaaaatcaattattcagcaattcagttcatttcattgagacaatattaataaaaggatcaaaagaactatcgtctaattatgtcatacacaataaatcaccaactatttatcaaaaactgttctttccattctacctctgtggttattgccttaggtcagacaccatcacttctcacctgaattaatgtattaagtttttaatgggtctccctatctccaatctcaccaatcccagattaccctttaatgatttcacattaccttgaaaataactaggcacttatttttgtgctctggtacaaaaatgcctttgtctgttgccacacaggccattatctcatggaaaacctgttttccagctgtgtcgaattcagtagtattcatagacccaacacaatctcttcttgtctttaatgtgacgtttatcctgaaaagagtgcttttctctcacactccctgtatatctggttggcttatccttgaatatcctactcaaactttaccttccccaagcacagctttccatgatctcctcaatgctgagctgcccttctctgtgctccttttgcaacagctgccaagccatttcttacatggcatttactgtctcctctcccagaacaatttcttgaggctagaaaccatgtcttaattatcttgtggcctagtatctgaatgtctgcaatatggaaaaaacgctccattggtgtttgttgaaaggatgaataaataaacatttcctaaaattgcctgatactaagaatcgctcaggtgctaattaaaaattcagatccccaagctaagatttatattgaccagtatgaattgaggcagaagattctgtacatttatcaagtatcccaaatgattttcataatgaggaaactgagagaatttaatcataacggataggaaaatctgtctttgcatgaaatttctctgtcctctgtctacgggttacttgtttttgaggtatccatgaggatactcctccccctttatctgatacctaactgtgctgtgcaagaaaaacaaaacagtttttcgtcatataagggcatgaggctaatctatccttagctcagaatataaactcagcaagggacttagatatgatttcaacattgtttgtattctttcagctagcgttttcaatgtggcctaaaaatgtcatgactcagagtacttattcgtagaattgcttcaaaattttatctaaaccactaaaatttcacacctggcattgaaactacctagtttgcctgcaagaactccacttacttgggaaatatacagtacttgctgagactaacttactgtgtaatgctttatcctataactctaggaatacaaactctttaaaaaaaaaaaaggctgttccatgttgcctctattcagcataccttactcctaatttcctgcaatattcttttcacctctactactcagggcaaactttttttctcaaagtcacaaagaagctctgaattaccaaatctaacaaatttttttcccatacccattggcttctaactaacagtatgagacaagcctttcttcaatgcccattccttgttggattcctggccttcctctttctctctctgcaactttttggtctccttcataaacgtattcttttgttttgcctgcttctaaatatgtttgttctattttggaatctaaacttgttggcctagcagtaaagttcttcaaagtttgccaatctgtttggatcttatcacactaaacacctctccatgtatcctacggtttgagctggcactcgtcagatgtggttttaaaatgtatactaattaaaattaaatagaataaaaaattcaactcctcagtcacactatccacatgtcaagtgttcaacagccactagtggctaccatattggacagaacgttcatacaacattgccttcatggacataagttctattggacagtgctagtctagacaactggactactcaaatttctcatctctacactttagctcattctattctctgtctacctgaaatgcggtccaccaaccatatctcttcctattcagatatgacttgttcttcaagatttattcttaatatttacctgtctccaaagtctttacttatcactctagctgaaagtatggcagcccacctatgaactctcaaagttgtttatactactgctcttccccatgttgttttgttctgtcattattggtgcaaatgcctgctttccttgatcagagatataatctttgaagagttgattgatagttgccaactgtcattgagcactttgaacatgagaagttaagtgcttgatcatacttctcacatcctcataactcccctgtgaaatatatgatgttttttcatattcacgttaaagaaactgggatttacaatgatgaaacattggacaaattaaggtctcaggacaggaggtcacggagtgatgagccctgaattactctaggtgggtttaactccaaagcccatgcccttacccaggggaacacactgcttcttgagatctcattcaccatgttaatgaccaccccacagccccaccacctaacgctaggcatgctccatttgtgaatgagtgaatagatgactaatactttatatgcttatggtcatttacaattcacaaaacttgttgacagccatacttgatttccatatgatttccccaacatctctgaggcagctccataggaaatgttatctccatttcacagaggctgagagagttcagagtcctccagaagctcacattgctatttagtaacaggcatagacaggacttcagcctgtgtgttctgccttcaagttctgccagcctttcttcaaaaccttctgtgagtttaaaactcatcaacaatcagcaaaggcttaaagagttgttgtatcttaatatatcgtcgtcttcttcttttttttttttttttttgagacagagtcttgctctgtcgcacaggctggagtgcagtggcaccgtctcagctcactgcaacctccacttcccgggttcaagcgattctccagcctcagcctcccaaatagctgggattatgggcacccgccatcatgcctggctaatttatttgtgcttttagcagagatgggatagggtttcaccatgttggtcaggctgttcccgaactcctgacctcaaattatccacccattttggcctcccaaagtgctgggattacaggcatgagccactgcacccagccttgagatactgtcttctaaaacttgccctttttattgtttaaaaaacatgatgaggccgggcacggtggctcacgcctgtaatcccagcactttgggaggtggaggcaggtcgatcacctgaggtcaggagttcgagaccagcctgcccaatatggggaaaccccgtctctactaaaaatacaaaaattagccaggcacagtggcgggcccctgtaatctcagctactcgggaggctgaggcaggagaattgcttgaactcagaaggtggaggttgcagtgagccaagacggcgccattgcactccagcctgggccacagagtagtgagactctgtcttggggtggggtcgggggagggggcagggaggaagaaaaaaaaaaaacatgatgaggcttaatggtttatgtctaagggaggggaagaggcaatttattcaagttttcagtgcttttaaatagccacatatttcaatctttatcatattgtttttgccctaaccctattaggataacttgcttacattaagcaaaattctgagaatgttaattagcaatttagctatgaatatgcatgattatttttaagtccactaatattatgcataggtcttatctgtaattatatctaaatgttctcttttttctctccctctctctttctccttcaggaaagccatttaaaacacatttgggaaatgtttgaaaaaattaattctattacccttatttccagaattttcttaaatattttatggctatattttttccttctcaaggcaaagccgtacatcaccacatacattatcatatttgtttacaaaatatgagagtcaaggaattaattttacaccagttaaataacagaagaaaaagttatactgtattttcttctttattatactaattttttcacatccttaaatggttttatattttgtggctatctgaaattatatttaagggcgagtattatactaccatttgtttcacatccaacttggagcattgcatatttgtgtagacatataaggttagtcaggggtgagagataggaggattaaactcatctagtttgcgtgccctttctcagtcacaatgcagtctttacaaacaattttttcctttaacagaaaaactgaaaaggtgtctaaaaaaataatttgccttaagacaacctttctaggaaatggtgaagatctgtttcaaacccaggcctgcctcatgccaaagcctatgaccttttcactattaatgaccaaatggttgaatgactgttaaataagtctcttgggtaaaacataaacgtgcctgatacccattcattaaaatgtttattagatgaataaataaattggtggatggagctcaatataatcagctcatgtgcctccacaccaaaagagaacattttcaaatgaacatgcaggaggaatacatgattacaaaaatgcttcagcaatgatttcgcttttataggattacttgtcccaagttcaacagtcttaatgcacatgcaatttgcttgaagtctataatgcccttggatttcaagctgaggagtctgatcatctggaaactaaaaattaaggatctgaaatattgttaactaaatagattgaactaaaattagcctcttaggacttaaagtgcttccacataaagtccaagagctagaaatgagaatgatgttctctacaatcaaatattgccttaattccaaatttagcttctgccacttgatctaatgttacatcaaggcatatgggccctctgcatgtgaagagcttacaccaatttaaagcaaatgcatcacatgggcaagaatgcaaattccaatagtaataatgtttctttcactatttatttcattccttatttttcatacttgttgccactttgtgaacttgcctccaatcactttacactggcttattttaaaagccttttaactgttctccttactgtcacccttttttcctaattccactgttcctacaaatggttgctagaaaaatcttccccaaacacagcttttatcacaggctcaaaaacctatcacaattctctaatgcctggtctataagactcttaaagtctttcccccttctcaccagcctagtctttccctgaggcagattccctattaagaagaaacaatattttgctatgccctgtattttcttatctgtgccttttggcatgctagtgctagtgatcctaatgtagagctttcaaacatgctttgaaaattatctttgatatattttcatatggcctctgtattagtcagggtcccagaaaaaaaaatagaattcatcccagagtgttcaaataaagagattttaataaaggagttatttgcataaattgtagacagacttaaggagcaaacaagatggcagggcacccaaaggatagcaatggtgagaatataatactacccttagggataaacagtcaaggaaaaggagcagtgtttccttaggagccctgcatcagaagaggtacagaggagaacagggtgaagggagttatatcctgaaaggacatgatcacggccagcgcacaggaccgaagtaggacatgaagaagaaatatcctgacctctttctcttcctgccctccaatatcctgctagagccttccataggccccacccaagataaacacagagagcagagagtcccagtcatgcaaatgacaagggtcagcttcgcagagcacagggaagacatggaatagtgttgagtgcatgggggcatggcaaatggagaacaatttgcacagtctgagctactctgtagccttctggaggatggcaatttctgagatatcccacatttggagtaagagaacagccacagacctcactctatgtgtcactttgagcaactttgcttagttagaagctatttccttacctttaatataagagtaatactcagtttgtataatagtcctggacatccaatgaaaaactgtgtataaaatatcttgtcccataagtgctaaatgaattgtaactactgctgtgactgactaaataaaaattatatatgtataagtataaaacctcttacaaaacatgtaataataaaagaatgagtcataaaagacaagaatcaatgagtgttaatggtcacctttgttgctgacctctaaactccatcccctggccttaacaaatatggcaggacatcttcaggatttggcaggcagacaattttatcttacactagtgacttggatgccattcctcttccttccactcagtaacagacggtgccctggacagcagtgacatctgcagccccaagggagaagggtcagcacaaattttaattttgcttttggtttggggctttaagtacacaaacaggttttttttttccctgtcagtttgcatctagcttcgcatctgacattttttaatgttttatgtatttggattgacctagaaatttatagcttcaggtttttgcttattttgctctgtctctaattcaacctccttgatttaaaaataaaagccaaaatataacatgaacaaatactctatttgtctgtatcactaagggggtaaggaagaggtcattctgctctttttgagctacttcttattacaatatattaacatttgaatatcttcaataacaagaaacaagaatactagggataacctataaaaacctgagtataatttgactcatcgctaaaaaaaacttaaaagctaagaggagaacatttacaaaaattgttatgttcactgacaaggcattagatttcagactaattgctgctatgagaaaaatagatagatacacacatacataaagctttatttttagaaggtcaagtatctacaccaaatgtttcatcctccagagttcagtttcagggaaatctctacaataggagagcctcctgatgtttgttgtggccacatttggagccatcaaaatttcctactcaggcatcccacagagaaaaagcatctacccctaagaatgtgaaatagtatcctcattactgagttgattactcatcaaccttaatagtatttgtaattcgcctttaccctggggcagttttcaaaggtcacagggaaggctgaaggctgtgtctataagacagtttgatcaaaatagaactaaaggctggcctcaggtagctatttctgagttggtcagaggacaatgaaaactacagttcatgcccaaatgttctccttggtcaaggggagactggctagacagagtcagatcttaagggtcatttctgattggcctccatccagagtatgacaacaaaactcgagaagcttcgcagataaataatgatgtaactaatttaggtgtttagataaatcattccaagtctcttttgtctgcttaggcctgattttcctgggctaggtaaacaccctgaatttacaagagaatgttcagcctcattttaactatgcaactggtagaagaagaagaaataggccttcttctattttgatgctagaaagacaaataaaacgacatgcataagtcatttagagtagtaaagcaaataatcaacaattcacaggattgaattgtatgataagaagacatatggaatttctcattctggttcttttctttgtcccttttgtaagttacttactcaaattgattacagcttttcaatctgtaaaaaagggatataagataaataatctctaatattccttctaactctataaaaatagctattgttttatgtatcaagaataatcaaagtattttttttagattgcagacctatgttctcatgagactgcatttcagatggattggaagcaacctaatatgtattcaaaaaccagcaccagatgaaaggactcagccagaatcatgcaaagcagaagaatcaaattcacagagacagactaaactttttaactaagactatcatgcaattatattgttggtatatcccatgtctattggttgtatatgtatccaaaaattaggtttagagatggatgatacacagattagataaactgataatcaatgaagaaatggaaaaatagacatttttaagcacattttctgaaatatcagatgtataaaatatgtgtattcatgaaagaaataaaattagacaggagacaaaacagataatttagcaagaagttattaagggtgaataatagtattcagatctatctgtcataaggccctacaaatactaaaattagctgtgatttttttctattagttccctaggattctgctaaaatcagcatcctcatgagcactggttaacactatggtgtaaatcatttgctgatgccataaattaaaaacaaaacaaaaaactatattcaaagtaactgagctataggaacatctccttaaaagatggaggcattaagagcattttccacaaccgagaactaaatgtcattcacctgtgaattaaaaaaaggaaatcacgggggaaaaatgagcagccagatcaattgcataaacctttgtcaaagatagaaatgtttatatgggagttctgtggctaaacaaaatgcaaacagccacatattttttcaaccaacaaatggatatcagtagcttaaataaactctttcatctttttatttttttcatccttatccttgctttaaaaaaatggaacacagtatttgttgaagattttatgcacatattgcatcatagcccaatttctcaaactcaaagtcaatttagcaaatagaaatgatagcagaaaaaacatataatgtcctgttgggaagaactgtctttcattgtagtgtgaacttaatgactgcatcacctaccttgaagtattttttaggtctagttattcatttaacaaaggattatccagtgccttctatgtgacaggcacagtggccacaaagataagcaaaaagatatgctccttatcttcatggagcttacaatttaataagagataaatatgcatcaaacaaccccacaaataaatgtacaactgtaactgtaataaaagctaaaatgagtatggtgcactatgggcatacagtagggagatctgacctaatcagagagttaagacaagttaggggccttgtatcctattcctggaatcttgctcatcagcaaacagctgaaggaagtatttgtaaggatagtatatccctctgtacatcccaaagtcctgtcctgtgcacagccactgactacatacctctgcatccaaagcagactcagctttcagctggccttgctgagagtgagcccagcatatcttggaaaatgaattcaccacactctggcacaaaccccatatcatccaacagcttcttcaaccagagcagctcagtcttggtccttatccatgaatgatggttgcagaaccacgctggctttacagggatctgggtaggatccattgcccccaccctgagtgtattcatagtgatgtgctatatggtttagaagccttggtaaataagtcaaggtagaactgtctcaacccagaactttcttcaggtaagaagtatgcttccaacagaagttcctaacaggaagcagctatcaccatcaaaggggagtactgaaatcattccaagactaacccccacagtctactcttttcttccctatcatctgtgcccctaaagcagtcaggagagttccctagccagacctaactcagtacttaaatatctttgataggcctgggaaacagaacacaggaagaaaagtcgtggcttttcaccccagcagtggaatctattcttgttttttgtagcatgagatgtttacacctaaggaacagaaagtgaacttaaaatgtctttaattaagaaattaggtttaaatgattccatataacaaatctgatttaattttaaatttttgaatacatttactcattcaagaatggtttcaaaccctccaggggtgagataaatggcaattctagctatcttctaccttcaaatataactttcctgaaataaaaacaggaaatccaatttgtaatcacaataaagtttcttatctaaatccaaaggccagtttttttccccttggaaacataagcgcctgaagcaggggctgcattttgatattctttgtggcacttggcacagtataatttctatgaaggtgccttgtaagtagcctggggtgattatggtggtgtaattttcatcacaaccacagataacccaggtaactgtgcaggtacaatgacgttcagcttaagtggctttgttccaaacaagggcctctattgtaaaaacaaagcaggtgttaaaacatagagatattgaagataggggtcattttacatactaacatgcactgaaaagtaaatctgagcttccccacattattgccaggaattacggtatacttaagatgaatccattaagtacacaactggacaaatgatgaaatttcatgttagcaaaattcctgacatatttcacacctcttactctattaaattacacttttttaacaaagaaaagctttcctactgctacacattttcaattttttctcctatgtatttcatattaaaatttcaaaataatttgatcagagatctagtgcacaaaggtgcctaagtgaacaataatcaccaaaaacacttgcaatggctgcagtagtgggattcccatcagtgatgtcaacagtgatgccaagaagacaaaagaagagggaaggagctaataacaaaatccatagaaaacaggcttcattaatttctgaacaggctacataaatccattaatgcctacagattaataacatggtcatataaatgaagttactgcctacgtgttttctgaaaaacatcattgctaattcatcttatactgtcaaaatttctttatccaaaatgtatatatttttgagtaatatcttctcaagaaagtaatactttcttgtaatactcaagaaataccctcaattcccaagtactacagtttatatgtgaccagtttttgatataataaaatatataaaatgtaaagttaaaccttagatgtctatctagtgcttattctgagtggcaatgaaataatgtaatagaacacagcaaaaggccgaaagaaggaagagctgtattttgggagtgcagagaagtattacttcagaaatgtgtccagacaaagaaaactcattcaagggacgtggataagggccaggtggactaaggaagaggtaatctatctgggtgtctcaaaaaggaagttttcattctggaatctgaaaagaggatgaatgcacctgaaaatcaaaccagcagagagtgtttcaagaagtagagttagagagaaagaatcaactagagataggtacatcagacataggaaaggaaacgtgtagctaactgatagcttccataaagacaaattgaataataagactgtgtatggtttacaaatgcaggcagtatttttctcgaggtgtctttgtagtgaatctactatctttatatttgccatgttaaagatactactgagctgcccagagagcagtcaaggaaaaagatttttggccacagggctgtggtccttgagaaatcctggagttcctgtgtgcttaggaagttatcagaaacagaacatgttgtgagtgtctgtgcttgaagtgaaagaagggagatattgagaacagcaatgagtttgcccctttttgacaaatcttactctctgcttatttatatcaaattatcatcatcatcacccttatctccagtgattacccaagtctcttgttcacactcctccaaactgtctacatatacctccccctcgcaatacacactgaagttattaagaattgaaagaacaaattgtttgcccatcctcataatcatctgtcctaaaaggtcatttaaacatttaatcaaacctgcagttctccaggggaacgtgtgagtcatgccgttcatcccacacactcaagcggggctttgtgtcagtcttaggaatgatgcagactggtcccacaaagaaatcagtcacagggacattttctgtcattaggcagagaacaaaaagctaacagtttcctggactctactgaaataaacttttgcaccaattaatgaaacccctatggaaagcatcatgccagaatccaaggaggctgtccatgtattgacatgcaaactaacactcctgcaaaagagggggtaggtgagcatcctaagtcaatatgaattatttgtttttctgctactttggatcagctataccactgctccctttcacaggtacaaatacacaaaagagggcttctgtttcataaaagtggctctgacaaatgacactcctcagggtgctgaacccaacactggcagccagcccattctgtgccctcagcctgccagtacttttcacttccaaagctatcagcctgcttcagacctatgccttcactctgactagggacaaagaaaagatcacagtggaaatccttctgcgtgctgctaataagcctatttagagtcaatgagaaagcctcattttgcaccaccaataaaggccttcaagagtactactgaatcagagaaaccgaaatgtttctatgtactccctgtcctcattttacatcagcctgacaggtgacactcagcaaaatatcgaacaggatgacctccaagtttccttccttctctaatgtcctctggttctctgttggccagtaggatttaaattttatttaaattatctcatattctgatggattcttgagccccttttcagttttagataatctccctgtggtttgctgaattggcatatctggagtctaggatctctgttggcaaagaactgaatattgctcccatccaacagcttagctagcactgtctattttctttctgaaagagatctgggtaggagacaggtgcagagcatctttccacctcccacagaagggctagggaaagctttgttgtgcatgaaccatgaacaaaaggataattcaaaccagcaataatgtccttaataaaaaataataatcattttcccaaatgaaaatctacaattctaaccatttgatcacagtgatgtaagcaaacaagcctgcagctaaaggttatatatgggtcaaagatttaatggaaagtgatacatgggtggaatgacatcacctatttgtcagaatactaactcctctaccatatcctatgtcggcccaccgttggggtgtaagggaaaggtgcataaagagataagtacccatttctaaacataatgcaagtttgacatttaagctcaatagtttagctatagagcgttttggtaacataaaaagaaaccagagcaatttgagtgacctttgtgaaagacaggcataaaggttgcaaccaccactctcaccaccaaaatctaaaaatgcggaaaataagcatttatcaaaatttctcagagactatgttacccacccaagattccacagctaggatgcagtgtttgagtgtctactaacaaggctgggaattattaaacacagaaagcataacagaaacacttagttcctcttgggtcttatggtccagttgataaaacttccagcactttgaacagattttcacttactgcaaagaaaaatgcttagctgaattattgtctatctgggttgcaagtagcacacccccaccatctgtaaaataatattttggtagactagagggcatgttgttaaaggaacccaaaggagaattgttttgataaagttagggacaatctctaatatgtgtgttttataattctgcaacttatgtagaaatatatctgaatgaaatgttgttgaaaagctgtatatcattttaattttaataaatcaaatcacattttatattcactgactgagaagctggtacttaggaaacctgtgagaaattagtttaataatttgtgtgtattgcaaatattgaccttctgacttaattcagaatttctatataaaaacaaaaatttaattctttaatatcttaaaatgagggatgctcatgccatgttaaataaatcatttccacttatatttaatacattgtattagttaggatgcttgcagctgcaaatgatagaaaatccgatccaaaatggctttaaaaattgttgttctataggtctatcaccctagacttctgctgtccaatatgatagtcattagccacatttaaatgtaaagaaatcaaagttacatttacatttaagtgtaaagtaattaaagttaaatacaatttgaaattctattttttcagtttgcactagccatattccatcaagtgaccaatagccacatgtcactaatggctgctctattaaacaatgcagatatggaaaaaccttcttcacctcagaaagttctattagatagtgctggcttcaaagaaaaggaagttgttaaatcagtaagcaacagtatctgttatattccctatgtagcaggcaataatctttatgcatattatttcctttaacttcccaaccgctctatgaggcaagtattattttaatgtattagtctggactctaggttgctagctaaaaatgggaaaacataattaggagaaccttgaactatctcacatatctacaagaaaagcctggttaaggtcctcatcaccatcagaactctttccatctgtcacctttattctgttgcacaagtcaatattattcttccaggtcagcttcccccttgtggtggaaacttcccagcctcatatctcacagcctcaaactactgcctcccaccccctgagagagaataatcttcctcctttcactcccattttagatattactcggaaggactctgataatttagctttagtgaagagctcagtgttaaatcaatcagttgtggctgaagagacacaaaggagaggatcagggttgtagaatagagacatggccagaggggctccacttatggacagtgaaaacaatttctacagaaactggaatggcagggtcctctccttcaacatatttctgagtcctcaaggctctatctcaggccctctgcaatttccactccacatactttctggatctgtctcaccaagtcccattaatatactagtgaggccccaattctctgtctcagcaagaccttgtattcttagcttcagactcacataaccaagtaacccttcccagacatctgcagctctatatctcataggatccttaaactcagtatctcccacaaaattcatcatcctccttccccctcttccccaatcattcattatatcaggaatgctctttcaatcaatgaccgaatttcccattccaagaatcaaggcatcatccatgatttgtcctctcctttaacatgcaattaattgccaagccctacatatatccctaaaatgtctttttattaatatatccatctacttctgtccattcctagtacagtgcaaccatcataggctgggccactatcatttctggaaaattactgtagtatctcatgggtctcccttcctccagtgttatgcctcaccaatacattatccatactacagccagaataatctttctaagatggtgattctattattctgcttaaaaccttctggtgcccattcattgactttcaaaacatttttcaactgcctcttgaggcatataaagtgttatatgatctgtcccttgcctaggtctctatccttactctcttcctatccccctctcctagtctctacaactgccatcctttctcttgcccactggtctttgtgccaccctctggttaaaataataatactactgataatctctttttcttaattctgctcatattttagtctcaacttcaatgacaccaatcttctcccctaggctacatcagttctccctgctatatgctggctattcgcttaacacattgcattgcaggaactgggctaaattattcaccttcccaattagactgtaagccccatgaggacaataaccatttttgttttgctcacgaacatgtccttgacatctaatagctagtgcttgaaaaagagcagaaaataagctgaatttaattctttcatttaatccacaaatattttaaggaagcctatttgtgccagatgccacccaaggcactgagattcagctgtgaatgaaacaaaatctcttcctatatgaagctcatgttcttgcagggtaaaaaaaaaaaaaaaaaaaaaaccctaataaactaataattttttagaaaatgcttaaattgtataaataaatatagttttaatatttgtataactttttacatttttatttttactttttaaattttattattattatactttaagtttcagggtacatgtgcacaatgtgcaggttatttacatatgtatacatgtgccatgctggtgtgctgcacccattaactcgtcatttagcattaggtatatctcctaatgctatccctccccaaaccccacaacggtccccagagtgtgatgttccccttcctgtgtccatgtgttctcattgttcaattcccacctatgagtgagaacacgcggtgtttggttttttgttcctgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacatgtgcgtgtgtctttacagcagcatgatttatagtcctttgggtatatacccagtaatgggttggctgggtcaaatggtatttctagttctagatccctgaggaatcaccacactgacttccacaatggttgaagtagtttacagtcccaccaacagtgtaaaagtgttcctatttctccacatcctctccagcacctgttgtttcctgactttttaatgactgccattctaactggtgtgagatgttatctcattgtggttttgatttgcatttctctgatggccagtgatggtgagcattttttcatgtgttttttggctgcataaatgtcttcttttgagaagtgtctgttcaaacaaatttacaagaaaaaaacaaccccatcaaaagtgggcaaaggacatgaactttttacatttttaaaattgtataaatgaaacctttttaaatgacattttccattatgtactccaagttgtcttttcattattctgttacctcattagaggtagtatggaaataaagtgctttcccctcaaatagtataaatgtaattttatttttttagaaaaacaaaacactatggagtcatggcatttataatgaagtaatcaaatattccaattaaatattcaggtaaccaaatattccagttaaatattcaggtaaccaaatactccaataaaatttgactgattttataggacacaggactatatgtgtttctagaatcatattcccatttaaattagcatcgcagtcaggaatttaaagacaaactatcagaatagtacattttcttcttaaattacagtaaaagcccttttataactatgttgagcttttccttttattaaaaaatatcattccaacaattaaaatatttatcaaatgcatgccaagctaggcaccatgcatcatatctacatcactgtaatgaagaacaggaggactatctggccatacattatagaccaattaattaacttaacagatatataatgctaagcatatgctaagtcctgaggatacagaccctgcttactagcaacttacaaactattgtctgactattatcttcctcacaaaatataagctccttgagggcagatgtttagcacaatatagagtttaacaaatgtcataagtaataaaaaaaaatcaagactcttcggtagtcttgatttctcaattagccttagtaagctctaatcacacttagtcttaatttctcaattagccttagtaagctctaatcacactttatgtctcctttgccctactgtatccaatcctttgttcagctagttcttttgtttagctatgttcctaagaagttgtggtaattctcttgtatttcagcaaatcatatctatgagactctctcaaatcctctgagttaaaaagaatcccaagataaaacatagagaagaaatattatttttgaaatatagtctcctgtatttatctgctttgtatcacttttagaaaagaggagaaatcaagttttcctgatattgaatcatctatacattgttcctttttaaaagtttgtttggttttaatgaattggttccctcaactgaagtttaatagccatttaaaggaagacaatttatcctaatgtttctgtatttttctaaactttctcatcctctctggcccaagccttaccatagtttttcaaataattggtgatcaaaaatgctgaactgtcacctgtttgcctatatactcttttccatttgtgagttcttcagtgtaatattccagagattgtgtttattcagatacattcatcttccaatcaatcaagataatgccagcttctgttgtgggttttgcagaaaggatttcctagactcctgaattcattttttctctctgtagtgtgagcatttttctgttttaaattattttctgaaaaaatgtgagtatttacgtactcgaaattttaactagaattgcttcccttctaaaaatgttagtttctcagaccaaatgcatcaatctgactccctcagaagtcaggcggttcacaaagagggaatacttcaccttaggtggccaagaaaaaaaacatactggcccatataccaggaaaaatagtagaatgggtcagtgcaactcagccccacttcggtaaagttcttcagagcaggaaaggatgaaggaaagaagcaagtatcaaatcagacttcagtcctatcatcgttaggtagctacagggctttagacaaccaacttgaccagatgagcctcaatttccctttctgcaaagtgaggaaactgagctaaataatctctaaggacctcttcaactcctccactctatgtgtatttacgattgacagtacagttttctaagtgttcagaatattttttgtttctgagatggcaaactttacaatctgctttgcagactttgaagatacaggtgcatctgtgtacgtttctttaaatttagtaatttagtaattaagcttcccactttcaaatttactaatgagaaaaacacgcacacacacacatatatacatattactctgttattatactttactgatttgaatacatactcaagtaagtatataaagctggctactgattgcatgtttttgcattgacaatgtataggtcaagtcttgtttagacgatcttctgtaagacaccttgagtttatcagtaacctttagcacagttgaatgtttattttgctaatttagcttcaggtgctatggttatcattacaaactaactctaatattctctgttactcaaagtataccctagagctcaccaggatccatgtcacctggaactcatcagaaatgcagaatgcctacctccagagttacaaaatcaaaatctgcatgttaacaaggtacttaagtggtttgtgtgcatgctaacattctagaaatgctgttagacatagtgcttcccatattgctttaaaatagatatttttctttaagagaatgaataaatgagtaaactaactctaatttagcaatgtgaactgctataattcaatgtcattggacttagagttatagaacttctagttgatagtttctcctattttgttttttgcttaatgttgtcataggtctactcttatacaaggcaaggggccagggaactggatgtaaaggtttacgctgttcaagacccactagcaaaaactacatgtataactgaaaatcaatgtgaagaatattaaaatatttactactttataaaggattaggtaataaccaatatgttatttttgcttcactttatagttggtgattaaaattccaaaatgtattccatcacacataaagtatcataaagagcaaaacaggaaaatatttttcaactatgtggtaaaatatctaatataagtaaataataaatggaggatataaatgtcaaggacaaatccaaataaaagaaaccaggatcctggctgcagctctgagattaacactgtgatttgtcaataattcactttacttctctgggttctagtttcttcactagaaaacaagagattgattcttattttacatcccagctctaaattctgaaatctagtatgtctgaaatcaatgcctgttttgtcatctcagatggatctattgaaattcaacatgaaatctcagaaacagcataaataagtcatccttggatttctgctattttacttgcgaagaacaagagcatatggatggctacctggtagtgctcacgtaaaggcattctccccaagagttttactctaggcaaggggacaaatggggatggcagaacgcattttaattcaggggaacctacctgggttatctttcactctgaatcaccaaatcaaattatgtaaattcatcccccttgatgactacctacttccttcatatggtctctatgcgtcctgagtgaatacgggagagcttatacctttcataactttacaaaacagaggattgctgagaggtagttataattgaaaagttacatagttaatctagcaccagaaaataaactgacaggtcttccagggagctaattattgaggctgctatttggttcactgacaggattgcttgtttgtgggaagaaacatatttgtgcgttgctttttccattaccgctatttctatcatcataaataagaatcaataggccattttgcatagcatatgctcaccactattttgtatctgagtgtcagctgtatgcaggctaagcagcagtgccccagtctcctggctgagaattaaaacccagcaaagaaaacacctcaaattccacaagacagtgtatatgtctttgtgagctccttgagagcaagggaggtctgttgtttgtctctctatctgaagcacagtgcctggcacatggtgagcttcaaaatgtataaacaactaaatgaataatgaatgaatggatggatgaatgaaacaaaggaaggttttaagataggatatggaatcaactgtatttactggatcagtcaagggatgtcgttttgataagcacagagctatttataattcgtgatggagacaggaaggaaaagacccggcctgagtccagagggagctggcttttgtttagcagcttaacccacatactcaggtctctacaatattcactattgggtcctcactatagaagacaagaaatcagaatgacagtcatttaaaaagtaaagcaaaacttctgaagaaagactctactgccaatgagaacattgctggacaaaacaaggtcaagtaagggactgatcagaggaaagataggaatgagaaaaaatgaggcaatgaagggagaggaattgtggcagaggactgagtggggaaataagtgtgtgaaaaatgtgtaaagacagggagaggatgaagatgcaattctcaagagagtctgtgggtgtctgggttttggagagtggaaagacactaagcctgagagtacaatgagggagggaggaaggaagggagggagaggtcagataaaagtctataaaataacacccatcaccactgataacaagtataaaagagtccttttttcttctcgagaaagacaaagggaattttaagtaggattaagtagtagtagctttcagaactcagcagctctcagaagcaataataactacataaatagctaagtggatggtaggaattacctcacttggaatttggccagcaaatcaaaagttagcagtaatatcacatctttttgaaagctttcctgagattctagaggggaaaattatctcagaaaactgtttctactgagtaaatttcaggaagaaatgctcctcactgcttgaagatgttctatctctggaaaactggtaagacagaagtccctccctgctgggaagcactctctcatccaagtaaatacattgccaattttgcccccaatggaagcaaataattacgttcgcagatcaccgtcgcctaatgtaaaatgttactcaacacatataacttaacctaccaatgatgttctgaatgaacaaaaagggcctcatggatatctcactttcagagagtgccttaactttttgacttattgcaggtagttaaaatgcaaactttttaaggccacattttaaagcactttgcaaacgctggacacctctactcgtgaatatcctgtaaatttttcctttcaagtacatttgaccactaacatgccagatcatcttcccttctcccctaaaacagaaatgaaaactgggtaaaatggtaatttgggagacaaatatcttctcttatcatctgaaaactgtcatatgttgcttttttaaaaaattaaattagtgttatttgttttccacccagagacaagttattttggtatcacccacaatggaatttgcatgaaaatctgtttactgacccagttccctaggggtgcatttgccctagcacttggagtaaacaccattttcattgcactagaaatagttctaattggacaaattgttataattttagcaacacccaaataaatcaaaggaattggaggcagacatgccacagaatctggattcggccacaaaccagttcagtatttgtgcctgaaataaaagtctagtcatataccacctacagatgctaaaggaacagctacatacctcaactgaacttagaaaatatgatttttttattgtactttaagctctgggatgcatgtgcagaacgtgcaggtttgttacataggtatacatgtaccatgatggtttgctgcacccatcaacccatcatctaggttttaagccccgcatgcattaggtatttggcctaattctcactctcctttcaccctcaaccccctgacaggtcccactgtgtgatgttcccctctctgtgtccatatgttctcattgttcaactcccacttacgagtgtaaaaaaaaaaaaagaaagaaaatatgagtttggagaaactggttattctgaaaacagcctattaaaaagttatgtgactggttaacagtgtgtgtgtgtgtgtgtgtgtgtgtgtgtatgagtccatccatttcattaactggggtattttcactaatacagtctaaataacaggaaatgaatttaaagagaatcaaacaataacattcagaactcaaagttaagcatagtgtaaaatatatctcagtggaaagcatgtaagtgcttaacttaactctccttccaaacccatctataaactgccactttgtattttccattcatgtatcctcctctccaagaagctggacctttttactgctgttcacgcacctacacgtcacaccctactccatgcctttgtcctgctgactccccatttcttctcatcttggatgtctttcccaaatccttgtcatcaaacactcatctcctccacagagctttggattttacaatgtaaacttacatacattttctgaacttccctaattatctatatccaaatttagcatttaattatagaactttcctctctgattacgtatatgtttgtgtgtaccttcttttcccccaaccaaatcacatgatttaaaggtaacattggtctttaatgcctctccttaaagtttccatcaagatcctactctgcatttattctctttcactagttatcccttctttttttttttctgaaaacatgcttaaatgtgccctatcctaaagaaatctccaattctttctcaagctctcccaccatacctactttctttctctcaaaacttcttgaaacagcatcctttcctccacttctattctgttctctctcaacccctctaatttggttacccaggcacacccttatctctcagctgcaagtccctgcagcactgaaacctcacgcacctgtctttctcctggagactgagacaaccttgactcccagttcatctccttcccccaagcccagcattctcagtgtcctttcctggttcctgcccttgaattctcagtcatcactcctcatcttttctcagtctcccatggcaattgcatctctgcttttgtctttaacttcaaaatctccaagacttcctaatctcaaattttagtgaactgtctgtggggtcccagaccttatgctgccacctgctggccagtttcatggggctatctcagaacaaaattcaagtttattcccaaacacctaaccattctatttattttatatttcctctgttaactaattacatcaccattttcctagacctccctgatagaggtttaacatcagcatcctccatgatttaacgatctttgccccagcatcaaccactcagctggttgttatataaacacaacactatgtagcgttagataaatataacactacgtaccaaagcgtctgtcctgtgtgttacatccctagctagcttttttgtttgtttgttttgttttgttttgtttttttggagatagagtctcactctgtcgcccaggctgggtgcagtggtgcaatctcagctcactgcaacctccacctcccgggttcaagcaattctcctgcctcagcctcccaagtagctgggactacaggcgcccgccacacgccgggctaattttttgtatttttagtagagatgggttttcaccatgttgcccaggctggtctcaaactcctgagctcaggcaatatgcccacctcggcctcccaaagtgctaggattacaggtttgcaccaccgtgcccggcccctagttagctcttcttagaccatgatggcctgtccccaggatactggatgagtcctcattgacctgcctccattttctcccctgaaccccaatcctcttcacacttctgccaggcaaatcttcttgaaccgagtgtctgagcaattctctagatgaagagcctcaagacattgtgtcctaccggtagaataaagcccaaattcctcaactctggaacttctggaaagaacttcaagactgtgcatggtctggctccagactatcatcaaagcctcagctgtcatcacgcttcctctcgcgatattcactcttgctccaacctccctgaactattttttttttcctttactttgaacaaaagagccttactctggcgctagagcttgtcatgcattcctgtcatatctttacatgactgaccacttcttgtcactcaggtcttatctcaaatgtcacctcctctggcgaggcatactcagaccacacagtctaattaccttcctcctcctaatacccaggttagtctttcacagttaatctgttgtatttcttctaagcacatctcagcatctgaacacatctgttcatttatgtttattatggagtgtccatctccccacactcaaatgtaagcccgtgagcatgaatattgcctttcttcactcaacccagctcctggaaaagtgcctggcacatggaagcctgaaatcagattcttccacagtgtggcacccatttccacctccttgttctgtctctgtttatatgtctgtgctagcttttagtatattacatcttttatttgaacagctatttccaaagaaagtgaggaggagggaaaggaggacatatcaaagtctgggggtggcagggtagaagaaggaatgaatcatttctaaaacacacattcaagttgtgtagttttcagtgtaaaggatttgtgcatttttgttaaaattgacccttatatatgttgtatgtttttgatcctactataagcagtattctttaaatttcattttctatgtgttagtttctaatacgtatattaaaaatgaatgtttatattgacctcatatctgtaaccttgctaaatttactgctcagttctaagtaactctgtctcaaaaaaaaaattatgcgagttttttttctatgtgcacaatcatctgaaaataaatatagttttaatcatatattcaaaaatgcatattcaatatcattattatttttaagcacaagctatggaaagtaaagcatctaaaaatcatacatgttccaggatagctgctatgcaggatttaagaaaataatagtattatagaggacagcgattaaaatagttgaaaaatactgtcttatagcaacttatcatgatacatattacattttgaacccctggagagcaataccatgtcttatttgtctgtattccatcaaacctaataaagtacattttccaaagtagacaataaatgtttcccagataccccagtactgtatgcatggtatatgttcaataaaaacttgctgatccattgaaagaaccaataaacaaatttaagtttgttgaatgatcagggtatgctcagccctgagacactataacaaaaagacacaaaaaatagaaaatacattcatcattatccatatagaaaaacgtaatttatcaagtaatgaaaacaaatgaaaatgaaataaatgcaccacaggaaacatttgagtggttacctgtgcatttctttatatgactgttccttttcccatgtgatcctaacttgcagccaaaattctcctcccagaattctgcaaaccacacatttcttcgattattggcaagagttcggcttctaaagtatcgatcaaatcctatttcaaaggagaaaggtatgattttaatattctttcaaaattaaatattgtcagaactttcgaatggacattatattctgatcactgcatgaaaagaaaaaaacaaaacacataacaaatgagagaaagccagtagcccataaataaggcctctcttatggcaaaagtcaaggaggatcaatggacaatccccccacaccaccaccagtacccaagcacctggctctatgaataagtacaacaggaaagcctggtgtcagcgaccttcttaaaccctctcctactctactactcccagaggcagcaaccagtgacttcatgctgaatcctgaatacttagaacccaacttaaacttgcctcattcttttctctttcctagcatggatcaatgttccagactttcctgtgtttccacatacttcaaaatttctccttcctatatgttctgttttcaggtaattcaataaagcaatcatgttaatgtcatcttatggagtcatgaactcaagtgtcggtttgctcaggtaactactttattgaagggagaccccctggaaataatgccttactccagaggataatgttaagatgggaatttcagtcactgtcaaaccgactggaaaagatgtttagaagatagactgcctttcaggatgctccaagtctttcctgttgcatttatttatccataggataagcccagcatcatatatattcattttctataaatcaagcatttccctccaacaatgctataaccaccataaatacccatggaaatacgcaaactcaaactcaaagtgcaattactaacataatggaaataactgactatggtctttttcttaaaaaaatataatgggtcctctttcctaaatacatacacacacacacacacacacacacacacacacacactatatacatatatacatatatatatgtatatgtgtatatatataggtatatgtgtatatatatatgtatatgtgtatatatatatgtatatgtgtatatatatatgtatatgtgtatatatatatgtatatgtgtatatatatatgtatatgtgtatatatatatgtgtgtgtgtatatatatatatatatatatatatatgcatatgcatgctggtttaaatactggtcttgacaattctgccaccaaagctaaaatttgtatcaagtcatcagtaatgagtgcatttcctcatattatgatactccagttttgcctttgagttcagatccaactggaataaaacaaattctctatggtgcattcttaccatcaattgatgctcgtttgggcaaaattgtcacagccccttctgcaatctcctcttgctgatagacaggtgctattttggatccccaactatctgagccaatccagagaaaatgcccactttggtttagtttttttgctgcttccaatatcctcctacaggaataaaaataaataatgcatatcacatgtattaaaaataccacaattatgaatattacaagaccagatttaggaagttgtatacactcagtaggtcactgtttaacaattaagacgatcattctaactgcccgagtcttatcatctcctaaaaacaatatagcagagactaactccaacatatgttaattagccttatccttaacctcattcacatcattctgtctatcacctttgtttgtcttatctcatttggtccccaagttttactctgtaggtatttcagatttacaaactagaaggcagtctgttattggaaggcaattacaagcttttatgttgaacatgaaatatgttagaaagaggatatgggacacaaatctgaccctacatacagaagaaaagtaatcagcacctgatgtcatcctcattggcaaacataatcactgctcgagcattaggtgtttctagcaggcgtttgataattttttcaaattctccaggtcttggttcacgtgggattttctgtgactgagcaatgcaaacaccacctatttaaaaaagaagggaggtggtgattcagaaagagcatttatttaattagcaaacccaattacctactttataaaagcacatacttctgtatgaatattatttctcaaaatatgtgtcactctcacctattaagagcaattgtttgtttgcattataatatattcaccaaataaatgacaacaattattaatcagacatgggtttctttcccaatatttaaacattatttttgtggatatagctaagaaaaccaaggtgtataagatgtgtgatgagagtcaaaagatggaaagaagaagggatcttttgatttatgcaacataagccaaaggacaagtgacagaattaataaaagtatgaatatgtcttatagttgagacccttattaagtagcaaagtccttttgttacttttatttactggtagacttcttttaaagttaatttcattgtatagctaatagaactgcagcaagatcctcatgcatcagcatagcaatgtcttatgagacaagtggtcttcaaggctatgtaagacacaggcaaaccccaaagatgccaactttggattgacatacatcgccactatgaaaatcgaaatggcagaaataccatctcattttcactgcaaataaaaagacagaacccttcttttggcctctccttcttaggcaatgaaggacaaaagagaaaagtatagaaaagatctctgcctctgggctggggtaggaggagaagaaagaggttcccccagttgcagtgaaacagagataacattctgaaactagatgagaaagcaatattagtaataggtttcaactgcattatggtataaacagtatttttttttagtcagctaagaattaaatcaccatttatagcattgcttcagtaggcaaaggcatttttacttccaaacaattgccaatgcactcagtcatccaactgttattggatgccattatattctacgcactgggctcaacattggaaatgcacagtctaatccaggagttaccacctagtctgggaaataggcatttgaataagttaccatggaatagataataaagtatataattaataggatacccaatacaatcagaacacagaagaaggagtaactaaagtgcttgagagaactgaattttaaagagcaaatatatatccacatggggacaaaagtggaacatgtctggtggaggccaaagtatgtaaaaacctagcatgatcatggcctatggtagagactggctgggtttgaagttggaaacaatgaccaggtccaacttgagaacggctttgttagacatgccaaattctgtaggctgagtgttcatatgttaaaacttaatccccagtgtgaaagtattaggagatgggactgttgggaggtgattaggtcatgagagtggagtccttatgaatgggattagtgcccttataaaaaagactccacagagatttcttgcaccatctgccatgtgaggacacagcaaaaagacactgaaccaggaagagggccctcatcagctcttgaccatgctggcaccttgctctcagaccttcagcctccagaactgtaaaaataaattactattgattaagccacccagtatatgataatttttattttttattttttagatatgggggtgtcactctgtcacccaggctagagtgcagtggccagatcatagttcactgtagcctcaaagccctaggctccagtgatttgctcacctcatcctccggagtaactgggattactctgcacatgccaccacaccgcactggtctcctataataatttattatgcatttcaaagagactaagacatcaaataacttggactttattttgaaaacaatggggatccattaggttcatcagcaggagaaatatatgctgagctttatgctttaggtagactttcaaagaagaaacgtctggtagccaaatgacagatttccagggtgctgtgatcggacctaatatgtacagcagatgtatgagtaactggtgccagtatataaaactatttttcttttaagttagagaacattcaaaattatgcctgtaatagcaggactcttagtaaccttacaatttgcatcccaggggtgggaattgcccataatacacagattgggctgtgtcactacctgcagttagctagtctaccgatatactaccactagttgtgataattgattcattccttcagtaaatatttcttgagtgccccgtatctgctagatactgtgtgggtgctgtggacacaatggtgaataaaagaaattctctaagttcacagaattcagaaatattgtgggtaactcaggcttaatgcaaactaaaaagaaagaagaagaagagaaaaagaatggagacgagaaagaagaagagcaggagaaggaggaggagaaagaggaagaggaagaaggaggaagaggaagaaggaggaagaggagaaagacaaggaggaggaaatggaaggaggaggagcagatggaaggaggaggaagagatggaggaggaggaggaagagatggaggaggaggagtaagagaaaggaggaggaggaggaagaagaaaggggaggaggaagagggaggaggaggaagaggaaggagggggaagaaggggaaggaggagaaggagaaagcagaagcagaagaggcagaagaagaaataatacataattataaattataataagccctgtgaggaagagcaaaggaatttaatttagattgaggactgctcagggaaagccaccctaaagttgtgtaatgtagttgagatcaaaaggatgagagcatgggaaagggcaggaaagggccaggggagtcagtgaatgagggtgagaggagtgggcaacaaaaatgagatggagataagggtccaattgtgtgtggctctgcagggcctgtggaagactatgaataattaaatgcttaactttctcactaaatgtttctatttcttcgatctttgagtggcccataggaatatgtctcatgtatgagcattgcactccacggaagaaaaatggatgacgatcgctgatacagagggcagcctgaagtgggatgaacaggaggcaatgagccaagcaaggaggtattggaataggcagtgggaaatgatgactgagccagcgctactggtgctggggaggagcagctggagctaaggcagaatctctgagttagaatcaatggggctttgtattgatttgatgtaagtagggaagcaatgggaaaccgctaagtatgactccaaggatttggtctttgtgaccagttatgtgatggtatcattaaacaagtgggaaatccaggaggataaggaggaggaaagaatgattttgattggaagcaggttgtcttcaaagtatgcatggaatgtcaaactgaaaaagtgaatctggagctaaagagagagaagggaattgtaatactttcgtcaggggctgataggttaggtatttgaagtgttgtggggcaaagaggtcactgagagagaatatttaaatcagcaatagaaaaggtgaattatagaactctgaaaaaaatcaggtttggagaaggaggaaaggagtgattaaatattttgagaaaacttttggaatgaagtctagaggtaagttgaagactatgtataatttatttaaaatgcaaacaaaccaacctccgtgagtggaaacattaggtaactgcaaaaatgtaacatgaagtaacactctatagggaacaatagctgtttcaaaagatgactgcccttttaattaaattgccatgattacttaagcatcccattaaagacatgttatatgctgagtatcattctgagactgactctgtagccataaaaaattaagttctgaaaatttttattattactgtttcagaagaagcaaacaagcaatccaaacatagtttagtctgaattcattgatttatttattcaccatggacctattaaacatttttgtttgtaaagagctgagttagctgagttgaattttaacatagcttaaatccatttcactttttgctattcccacacctcacctcatatctttcaacctggtcagtttgaattttcctggaaagaggcactggactattaatctatttaagctgaacaaatgcttgtagagaacctgttccacatggcattgtgctgtttggtgcctgtgtatattttattaaagtgtagataaattatttctcaaatgattgtagttagaagactgggattatttccttaaccctgatacccattcacactttctttcttcatatcagtcaaaaaccagacagctaatctgttcataagcactcatggtctactatgtttcaggagctacagacaaagaccgccagtcctcagcagttatgatataattgaatgacaatatgtacacataagaaatgtcagacaagggtgtaaattaggtaacacagataacagcataagatacaccacagttcagtcataaatgacaaataggtcatcccctaaaatagtcctatgacttcataagaggaagaggttattatatactgttagaatttggtttaaaaaataaaatgaaattcaaagattcagacctcaaagatacgttttccatacaatactccacatccattgcttgactttttaaagagactctgtcttgatttaaattcctggggtgggtgggaggaagagaagttgcccttcatcaaagaatgtgtccaccacatctattcttccatgtctcagtctgaaagattactaattgtgtacaatttaagggactttaactttcctattctgcaggggtgttactgttctgtaatttttaaagcttagtacttacaggcaaaatgttatatgaaggaatttataattggctgttttctagaatttcctggctagtttccttgcagcctgtgtattttttttccttctggttacttaacaataatttaaagatcatttgttgaatttaacactttatgtatactttacaatacacatgatcactcctttccagtctcatttactcaatgacaccatctctattcctaatggcagaacttgaaggtttgcatcatgaccatctttctgataaggaaaatgagaaacaggggtaccaacggcttgcaagatactgaaatccaggttcaaagccagatttgtctgcctctaagtctggacttcttccatcatcttacccatccacaattgactatacctgtggcttaatggtttagtgactgcaaatgattgatggataagataaagcaaatttaaagactctttttttttttaaaaccctgccagttgtcccttgtaaatctaattgacagctacataaatacagtccttctgttatcctaaataagagtttaattaaaatacttggaatctatgcagattatagaagtgacttaaagttcttcagcatatagccagtctaccctccaaactttccaattgtttctgttgatgcatgttctcaggaagacttttctgaggttcttgtcttccacttctttcatactgcagcaatcataataattttaattttacttttttttgttacttctttttctttttcttcttcaattagaaatccatgagtattgaaccttgtctttcaaatttatcagtataccccaacatgtatcactgcgtttggtacatagacttcaacaaacatttgttgaatgaataaatgcaagacttgtgacaggtactgctaggatagagaaatacaaatgagacagtgctgctttcaaagacttctccatcaagtaggggaacaaatagctacatgtaaatatatgtttaaaagtagatgtcattaaaagaagtaaaaaaaatatttgggccatgacaattcagaggaagttgtcactgaaatgggatctgcctcccaaaatagtttttattagggtgccatgaattagaatactacctaggccttagtgtattcatctgtagagtggcattagaatttcctcatattgatacaagagcaaatttgtaaacaatgccatttcagaatttttacccctttagaaggctgagacttgtgggtgagtggtcaggtgtcacagatatgagagataaaaggcttgtatgtattgatttgctagtgcatagagatggtggaatgagaaagaaaatagacttgtcagaagacctgagagtggccccacataatcttgaaaagtctctcatctctcagtttcctcatctctgtaatgaggttcataataactatctctcaggtatactgtgagaatccaattataaagggtaaattcctatgccaatgtagcatattattattagtgttaataacagtaataatcatagccagacaagaatcatcaccaacactgagagatacttgacattcagccctaaaacacaggtttttcaacagatcatatttttgaatcttcaccattttatgtgtaatattatcaaacatcctaaattctgaaaagtgatacttgctcacttgcctgtgccaatagatgaaatgactagatttcactcttcatcattgttgattacaatgtgatcggggcaattttaaggtgagagaatgagaaaagttatttacattcttctcccatcccccagttcctacccccaagaattaattctcctttcaaatggattccataagtagtaaagatttggctccaatatctgagttgaaattagaatttaactctttaataaaatggttaaaactattaaaatattaacgggtgccaattgttaagcaaaagttgttatggaaacaaccacatgttctgtttcattcaaacatttgtgctacctttttaagaggctggaatctaatgtgttgagataataatgttggactctcctagaagcaaacctcagaaggagtttgaaatgcacaaaatttgctcttggcatctacctgatgcagggctcaggggaagcagagaaatccaggcagagaaatccagctggctgtggcccagtgacaggctgctgacaccacaagaagttctgaggctagaatggccttcagagttgctttaaaacaggccacaaaggccaggccattatacctccacatcaatcagtgcgatgattcattttatgtatcagtttgactgggccacatgctgcccacatagctggttaaacattatttctaggtgtgtcagaaaagattggctgggcggggtggctcatgcctataatcccagcactttgagaggccaaggcaggcagatcaagagatcaggagatcaagaccatcctggctaacacagcgaaaccccgtctctactaaaaatacaaaaaaaaattagctgggcatagtggcaggcacctgtagtcccagctacttgggaggctgaggcaggagaacggcgtgaacccgggaggcggagcttgcagtgagccgagatcccgccactgcactccagcctgggcaacagagcgagactctgtctcaaaaacaaacaaacaaacaaacaaacaaacaaacaaatagagaaaagattagcacttgaattagtggactgaataaagcagattaccttctccaatgcaggctgggatcattgagggcctaaatggaacaaaaatgtagaccaaggttgaatgaactcagcctgactgcttgagctgggacattgatcttctcctgctctcagtgcctctggctctgaggcattcaaactacaccactggttttcttgggtctccaatttgcagacagaagattgtaaaacttttcatcctccataattatgtaagccagtatctgacaaaaaatctctttggttctgtttctctggagaaccctgaccaatacaatgaatcatcagacttgggccactctggaagaggggaaggtgaacttggccaaggcagctctctgtagccagggcattccctcacagggttcagagctgaaggctgtctgcctatagcactcccagaaataggaataacaggtcatgcactgataggatcttgaaggtcaattcaccatatgtacattagtgttaataatgtataattgaaatttatacaaaaatgaagatatcatttttctgaaacaaccgtagactattgtttgccttataaggcaaataattaatagaatgttattatttaatgttaaaacttcctttcaaagacgtcttgttgcacaaacaaaggcaatctatacaaatgatagaaaactggaattgtagcctgcacaagtaggagaaataggaccttcattctttctggtttttcaataaagaagttttgttaaaacaatctaaaaggataaagaattatgtttttagttgttgctcatttataagacaaaaatctctattaataatttagtaggagaaaaataaaacaagaaacaatgtcacagcaccaagttccaactgtgatggaaattgaggattaacttattgggatgaaattacttacaaagctgtgtatagaatactaagtgtgcatttttaaaaaacaacatgactacagtattatcagtatctcaagttggttcacaatttccatcaaattaaattctacataaatcaactcaagtctgtggttatataatttgttagagctacacgacagaccttggttttggtgtacaaataagcaaacaaaattaccattttatcagttgttaaagagaatgactagactattggttaaaaatgattagacttacagtttgaccataagaaatttgcctagaattaaacatcttttgatctaataaaaatgtgatacagcccatccaccattatttatttcttatgaacatgccttcagataatagcaatgagcaaaacaaaataaccaggtgtttttttaaggcaatagaaacacataaactctctaccctaaatatccttagcatcatttatatttccatctttctgaagacataagtgaactaacaatttgacctaaagtaattggtcctttagtggtagttgagtaaaatttgttctatggtttaaataagtgtaatcacgcctcctgtaacaatattttcgcctcctcatgtggcgtacaactgggacttagcaggaaagtgcacaacatgaaactgtaagtttatcagcttaaagtgtactttgcaaaagagaagatttatctcacacatcactgtaaagaaaaagtgttatctctaccaacatggattaaaagagcaaaactgcacttatatttatgttcattttctctttctcactttcaaacattttatactttttcctctatcaaatgccatgtggaatcttaaagggactctgaaaagcaatgcaatgaaggaatggtacagaagaggcatgtgctaccatgcatagggaaataaagacaatccactgtgaaacgggactgcaacagaagcagacacttctcaaaagaagacatacaggtggctaacaaatatacgaaaaaaatgctcaacatcactggtcacagagaaatgcaagtcaaaaccactatgagacatcatcacacaccagtcagaatgactattattaaaagtcaaaaaataacatgttgatgaggctacagagaaaaaggaagacttacacactgttggtgggaatgtaaattagttcagccactgtggaaagcagtatgaagatttctcaaagaaccaaaaacagaactaccattcaacccagcaaccccattacttgatatctacccaaaggaaaagaaattcttctaccaaaaacacacatgcacctatatgttccccacagcactattacaatagcaaagacgtggaatcaacctaggtgcccatcagcagtggactggataaagaaaatgtggtagctatacactgtgtaatgctatacagccataaaaaagaatgaaatcttgccctttgcagcaacatggatgcagctagaggccataatcctaagcaaattaatgcagaaacagaaaacaaaatatttcacgttcttacttataagtgtgagctaaatcttggctacacacagacataaagatgggaacaatagacactggaaactccccaaggatggagggagtggggcaagggctaaaaacttcctattgggtactatgttcatcatctggctgatgggatcaacagaaacctgatcctcagcatcacacaagtatacccctgtaacaaacctgctcatgtacccccccaatctaaaataaaaatagatgcttttttaaaaaagaaaatcataattaaaaagaaaaggaccttggcacagagagcccctctcctgcctgtctgcagatgtactctcagagagatgctgtgatctggaggtggatcgggtctaggtaggttcacagggtcagcgtccacgctgggctctcactcagccacaactcaccaccgatctggaggtctgctcagaggaacagaggagtggggtgaatatgaatctcgtctctagggtcagacttcctaggtccaaatcctggcccttctcttcttagctatgtgagactgggtaagtgaggtggcttctttgtacctctgtccctcatctgaagattgagaagatggcacccaaatgggctttgtgaagagattcaatcgacactcaacacattacgttttcctcagaaaacacctgctagttgtaaattgtttaaaatcaaaatcaacagcccccacacagaaacagtgattgtctttcatcaagtgatattcacctgcattatttctagaaacctcaaatttcattctccaagtatacacagaatcacaactcatactagagattcctcaagggggatatagagtcggctgcagaaagctgtatagttagaagaaaaacttatgctcaccacaatagaaatgaatgtctgatatgttgcctcttcttacctcttcctttgaattagaaatgtctaaggagacatgggtacaggaactgggaaagagtcagagaaacaaagaaagaaatataaaagaagagaaccaggaaggggaaaggggagaagagaaatggtggcgggggagaatgaaagagaacaagagtagaaagaggagagctgagagagaaaacccagtccagaggtatctatggaactgggcagaaaaggaattctctgtagggtcaaaaaagcaagtgcaggatgaggaacaattggagaaggagcacttgactaggtttaaatgaatgtcattaatgtgttgtgtgcatttgtattttctttggattatgttttggtgagtgatttgtgatctttatttgttctatttgtttttgccatttcaaattaggttcccagactctgcagcaaaaaatacaacaggaagatttcaaaagagaaagctaactccttctaaatgctcaaatgaccaatatgaacagactctctgacatattttccagcccattgcctggaaaaaccattatgacaaagacaatattgaaatcaaagtgagcactgtttaaatttcttacctgttctggactttaaaacagcattagactttgaattaagcccattacagaattaataatttcattatggaattgcagcagttaaacaccccagtgtatttctaagtctagtgaagcctgatagctgtgaacactcattggatgtgtgacaaatacgtgaataaataagaagccactgtttcctgatatagtgaaattatctaataaatagataagcatatccatgttttaaaaccaccatcattcagaaaaaggcaaagtatcttggtatctgtgttatatgtgtacatatcataaagtcatttccaaataccttctgcagataggacattctcaacagtatatcaacagcagctatgagagcttataatctatgtgcactcttctactcagcaccaagtaatatctgattctacttatcagcattacccgaattctgcaatgtattagctttcaaacagtgaggggtctttgctcaaagcagcattttcaacagatacagtggctgagattctcaatttaagaaagaagaaactgatagcagaaaggtcattattattttagccaaataacccttctgagcaagggttgtacaatgaccatggtacggcagtaaccaaactaggaaatgaacttcagagaacaaacatcagcacccaaagcatttaaaaactcagtctttcaaggaaatgcaagtaacatgtagtgtttccctaggtaatgcaagatcattccctataggaggatttgatccatgtgtttagtacataaaaaggttaaaaatgcagttacgtttttaactttttggattcagatagcactaaaaagaaaggatagtgaatagatatgttttggatagcaagccatctaacattttcttgggctccagggatgatcctatcctggcctcccaagtagctaggactacaggtgtgtgccaccatgcctggctaatatttttgttttttgtggagataggggtcttgctatgttggccagctggtctcgaactcctggcctcaggcaatactactgcctctgcctcccaaagtgctgggattacaggtggaagccaccatgcccagcataattctttgaaggactcttgtcaaaatacattttggactagattttattcaaaatagaagacaattagtaccttgagatgcaaggacctcctccaaccacacacacacacacacacacacacatggacacgcacacacacacacgattctattaccttttccttaatgaaagatctacttttagaacaaatcgcaaataataatatatttgaacagaaaaatactatttcactaatgttttaatatctaatttcagcttcataatatcctaatgctatcaggttagtagggtaaacattataaatttatttttacatggaaaaaactgtccccaagatcacacagctattgaggagtcaaatgcaaaccttgtcaacctaatcctaatagcaaataattactgtactttgctattatctctcaataattgtctccttggtcattaggttgcctcaatgtacataattaaatacaacatcaacaggtaaggtggtatattcaaaatgcgaacttcaaagttttacatcatcaaggctgcacagtttagataaatgttttttggtctggttcaagttggacagaaatttcattgaccgacatcctctcaaaagagcctattgcaagctattttctccataaacccgggtctgcctgtcatcactcatggagcattaactgagctcttgctacatgctgagctctctgttagaatctgaagttacatgaatgaataaaaagacacagtccctcatcttcaggagataacagtaaacaacacaatatgtaaacaaatattacaatttgatgtgagaaatgctatcatatagggcagcctagggacaaaagaccaagaaaatggaatttggcaactgtaagtaagatttactggttcttgccagcggccttggaattacgtagccagagaagcataaaaaatagttgtatgatacattgatatgcatcagaatcaacaagtcagaaaacatttcataagtgagattatgcttgattcagccagccaaaaaccagaaaaatctatttctaatggatactaccagtccacagagatgcatatttcctttgacaatgttgtcattaaatatgatgtaataaacaccctgctttatgtacaaaaggagatttaatctaacttttccacaataagaagcagacaactcatgttactgtagaaggaatacagaaaaaaaattaagttagccattaaaatgaccactggaagaggaaatagcaacacatcaatcctaagaatgaaggatttcagctggactcaataaaatgtaatcacaacagctatctacaaggctttactttaatgataaaacacatcagaacttgtgagaataggtttttaaaaatttattcctattattggaaattctgaaaatgtgcaagccaggtcaatattgcattatttaaagatgcactgtcaaacaatcttttactgaaaccaaaaacatctacattctcagtgttataggaaatatagccggtgttttataacattctgcattaaatggtattgtttatctaagggggttcttagaaaagaacgttaagctttcaacaatcccaacatcacccaagcacaaaaatgaaaaccgatcagaactgcaaatgacaaaaggataacaatttgttacttcataaatttctgtgatataatttccacaatttccattcatgcagtgacttctagataaaactcattctccttgcaaatgcgttatagcttaaccatatataacatgtaaatatctacaagtgaaaagcagcttagcttgtttaaaaaaaaaaagatcctggaatataaacagagtaacagaagcactcgttcaagttcactcatggcatgctatcctcttctcatccctgcagtggagcacacccatgttccctctgcatgaccctgggcaagatgtgtaacatttgtggctatcagttccttcatttgtaaaaagaagggtgcttgacaggatgatgtcaagatgcctttgaatttcaacattttgtgtttctatgaatataccacatagctgcctcccatgagtactgtgaattatgtaagttctaatacgggaatagaacatcatgttaaatacaataaattgctttttgaaaagcctacaggagatgaactagagggtacatcagaaaacttttccaattcaaaattataaatcctgacttcacaagtcaaagaatgactggggatcttaaaaactgattttttgttagagtattggagccttggtcaggtgctagggatctgatgaccagttcattgaagcattatagttctcttgtcagttcaaaaaaaaaaaatgaaaggagtgttggggatgggctgaagatgaagacaacaatggcttccattttactattcaataatagcctcgcttttcctctcctcgtccatttctctctcctatttcttgatcctgctcaactttccctttctctcccttccctttcccttgtcttactctgtctttcccattttaaaaacctgaaaatggagatgagccacctgatacaacaccctttcaattacttccatcctgttactctgagactcactaatagcagcagcaaaaaaaggactgttgcatggcctggcctcttgctgagcatggaaaatagaacacattcatttacctccatgttataaactgaatgtctgtgtactcttaaaatccacatgttgaagccctgcccctctgatgtgatagtattacctttaggaggtaatgaggtttagatgaagtcatgagagtaagactcccacatgggattagtgtccttaatagaagaggaaagatcagactgatctctctctgtctctctctgtctccattcaccgtgtgagaacacagtgagaaggccattgtctgcaagccaggaagacagccctcatgaaaaacccaaccaggctaacatcctaatctcagactttccagcctccagaactgtgataaataaatgtctcttgtttaagctactcagtttatggtattttgatttagcaacctgagctaaaacactctaattcctccaaatacccaactaagttgtctactataaaaaaaaagaggggaaaagaggagagaaatgtcaccaatgttttgaaagctgaaaagcagatgattaccaagttgcaattgacttaccagaatagaaaaagctcagtgagagcccacaaggagtggggctggggatgaggccaacagaaacaaagctggtgttctacttaacatgatgaaggccctggagtggaggtaccagaggctccagaaggtggggttgaaaatggagttggttgaaaatctctaaagtcccttccctcaactccagtccctctgcacagaagatcagagagtcattttctatagaggatgaactcagggacatcaaacacagctgaagacatagtgagtttctatagaataaaagtctgcatgctgaatggatagtccctggtcccctctccctgtttagcatccagactgcagtagcctaacttatctccccccacccacccctgcccccactaaaccccatacagaaaattggaagagtcttctctggagaatctggtccaagggtaatgacatactgatacttacatggatgtttcccaactaaatgaccaattccacctgctcgagctaaagtaaagcccactggccaatgaatttgtcctcacctccaaggctcacaaacaccatgtcagcacctcactcttaatatcacagcagacatttgagaggagcctttaccgtgaaagtcaggaaccaaagcaaacagaagaggtaaacttagaggacaagaaataagacatacatagataacttcaagattattaatatcctcagagacaagaagtgtgtccatgcaacaagaataggaggctaaaagaatagaaacattcagagggcaagaagaagctcctagaaattaaaaaggagatgatagaaatatctcaatagataaggtataagagcaagtagagaaaacatttcagaaagcaaaacaaatgaaaatgaccataaaattggagaattcattcaagaggcttaactttccaattttgaaatccccaaaagagaaaatagaggccattaccaaagaaaaatttaagaatatttctcagaactgaagaataagaacttttggattgaaaatagttataaaataccagcaaaaagaaaagaaaggaaggggaaggaagaaaacctatatgaaggaatattaacacaaaattttaaaacactcgtgagtaaaaaccaattacagagaaggattaaggctcagaatggtttcaggattttcacagcaataatgtgaagtcagaagaaaatggagcaatgccttcaaaattataagaaaaaatgagttttatttgaaatgaaaagaaagcaagttaactatatatcaagtgtgtaggtagaataaagtctatttaaaatatgaagaaaactcaaaaaaatcatttaccttccatgcatacctttttttaggaagcttctcagggatggaatgaagctttccaaaccaagaaaggaaacaagaatgaacaagacccagaatccaagtagcagggaattcaccacaggagaaggaaaggggatttctcaaagtgatgatgaagagaagcagagttaacagccatcaaaggtccaaagatcatcccacccagattagagcagggaaaggaagcctccagaagaatctccaagaagaaaagaaactgaatggatgggctgtttgaggtgtttggatatactgaaaggatatgtacagttctgtcaaagtttgaggatgaattgataagttatatagaaatctaagcatatgacaaagcaagaaatgattaatttcaggaaaaacaaaatgtttaagaatagaaatggtattttagtacactagattaactgcaacatcaaatgcagaatcatgataatacaagcactgaatactaattaaatcagaattatgatacaatcctactggaaagattggaggaaaggaagtgtatgtgtgttcatacgcacatccatgtgcaatgtgtgtactgtggggagttaagtcatcgtcttccgtagtagacaatcaaaatgaaagctaaaaaaaaaatcaagaaatagcaacatgaaaatgttttgtgaaaaatggagacaaataccagaaaaagagctaaaggggttggaaataattgttcttggggatcaagattcaaaagcacggggagggcagtgggtttctgtgaagtccagtagcactatatacaatatcgcttgggtaaaatacatgtttggggccctgatttttaaggtcattaagtggaagtggggatgatatggtttggatgtgtcctcacccaaatctcatattgaaatgtaatccccaatgctggaggtggggcctggtgggaggtgattggatcatgtgggcagagttctcatgaatggtttagcaacatccacccttgctactgtacagtgagttctcacaagatctggttgtttaaaagtatgtagcacctccccctccctcccttggtcctgctcctgccatgtaagacacctgttcccactttgccttctaccatgagtaaaagctccctgaggcctccccagaagcagatgccactatgcttcctgttcagcctgcagaatcatgagccaattaaacctcttgtctttataaattacccagtctcaggtatttctttataccaatgcaagaacaaactaatacagaggaaaaaagagtttaaagatagcaagataattttagtcctgtatgttagggaagcatcttctgtaaccaggtttctctttaaaacatttctccacctttatgcctgtgactgtattatcttatgctgattgcttatttgtttgtttgttttggtggcataataggtgcttgtttaatatttttaggaacaaaatccagaaaacaacctgcattgactaaaataataagaaccacatgaaaatccatgttgcctgggtttaaagcatctgcttttcatgtaagtcaacactaacctactaatctgtccctaattggtctgatacccaaatgtcaaaggttcttttcagatatatcagtaattggttttaataacaaataagacctatcatttaaccaaaaccactactgacactttatctggatattgtttgcaatataatattatctttgttgctataataaagaaaataagagtcctctcacatacagacataattattacccaactaatcctttttaagcacttcaagggccacaagaaaatgaaattcagtggacaaaatggcttcagagaacagggaaacacgtgagaacccagaggtaggtatttgcagtcatgtaccttggcagagtttagtgtcctagctatgaagtatgcgagtttataactttggtaggtgttcagtagtgtttcataagaaaagagagtagagtatgaaatatatcagtggctgtcttccaacccctccagatagagcttgaaactctggcatgagtgcttttaggaagagaagaggtttgagaaagcttcttggcaaagtctgaactaacccattcagattgaaacttgatgagttctatttgagaaataaatcacagattccattaatctgtgattcaaatacatctacatgtattttttaatgtatggtagacactgaggctctggaattaattacctcacagttctccagaaaggatctgagtggtttcttttccaacagcaaatgggccacctacatctagactccttgctgaatgaagagactccttgctcctcgtcatttacacaagagaaaggagaatcaaacatcagcaatagggggaatggtctcacactgaggcccatgcctggcaaggggactgtatcccaactgacagataatttgggatgcaagtgatgaaagaaataaaaggtattggattcatagggcattccttcattttaataccaaataataaatattcattttaaatctcacggatttcaaacatcacttgggcataaacttgggaacaatcatgtaactcaaaagatgttaagttattttcctgcattatgtcattctacaacagggattagactgcataatccctctggatctcatggatgtcccagatacagtaactcgtgcaacatcaggttggcacattgtcttctagtaacaggtttttctcaccctctaccaactcatatccacaatcctcacatgggtggtattgcctgcctttttgcttttctttctttccttcctccttttctttccttcctttttccctccttccttctttcctcccttccttctgattctctctctctttatagaaaaagacactaatcttagaagctgatgacgtcagtaagaatcaggttcttatctggctctaattgtacacagcatcatgcaaaagaatttaatgaacttaggagcctctctgagcttataatgtatataagaagttgaatgaggaaaacgaaggagaaagaggtcactggcccttataagaaccaaatccataggcagataaatgctgcttcacaatactccaggaaaacaagtccccagtgaacgtcctggaaactcagcaggcaagaccacaatttatgtgagaccaggagaaaaacaggcaaagaagagacacacacacagagaaagaaaagatatagaaatggagggaaggaagatggtggttaataacttcaggtagaatgtgacagaagagagcaagacctcaaaacaggaactttttcttcatgttttccatttgttattattaagcatgaaaaactccccaaaatagcacttgattcatcattttcagagctatcacaaggatttcttctatttttctgcagaatagttagcattcaagttatttttgcatgggtgccacagcacaacatgggcataaaactgtgaaaaattaaatagctcaaaagtgtaggtgggcttctgtgaaatttgtgctgaatgaatttttagaaagcagaatgcagtactagaattgctgcacatgtgttctattattaaatatctaactcttctaaattgggaaggataataacaagcaatctgtgggaaagctgaagatctaaacaatacaattctgaaaccaaaataaaactgatttggtattttttacttttttaattgttaaaacatcattgtggagtaatagtacaaagacataaagaaaaatttctaaaaaaaatattgtccatattcctatcatcccagcattaaaaattattatttctttcagtctttatccacaaaaatccataaattattaatgtgcatgtactttttgtgtttggtttcccactgagcattatcatgctatcacaagagaagcaacagaaagaacatttgattttgaacctaagatgtggtttaagtcttggcacacagtcattccttgtatagtcctcataggaatcattttcttagctacctaatatcccacagaattgatgtaaccaattttacttactcttctccttcttcttggacatttaggtcatgaccaatatttcacagttctaaatatcactgcaatacatatttccctgatatagctttcttcttatattctgttttctgtatccttgatataaattcatggcaggttgaatgtatttatagcttttggtacatagtgccaaattgttttccaaaagatttataccaatttatacttttattagaaatatatgattatatagcagacttgccaatattgaatactgtatggttaacgttctcctaatgtaatatatggaaaatgatatcccatcatactatgtaagtgttaaatgttacccgtattatattttaagattattagtgtaagctatcaggagttctgaaagttaataaaattttaaattatagctcatagaaatgtaaaagactatagatattatttaacctagtcttttacccatagagaaatttttgcagcaatatctttgatggagacctgataattatcttacacccctcactgtgcttaattgccctcattcaatgagtcactaagtcctactgtttcaaaccccaaatccctctcaagtctactccagccatcattatctttctcctcactgccatggccttagttcaagccctccttacctctcacctgggttactataataacctctttgccagtatttctgcctccagttcaatagttgacatactgtatgtggtctaaaatttcaatctgatggtgaacgctacttctctgtttaaatacttcaatagcatgttattttcttccaggacaaaatctgaacttcacggcatagcacacaaggctcttcataatttagctcagacttcagtcttatctcacatcagtaactccacaaccatctgccaccaactaatttcatgctcttacaaaccttcatctggacatgtcctgcaagatgcctttcaagggtccactcctccaggagaccttcccaacttcttgtcttcccagcattggttggacattcataacctcattcaaacagattataaacctctaattggagcatttattccattgcactgtgtttgtctagttccacattttcccaaccagcctattggttctttaaggttagaaatgtacttttaactctgtatcttcagtgtcttgcagagtgtgaacccttagtagtggtaaatacatgtttgttggattaaccaataaataaatgaatgctccagtctctgttcaacgtcttccagtggtagtaccttatcaaacagtccatctcattttttatttttattatatttaaaaacaaaaatttttagaagcaaggtctcactccatcacccaggctagaacgcagtggtgctttcacagctcactgtaatctcaaactcctgggctcaactgatcttaccacatcagcttcccaagtagctaggactacagccatatgccatcacacttggtagtatgttttttttttctttagagacaaggtctcactatgtcgactaggttggttttgaactcctggcttaaagtaatcctccctattcagcctccaaaagtggtgggattataggtgtgagccaccatgcccagcctgtttattgtgactttaaaaatcaaagggctcttttaagtttctgctacttgtgactggacaaatggtctgttaaacaaatttaaaagaaaaaaacaaccccatcaaaaagtgggagaagggtatgaacagacacttctcaaaagaagacatttatgcagccaacaagcatatgaaaaaaagctcatcatcaatggtcattagagaaatgcaaatcaaaaccacaatgagataccatctcatgccagttagaatgctgatcattaaaaagtcaagaaacaacagatgctggagaggatgtggagaaataggaacacttttacactgttggtgggactgtaaactagttcaaacattgtggaagtcggtgtggcaattcctcaaggatctagaactagaaataccatttgacccagcaatcccattactgggtatacacccaaaggattataaatcattctactataaagacacatgtacatgtatgtttattgtggcactgttcacattagcaaagatgtgaaaccaacccaaatgtccatcaatgatagactggattaagaaaatgtggcacatatacgtcatggaatattatgcagccttaaaaaacggatgagttcatgtcctttgcagggacatggatgacgctggaaatcatcattctcagcaaactaacacaaggacagaaaaccaaacactgcatgttctcactcataagtgggagttgaacaataagaacacatggacacagggaggagaacatcacacactgcagcatgttggggggtggggggtggggggcaaggggagggatagcattaggagaaatacctaatgtagatgacagattaatgtgtgcagcaaaccaccatggcacatgtatacctatgtaacaaacctgcacatcctgcacatgtgcctgaacttaaagtataaactaataatgtgcaaggtgcccaggcatggtaactcacacctgtaatcctagcattttgggaggccaagatgggtggatggctttagctcaggggttcaagaccagcctgggcaacgtgatgaaaccccatctctacaaaaaacacaaaaattaaccgggtatggtggtttgcacctgtagtaccagacacttggggggctgacgtgggaggatcacttgagcccaggaggtggaggctgcagtgagccaaggtcatgccagtgtactccagcatggacaacacagttagaccctgcctcaaaaaaaaaaaaaaaaaagtgcaaggcactgttaaagcatttgctggcctaaaagatacataaaatagttcatcttgtgtgacttactaaatataatatggataccatctttgacatgtacattaaatatgacgtctacccttataataataggaggaactacaaaactattttaaaaagaaagtgtgaacacttttagggaaaaaaaaatacgtattcaagggtgatgcagaacctcaggtccaatctggctgtatcagagaatcctcttgcaggtcagaaaaggttgtctgaggaagcaaggctggaagcagactgtccacaggcaaaggtgttgatgcatttaatgggctctggcagctgctttcacacatactcagtatggaaggaggaattgaagtagaaaaaaggaggaaaacgaaaggaacaagaaaaaggaaatttgcttaaaggaattaataagtaagcaagaagaccaaggggaagagacattatatcatattaattctataagcataaaaaagcttaaaaataagatagtccaatgccaatgtgatttaattattatgttgccccatttgaaaggaaatactgccttttgtaatctgtctagtgctagccagtggaactttctgctatgacgaccacattctatagctgtgctgttgaagacagcagccactagcgtcataggacaattgagcatatgaaatgcagctagagtgactaaaaaactgagttttaaatttatttttattttttattttattgtatttttttgagatggagtcttgctctgtcacccaggctgcagtgcagtggcgcgaccccggctcactgcaacctccacctcccggggtcaagcgattctcctgcctcagcctcctgcatagctgggactgcaggcacaggccactatgcctggctaatttttatatttttagtagagacggggtttcaccatgttggccaggctggtctcaaactcctgccctcaggtgatccacccccctcagcctcccaaagtgctgggattacaggcatgagccaccatttccagccttaaatttaaatttaaacagccacatgaggctagtgtctatcctttttgaattctgtactcatacagaatgagtacagagaagaattctgtactcatacagaatgagtacagagcagaattctgtactcatacaagatttaaaatataaagaaacttaaacttaaggaggacctaagggacaaattcccctgtttgggagataattaaataatatttgtattggtctttgcaatttatactatactttcatgtatttcattgaattaataagaatatagaagctaaagatgaatgtggagtctccatcaacagaggccataagaaaggaatcatagccctgtgtcttcaccaattagaatgtgattctcatggagcaaagcccttactgagctatattagataggaaggagacaacagtgattaagaatgaagactctcagccagactgcctgtgctcaaaacccagttcctatttcctggctgtgtgatcttactgaagctacttaacttctctgtgcctgttttctccttattttaatggcaatagtagtagtactgacctcataagagctgacatgagctatatgagctagcacatgcaaaacagctagaacagtggctggcatacaaaataaattgctcagtgttggttagaaattaaccaagggatcggcagtcctacagaagaggaaaacctcttttgggaggacacactgctctggtcttgccgagtcctccttctgactgtgatatgtttttgcctcaggaatgtcagatgaggtctcagacaaggttctagacaagggaaagcacaatattaaacaaataataatgatgggtcttcaaccaagttttcatttcctctgataatccaattccatcatcctatcagcctaattgttatcctatttagttttcatggccacttttccttctaacttctaatgggttacaaaacatagttaagattatgagctgataattcctatcaattattaaatgttttcatgtgagccgagtattataagtgatattcatagtcagaattcttggagaccgctacttttcaccttgcaactgaggtgtattttgtattcataatccttgctctttgctatgccctggcctgttcctgaactctctctttgtctgcttttccaagcctcctctgtccccatccatctggcactcacataccccctcacttctgcttccacctctctccagcaggctcactgcttggtgcagatggagagatacttttgaagttttcaggaaatcctctcaagggcagtgaaacaatttgtctgtgagcagagatgatactgaatgcattggaatggaggtaaaatttagaatatccaagggaaaaatgcgttagttaaaatagaggatgatttttaaaataattttcaggagtaatgggaaataaagattttcaaggtgtgccagagctaacaaaccacagcatatgacaagagctcctacaattgctaagaaataaaatgcaagaatatattttattctcttccaaatacaaattcaatgatgtgctttgaatcagtacatgaaaatactcaggttgcaaagattctgtgaaaaatggtaatctctaggggcttatgcattaatccttacctgaggcatgcttttgcatgtttagtataaattattctttataaaattgcactgagcataataggacatgtagcttgtaactaggttaacaaacaatagattaatagcatttcatatcattcacagataactaaaaagtcaaaaacccaaaatattaataaagaatttagaaaacattacttcaaatagaagtcaaattcatgttttggaaaatactagtattatctcaataatttcagagggcagaagtctcaccaagacaactgaacaatgtaaatatgtctttataattcttcattttctagtttgaagttgtaaaaaaaacttcataggaagaaaaacacagtctcctgcaacaatgtgagttactaatgagtccactgcttcctcaatctcacacaacattctagacaaatgcctcagccagtgctattgagtgacatcagctcacattgcaatatattttctgatgtgtataataaattacaaatacttaataatttatcatggttgctttgagagcatcacacagcacttagcatctaactcaaaataactattgcccttctcacaacaaattccaaagccctcatttttctacttactatgctaattaacattccttttaatcttcttctttaatttatcctgtaaattttaaaatagcatcttagaaagaaacttaagggtaatcttgggtcaaccttaccagtgcaggaatctcactagcatctctaaaagatggccataaatgattttttctattctcaagactgttttatgttggttggtaggttgactactttgtttagtttgcctttgctatgagtctttctttagaatctattaagttaattgtggcattcggacatttatttaaagggcagtggaaaccaaagtgtgtaaaggctaatactcctcaatgccaaaagtaaggaagttaagaaaggtcaatcaatgattaaattgtttatcattagttaatataaaataaaggatgtatttttagctgacaaactaaattcaaggttggcactacacaaaaaaaatcacagacaactgaataaagaattaccacagtattagttatttaagacacgttcctgtgtatccatggttgatcaacacacaggattctgagaaaaattattttataaaagcatggtgctcaccttaaagagtacactatcttgctagagaaaatagacatacatattaaggcatattattgcattcaaagggtagcaggtaaataatatacaaatatgcctagagactacaaattaagtttaatgaaatgagttaagcactttcttctctccactttcttggagaggttcaggtcttacaaattaggatatgtgaaaaaagaataatagtcccttatagccaggcaggggtgaatattataggtcacataaagaagaaaaattcaaaagaactctcagaaatgaatttgtgtgattcagattgtggaggcaagaaagagagagatagatggattccctcaaatgtccgattaagacaagattggctatgaaatgaagtagagatctcaggttgtggagttatatcatatcaagaagcagtaagttaagagagctgtcagagttctagtggctgaaacctatccctatccaggaaaggctaaaaccagaatgaggatgactctgatagtgaaaagcccaagattctttctctaaggaattatgtgtgctgactcctagaaagacccatcctctcacagttacaagaatgacgccttcagcatcacaaacacagctgcaatgtggcttagcccccagcagaatgcaattgacagaaacacatttatcttcctctcctccagaaaatatttttaaagggactggattcaaagctacagaaaagcaaggggagggctcctttaggttgtacagtcaggtgcgaagagcaatgcaggcaaatagtacatcctggaaagagttaagaacatagattaaggattggatgaatgttatctggaaatttcctctagtcaggtaaaagctgaacacaccaagctctatgacttggtccagtctctgttccgttcacacttcactggctacttttaactattctctatgtagccttctctgaacccacatttaccaatcccaattaaattctcacagcacctggtgttcttagcactaatcacagcttataggtcaataactctggacataccggctgataatgtaggaggacagtggggaagtcaagggctctgtgctgtggagagaaatgctagggttcaaatcttggttccaacaattcctagttgtaaataaatgtatttcatacctcataatgttattgtaaagattaacaaccagtacatgtaaaggatgcagaaaaatgtctgtcatgtaatatgtgctcaataaatatggggtaacatcatccatggacccatgagagcaggaaccatgtctgtttcattctctatcacctctctgggactagcacaatgtttgggaagtagcagagcttagtgaatacatgtggagggcatgaatacttaatcacttcattctttgctacccattaagcccttgatatatttgttgatacatgtttactgtgtctccttattccccagttgctaggggtaagacattgttccttttgtatgccccacacaactcttcatgatgttgatacttaaacttaaccaagttctttcccaaatacttaaggagtcagatttagagaaatgtggatggaggcaaaatcccctggagttctcaactgtgctatcaagatgcttctacattataaaatggatataaaaatacatagctctagtatatatttaagaaggcaaaaaaatggtttattcctctaacttatcaactgagagtctttcagccacaaaatgtaattatttagccccactctaaatcattcataaaaatgttcagtgatgggtctccacagcatgcttatgactttttaaaattgattttaataatggtgtacatggaggttaaaccacagagttaaaaatgaacatactggcaatatctaagccagagaaatagcaatacaaaaaaattgaaaggcaaatgaataaaatatatcttcaaatgactggcaatattaaagtcaaaaaacattaaatagtatgagattacacttaagggtcagagacagaaatctcagattctttgtacctgtagttagggtcaaaagagagacagtaaacacttacatgggtcaaatgagacatgggcagaaactagaatggctggttggtaggactggatctaaaggaggtagtcttttctgtgatataatttctagctttctgagagagtctttgccttcataagcaatattacttagcataaatctcacagttagagcttaatttctttgactaagatagtgtatgtttctcaaagaggaatactttgactccttggaggtttggagccatgtgtcaaaagattgtgcaaagccacaggataaacatagcttattttcctgcaaattatgtttttcttaaatattggaagcatagggagatgaacgttttaactggtagtaatttagatcattcgtttatttaacaaatgaataaattatgctgtagaatgcaaatcttgtacatgtaaagaatgcagaaaaatgtctgtcatgtaatatgtgctcaataaatatagggtaacatcatctatggacccatgagagcaggaaccatgtctgtttcattctctgtcacctctctgggactagcacaatgtttgggaaatctcagtagaatgcaaatcttgcattctacatttttaaaaacaaagcatgaaactacagagaggcatcatgtttgtgtagatcactttagggtacctagggctttaggttgaagagggaaacttccatggcaaagacgcaaaaacaagagggaaaggaaatgaaggacacaaagacacagttcactgttttggctgagacccagaactccttagctcagaactactaacagcaaaggtggcagagataccatggtagagtctgcaaaatgcaaacttactagaactggcaatcttcaacacctaggcaggatggcagcaactaaagctcacaaaacactagaaaagtatgttatcagagttgaggagatgctatgtggacatgggggaggagaagaacaatttcaaggtctgaatgagacaaaggccagagcatcagatctgcagttacttgtcaactcactgaatggtgagggatgcaaaggcacaggtgtgcacactagcaaggttcagaagtgaattttgacaattgtgtgttagagatgataacagttcaactgagatgacaaggaaattgcttatagatgtccacatgaacttaccacatcagaaaacaatacatatgtatacctttgaaaccacattttccaaccctactcactttcccaggcttgatgccacctctgtgttttcctcctcctctcatcctaaataaaccttgttcctcaatataaactcagaaagcagtttcgtctataggttcagtgttttcaggggcagcagagattcagacagggtaagctcatcatttttacctcttcattcaccagcgtaagtgtgcttgctctcagacaaacattaccactaccaagcctgaattactctatctgggctggcaacaatggcagtattaagaaaagataaaaaccatctaaatcatgctgcttggaactagttataaccacctttccagacacacagatacgtttccatgattaaagtataatgtggttggctgaaaggaactcagaaaatgatcgatatttgaacttaaaacgtttgatcacttgtcctgtgattttttttcttaaaactcaactcacattgtatttgtaagaacacagggaaagagctgagtaacaggacctagaggagatttttctttcctatcacttttcatgatggataggctccttaggaaagagaaagtatttaagggcttgccacgactccagtcatgttttaacctcattttataacccgtcaataggattgtgttacagactatctgactccccccactatccgctgttcactctcccttttagttatagaattccctgaattttatttaggcaaatggctatcccactggagactacacctccctacttccaacagccttctttgcacctcggagtggttaaaggactaagtcttggccaataaggtataactaggaaggatgtgtatacctttcagctcatgtttcctaaggacaatgttcaccctccactttctctcccacttgccccttcctgcagactggaatgtgagcaggattgtgggagccagtttcagtgctgcagctgagagcaacccccggggactcagcagagtaacaaacagaaggaatcggggctttctctaatcaatgttgcagagaagaagtacccacccatcctgggccacctacccaccttgattgagaccattgggtaaaaaagaaagaaatttctagcttgtttaagctactttcacaaatctctgttacagcagtttagcctgtattctaatatacagtttctacctagaagtgggtattgccataacaatatctgagaccagggtcacaggctgtaaggacagagatacagatattgacagctggaaagctgaggactcctgctagaaaagccaactttttctgttccccaagcagtacaaggtaagactgttgctcagagcatccttcaagaatctcctatattctcctaggccacacaatggcagccagttcaaacattcaggtagggcaggcctggatttcccattcgagcctattgcttcagatgacctcaaggaagaagcccttaaactgagggagttaggagtgggctaccaaaccaataaataagctacaaagccaataaatcaaaaggtagttaaaaactacagccaaaggctactttaatgtggaactggaagcagacagactggaatttttgcgggtattacattgccaaagaaaacaaaaacctggctgacagagctagtgactgttgaatcactaaaccaaatctcaggttcccaaacctgcaccagtagaaagcaagctgtacaaggagggaagctaccaatgagggcatattatctaacacccaccacagatgtggccacaaaagacagaggccatcaaggacaatggacagggagttatacccagagagtgagtttggattggccaagatgacctaataaagactgccaagtagttcttgcccagagaaatgtaataacaacaacaacaaagcgctaactcctactgactagattatgctgtttgcctcctcctcttttccctttccaagtagggatttcatggcagataacttgtcctttagtgccggggtcactggaggcacatccaccctgatagagaggcctagacatatcccagagacctggactctcagctgggtgcagtaaataaatgggctttggtttgcctctttgggaagaaggtgggcatatcctctacgtgggatgaagggtaggaagggatacttagatgctagggagacaagctgtgaacagagactattcattatctcccatgtccattcttctcttgtccttttagataaggaactaccagaaaggtggctcagtaagagcctacatttcataaccccctcttgtagctaactagacatggtcatataactacattttggccaataaaatatgaattttagccaatggtatacatgtttataaaggaaattttttgtccttaactttctctgtcccttccccttctctgtcccttcccccttcccatgggccagaatgcagatgtgaaggagggtgccaccactgagcacatggatggggacagttgcctggggatgcagagcaatgagacagaacctgagtttctggtgacttcatggagccaagctgcctaccctccctgaaatgccttcctaaacaacatctatgttgtttgaagtattacattttgacatctaatttttacagctgccaaacctgtaccctaattaatataggagaaaattggaaagcaaagtggtttgagtgcaaagtctatatattgtgtatacatatgcatgagctaaaggtgaggacctagaaactgtcactttagaaagaagaggtggttataagataaagtagtaagtgcattaaaatccagcattcctcaccaaagcatagctaagaaaatccatttgaataagtaaaactatattcaacttgaaaacactttatcttaaaaaaagaattgtaaaattaagacaattttcttctttttcaatagtttaaagctaatagtaaaatatcacttgatcaactcaagaaggaatcccataaagttatctgaattgataaatggttacatgtgcaaatatttagtaacaaatatcagaaaataaaatcacatagtatacaggcagttaagtgctctgattctgaaaacagatggatcgtttatacatcctagttctcccaattacaggcaacctgaccttcagctacttacctagactctctaagcctcagctgtctgtgcttcagtttcctgtggatcaaatgagataatgtacaaagcacttggggcaatgcccagttcatagtatgatttcaattaattttgtctaaaatcattgccacctgattgtaaaaatatctctatcaatcagaagatgggcatcttaaccatcattgttctatgagactgacctctttctcaggttggcaagccataaaatgcccagtgccttgagttttaatgaaagacaccaattcaatcagggcattcactcatttaccatgtgtattgataccttagcatgaaaagcatgatcaatgtgataaaataaaaatatacttctaggtttgagaagccaattcccatgtcacccttatttagctgagtccacctaaataagaacacccagtctttgaattatcactccctaattgactgatattggacaagtctccacatatctttgagactaggtttcctcatctataacatggaaaaacaatatctccctcatgggttgctatgggtattaaatgagaaaattcaagcacctggttactactatgcctagaaagagtaagcattcagataatggatgacggaaactttattactgctatagttatggctacataaaatagttaaatacctcatcataagaaaattgtgcctgcatgtatttgagacccactggttgtagggtaaatgctttgtgctatctgtctcatcatactgatggcccatactgaccacacatattcattctctcccaatctcagtagataccaaaatgctatttttgcaagcctgttgtccagagatgggatgtattcatgaaacacagacttcctccactctgtgaagtcaaatagcttgcatgagattgcatccacaacattgtttcttattagtgtcacattctgttcaactaagttgaccactgcaggctaagtgataattacagcaatgtgtgtcatccagtatcctccaaaacttaatgattttacaaactaaaagtatatctgcaaagaaaatgttatcttaaccttcagggagctgattgggacaatcagtgtaatcattttaccaaacatccagggtggaccaggggcctttatctttcacctgtaacatgaagatgaatctgaaactaaagcacatgcttgaaactgaagggaaaatgagtctttttcttttccggattaaaatagaaccttcccactaacccccacctgcaattccaattatttatcccatttctatcagggcagaagctatttagcatggcttatttaatccattgttttatctttattttttaaataatcaattttgccctggctaatgcatttacagtgtttcctcttgcaggtttctgatatagtcaccacccaggtctgacctagttttctaagctgatttttctcagccatggagcctcttgctgagtggcttcacagttcatctgcttccattccctaatgccatggtccctgagaccatcttggccgcatatggtgggcactcactggaatggttaaaattgctaccctcttcactgaggcctcagaggagtatgtaggtccaactcacactgctcagcagtgtcagagctaagaccagaatccatcaactttgttgtcaccatgtagacaagagcccttgatcctccatcactcaaaacaaaattaaagatgagctcccaattgaagtgttctactggtaacctcatataggcacagacttattccagaactcctggttatgctataatatcccttgctgtcttctatgattgtcatttggggtcaatttgttgttgttgttgttccttctcttcctttgaggatgcttttggatttgtccagctggattgtttggtccttggctggttgtcccggctaagagcccagcctggagccagtgcccactgtgtaagcaatgcagatgacattgtcgaaaaagggactctgtagagcattgtttgcttagttggcccctttctagctatctgtttgcaactaccttgataaaaaggtgctgataatgagggacagagttttatacattttagttaatcatctccgcagcaggtttttatacaggatggtgatcaatgttgaaattctacctatctgcccacactgactcattagtcatgagcatttgtcatcatacatggggacttcccagtgccctgcactgctttggccatgtgcttaggaaacactgggccaaaggacatctatccagtggacgttttcaatctcagcagaaacaattctaattctgcacttcctgaaataaaatcttgccataatcaaagcaagaaaattaaatcccttcctagaaataaaatatacttatttgaaagtgtttcaggccttgcgcggtgactcacggctgtaatcccagtactttgggaggccgaagcgggtggatcatgaggtcaggagatcgagaccaccctggccaacacagtgaaaccccatctctactaaaaaaaaaaaaaaaaaatacaaaatattagccgggagtggtggcgggcacctgtagtcccagctacttgggaggctgaggcaggagaatggcgtgaacccaggaggcggagcctgcagtgagcggagatcgcaccactgcactccagcctgggcaacagagcaagactctgtctcaaaaaaaaaaaaaagaaagaaagaaagtgtttaattagcagacaagttcgtgtcatttttttaaatagttaacttttacttccagaaaaatagcaaacaagataatactcaaatgcaaccgtggttgcagaatctataaacccaaaagtctgagagatttacaaataatcaatattataaacaaaaatcacatctacctagaaacatttcttttaaaaaaatctgctggcaagtccctccactcttacctcaggtgggccataaatattttcttccaaatatataggataaccagaaactttctctttctttaaacaacaaaaattggtttataattaaaatgcactttggcatacctttctgcaatattttcctcacttgagttggagtaaaaacttgagagaattagcaaagcctgttaacctcatgaattgggtagtgaatttggcaaggtgacttctccagactttcaaaaagaatcaggcaggaaaactactttctggatgttttgattacatgagcaagcaaatttccaagcatctacactcccaataatcaagtgatagtatggaaggccatcgttactatattgagaacgtacctattttttaagtgtcaaaactgcccgataatgaaatacttgccgtgtggtccaagataaccacctggcaggcctacatgctattattttttttccattctgcatgtcttttgtcctctcttctttatatcacttgcccacttcagactatgaaagttgcttgagggctgagcccatattgccaataattcattataattggaagcagtgggtgcttaagcactcattacctgacaaggaacatcacagtaacaagctcagtttagaggtcagtgttaacaaggccaaggtcctagacctgagatgggtggatgtggacgtttgctctgctccatgacaataagccaaataccttggtctgtgctactgctcgcccggcatgcagcagggaggtgcagagcatgaggagtatgtgaatgtcctagtccaagtccccagtgcagctaggattggagaagtataattaaatattgctcagcccagaagaatcagggtgtggtccaggtcagaaacaggcagagtgaagatgagactcaccggtgctaacctttctttcctttgctaacacattcaagtgacagccacacttccaccagtagcacagactcatgagaactggtcattaaacagagagtactctcactgggcaggtgaagggggatatgtccattattgtgagaggttcatgttttgacaaaaggatcctgatactgatacccaatactgagttgaaattcagtcaagtagagcggcacatatgaatcacttggggatcttattagaatacaaattctactcaatatgtctcaggtgggacctgactaataagctcccaagtgatgccaaagctgctgggcctttggctctctctttgaaaagcaagattctagattttatcagatcggcaggtgtaagggaatcctggaccccatgaaactggaggttcagaaacatctgaagaaactgacaaattactaatggtcagagtcaccaagttttcaggaatccagagatcacaccagtcacaatcactcaaaagatgccagaattcagtcccaaccagtgccctgggtttctgagtcccttttttctctctccactacccagagcaagcagccagggactgtgggacacatggcagagccctgatcttgtgggcacaggcagatcaaagtagctaaagatgatgttaaagagacaggtgtggtaggcaccaataggaggctaggaagtcaaggtcctccaatctcagacccctgtcttaagggtaagatcaaaggctggcacaaaacttacagatcattttatacaaaagttggtatatgcttggggccttgtgggacatcttctccatatcaaatccattaaatcattggcccagactccatttgtctttaacaggaaggaatagctcttggggtgattcaaggtgaaaccttatccatttcttccctctctctcattgacgccgtgtatgtgcaaggtggtgaggcagccgaaattaggactatagagtccttcatgttcacagaacaagtgctgcaaatgggtgtgagtcagccttgagctcaatcgagagtaaacagacaaatttacattcatatatggatttagacatttgtcaaatatttgctaaaagagcatttcacttgtcgaaggaaggcatagccttaatatttttctttctttctaaaggactcgtttcacccacgtgcttgatgaaagtttaaatataaaatgcctgagatgaaaatgtatattaatatttttctgtctttccaggtagatctgctgacctccttcttgtgctaaatctattaacaagcaaataaagctgaggtccttagatcagtactatagccaagagatactaatagtacccatcaaaatcagatgttaagcctgtccagagagctcctggcaacctgagagactaagctgacatgggcattcctctgaccaccaacaatggaaaacaggatcaaacatatccaaaataaatcttataatgtgatctgaaattaagagaaagataggaggttctcagaagccatgaataaatacagaagtaaaagtcaggaatatgaggtggacctgggctgcatgcgacatcccaaaggtgtatttttcaagaatacaggccctagaggctgggcctggagtcctggccttgggctgtggcccagcagagaacctaaactagatacttgacccatgagggctgcacaggctttgaggagaggattgggaaacccccaacgcagcccagggggctgaagcaaagcttagtttctactgtaaatatataaattattaaagatgttaaacagtagtcaaaaagaggtttagaagtgagatttgccagaatccatcttaaatttcaactgttccagaatatagaaaaacaaattagccaaagtttctgttatgacctcaatacccaaaagataacataaactaagcaaaaagagaaaccacagactgaaagagaataagtgaatgtaggtaagacacagataactagtctccaaaatacataaagaacttacaaaagtcaggaaaagaaagccaaacaatcccatataaaaatgaacaaaggatatatattaatacttcactagcaaaatgattctaaaatctagtaagtagattaaaagatgctcaacttcaataataatcagagaaatgtaaaatgactaacaacgtgatgtcatttcacatccaccaggttgagaagtattaataactcaactgtgagttaagatatggggaagcttttatatccttctggtgggtgaggaagttggtaccaatcttttggggaagagaatgaaaatatctagtaaaggtgaagatgcagaggccatagatctataaattacatgtgtagatgtttactctagggaaaccctgacaaaggtacacagggagccatgcaagaatgtcccctgcagaaatattcacaatcgcaaaaaaatacaaaacctaaatattaataaataagcaattaataaatacatggtggtatattccaatttatagcattttatttctttataaaaggaaaatctctatgttacaaatatttctattacttaatcagagtgatggatatagaagtttttatttgtgttttctgtattttaaaacattattttatacaggttgagcatccctaatctgaaagtttgaaatccaaaattctccaaaattcaaaactttttgattgccatcatggtgtcacaagtagaaaattccacacctgacataagacaggttgcagtcaaaacacagtcgaaactttgtttcatgcccaaaattgttaaaacatactgtataaaactgccttcagtctatacatataaggtggacatgaaacaaatgaatttcatgtttatacttgtgtcccatccccaagatatgtcattatgtatatgcaaatattctaacatttgaaagaaattgaaatccaaagcacttctggtcccaggcatttcagataagggatatacaacctataattaacatttaaataaaaatatattataaagtctacctagagctatacattttgtcaagggaagttatatctccccatccctatgtagagatgcacacataaaggcctggaagaatacacagaattattaatagtgtaacttagggaagaaagtagaacagtagaagaccaaagaggaaattttccctttactctgcctaattctgtgtttttcacatatttatgaacacatattcatgtgttcaatgtgattgcagtgaagcctcaattaatgtccttcctacatccacaccctttgccctgtaattttgcattcttccttctgattctggctggccctgtgagttggtttggcctacagaatacaaatgaaatgttgatgtgccaactacaaggttaggtctcaagagactgtcatggttttccttgatctccctcttgcagttagacttaaacactcttagaaaaagtctggacttggctaggcatagtggctcatgcctgtaatcccagaacattgggaggccaaggcaggaggttcacttgagtccaggagttcaagaccagcttgagcaacatagtgagacccccccatctctacaaaatattacaaatgtagcccagtgtggtgccacctgtggttggagctacttgggagactgagatcagaggatcacttgggcctaataaattgaggctccaatgagcctgagctgtgtgccactgtacttcagcctgggtgacagagtaaaactcagaaaaggaggggaggcagaaaaggaaagaaaaagtcaaaagaaaggaaagaaagaccaggacttgccagctggatagtgataaaccatgttcaggagaggctagttatcctagccaaagctattctataccaacctgtagatacaagagtgccaagtcatgatcaacagatctgcctacctgacccacagtgactacagacccaaactgagaccagagaaatatccagcagacctataaactcatgagcaatagtaaatgcttattatgttaagccattgagttttgggatggttttgttatacctcaatagttaattcatacattcatcagatgtaaaatttttaagagtggaaaacaggtccatccatttgagaaaaggtgacctgctgattcatacctagacacaatatataacaattccaagcctttatgattcatgtcatcattagagtttgacatcagaacttgctctatattgcccacacactgtccagtttcttatctggaagatgtgtccttcatcttccatgaagctggagccccactaactgaggcttaagtgggttattttagcacatcttctagcatggtgtgtcatgtcaagtaccctttatgaggcttcatttactcttcatttaccctttgtgatgctattcaaattgatgtaggaaaaaagacaacaaacaacaaattgtccattaacttgtgctgcatttggcaggaaagtccaagccaatatgaacataaagagtaatcaaaggtgtttaatatgtcattaagtattctccgtactgagccaactgtgaaacagaagcttggagagtaacattaatactttgccccttgtatatattatcagtcaatattattcaacatattgttttagttgtagagatcaaatgcttggtgcagcagaagggtacaaactggagactccagaggctgcattctgcttcagaccagtgctgggattttgagcaagtaacttaatttatattttaagtataacttgtttatcttaatgtatatatattgtatatatatgcacacacatacacacatatatatgtatgtgtatatatatacatatatatgtatatatgaagtaaagaggctattggacttatttcttaggttcctcccaatatgaacattccaagagcctgtgacagtgaaacaagccccgaggccttcctatcataaaacaaccttttcattccattttggtctccatagatttcagtgtcctttctctcagtcgaaatcactcacttcaaaaacttggactaacatcaagattttagccagaagcaagctgaaaagtagttgccattggagactccttaatacctcattgttaaactggctaatggtgctctaaggatgagccgttagaggaaatggtcaagatcttcatctcaagggtgaggaagctaaggtcctgaaaggtcctgtgatttgccaaatgtcagacagcatcctagcaaagagggtaagttctacttttaaggtttgtgattccagatccatccgttaatccactcatgtaagatttgtcgaacacttacagacactatgctaggcgctagggatgcacagttccaagacaaacctgttgccctcatggagctcacagctcggtggaagtaaaaaataagagaaacactattgaatcttgtcacacatgattagacaggaatttatgggatgctctgagaatccagaggaaagaataccttactctgcatgaagagacagggaatttttcatggaggaggatataattgagctgcattttgaaaaataaggagttttgaggcacacaatacataagaggaaagggcacagaacacaggacatgcaaaggcatttaaacacacaaatgtacacacagatgtgtttgggagactgtaagcagctggatatgcttccatctaggatgcaggctgggaatgtcaggaggcataaaggaagaaataggcaagaacagatgatgccaaggaaaggagttttgacttttgtctagggagatgaaggagccactaaaagacaggtagcaggcatggctatccttgctttcaacagacagcatgtccctaaagaagagaagatgagaggacccagttaggaaaggaaggatagcagtgggcggctagtccgtgcctgctgctctttcctctagtctctgttggatttccttcactccagcctcaatgtgccattcatcatcaatgacgccatcccctggggaagcgctgtagacactcgggattctcagatgggccagcccaaggaccacagcctactgccactcatggctggctcagtgcgtaaatgctgtcctgaacccaagagaagcatgaacttgggggaaccccagagacccacagtaagattcaaccacagatgagtgtggttgagtgacactaaggtagtaaatattctaacagatataggttaaatttcaacaggtggtttactaacttggtaactgtgtgacttcaacaaggttatttcacttctccaagtctgaaggtcctcacctatcaaatggagataacactaacacctaccttgtatcctggatttattgaaagaaattatgcaattaattatatttcatctgtgcattcctggaacatggcaaatactcagtaatccataattataattattaacatttagcatcatgcagtcaagcaccttgcctatttctagagaagcttggaacctgagacatggtcctaaaagaactctcctcaatatcacactcccattctctcccctccagagacctcgaagacaaaacattacatttaaaggcctcttccctgatccacagcagcatttcttagattcttatgaagcatatttaggttaagataaataaaatatcagatctacccttggagtagctaataaaaaattttaaagtgattttcttccttctacctccaagaagaccctcttttaaaaggtgcaatgagtaccagaatcaaaatatatattacaggtttatttttcatatggcaaaagcagtatgcctatctctgtcctcgaatatctccatggttttgtgagttaagaattggagttaagaatgtccctttagatggaaactttgctgaaattttatccactcatttattgcccacatgagtttaaaaatgagaataaagctagatcttttacatcactggaaattttcttatgtctcagcaccatccagaatgttggcaatattaacagaccagcaatacttcttgcataatggagccagaggaataaggaagggtggggaggaggaagggagcagaggagagctttgggagactttccctgactaattcttcttcaaaactgtgaaacttacaatttctaaaaaccatagtcatgatgaaaatgcctcctttaaaactgcagccttagaggaagcctgtaggcttctgtcgagtattttagatcaaagacgtgggtttgaagttgaggttaattccctcactttgcagtaccactaaaatgaacatcacaaataaggcctgaaaagcaatggctcgattccttgaattaactctatcgtttctaggtaagtacttggaaaacactgcatttacaaaatatatagctggttgaggacccaggtgattcaaacattaaaatttactgagatttctgcttagtttgcctgtctgcttattcaattttgtttcacacttgattaatcagaccttaggttgaaatagccaaatgatctgatagagctttctggtaagaagaatagtactgcagaaaaatattcacaataaaaattgagatgaatgattcaggtatgtggaatataacattctgtttaaattatacatctgttgtcaaaagatacatactttgtaaataagtatagaaaattatctggaagaattggtactagtatattaacagcaactttctctggttagtaaaattggggatcattttcattttatttttatctatttctctctctctctcagtatcgctttgaaataaagacagctatttttttaattccaagtgttttcaattgtgtatataaaccaaagcatcaaaaacttcagcttagagtaaaaattagtacatttaagagcaattggaaacacaataatgattatagccagttttagcttccatgttccataccccatgctaagcatttcccatggcttgtctgtaaccctatgaggtaggtattcttatcattcctattgtataaattagagaaacttaggcatgaggatgttaaataacttacccaaattcaccgtactagtaagttgtaaaagtcaaaaacttttggtggtccagaccatctgattaacttctattttgttctacctggattgatcctaaatgcagcagctacatgtagcagctttgtccaagtcttttttttttttaactgtcttattcttgcttcttttataataatattaaacttccttagtctgttaacgtggcacacctatctgcaagggaaagtggtacataaagaagatattgtcatatatctccaaaatggagtacaataatgctgtaaaaaagattaatgaagatctctttgaattgttacaggctaacttccaggatgtactgttaaggtaaaaaaagctaagtgcaaaagagtatctatattatgttactccttgtataagaaaagtgattataagaaaacacatacataactgcccatttgtacaaagaaaatatggaaggaactcaccagaaactaaagaaactatctacagagggcaggtgtcaaagagctggaaagaagacggaaatggttatgtgtatcaagacaggatggagtgacagatactgccttgggtgcatcattttgtaaagctctggctcttagaaccacagttatgattcatatttttcacatgcccctaagcaatcaacaactaaaactaacaatgatgaggatccaaaatgcaatacaaaaataacaaataagcctgttacaaatgagttacaaaactacactgaaaggatggggaatagtaacactaacctaaataactacagaaaacagtatcttgactggataccatgaagctaaagacaaatacaaatgcataaatgctagaatttagtcagtaaatatgtttctcgcaggggcataggatagcaattctaaaactatgtgttcactagaatcaaacaaagaagtaaacatatcatggaaaataagcagatttctcactatttgagaaataaattacaaataaagacaggaaaaagctaaaagtgaaccctgagtttacagtatttagtataaattgtatagtacaaatggctttaaatatctatatagacatatagataaagaaatatagaggtgtgtatatgtgcaggttattcatatgcatatatttcctggctctgcctgctgagaaggcttagagcaatgacatcccagtagtaataagcacatctagcatgaagatctcagtttctaaacaccattctctgatttaaaaaaaagaaagaaagaaagaaagaaaaaagcttggacaagtgattgatttcaggactagagcaggaggaaaaaaataagcttagaatatagtgtgaagcaaaaaagtaagaaagtgttcaaaaaaataaataagggcttaataagagagcacaaacactaaatgaaaataagctcctaacagccaaagctggaacaaattaaacaagttaaataataatattagaatatgacccataaaaccaaataaatatatataagttcatacacatggatataaataatctattatctaaataggagagaaagacagctcttccatggctgtagaatcccaattaatacatgttgaaagaaagaaggaagtggaaaatcaccattaagcaaacaccataataacaattgtaactagaatcaaaatccatggatgtatgctgaaatcatttgttcacagtctaaagagaaacaggatttgcacagtcttaaagcatgtcccccaagatctttcttaacagtaggagaaaagatactaactataaagtggagaacccagcagaaaccaccttaatcaagtggtcatgatcaacaccaccactaataaaaaatattggcatcacaaatcccatgacatgatgtgctgagaagaacacatcatttctgtggaattcttgccaaaaacacataacctcaaaccaagcatgagaaaacaccagacaagcccaaattgaggggaatttggcaaaataagtattctatactcttcaaaaatataaggtcttaaaagttaaggaaagatgagaaactgttacagatttcaggagactaaggagaaataacaacaaaatgtgacatgggatcctgaacagaatcctggagaataataacaatgaaatattgatgaaaaaactggtagaatttgaataagatttttgtttaattattggtattatatcaatgttaatttctgggttctgataattgcactccagttaagattttaatactgagggaggctagggcagggatatgtgaaaattctccgttccatttttgcaacttttctttaaaagtagtttgaaatttaaagttaaaagaaaaggtattgcctttacttcaacataattaaaaatgctttttggaaaagtaaatctcctttgaagagaaagaccaggttgggggagaaaaaaaccactgatgtgaaaattataccggggaaaccacactttgttaagtttccacttttggatacttatgatgacttaagaatctatatcaacaattctgtcccttgaattcaacacactgaggttttattcctcagctataatcgatcttaatttttcagtttcaacagaaagacatctttccctcttgcaaagaccgtggccttaaaaagcttttgtcatttctcagttgtttgcaactccaacagtgaaataccgccactacatttgatttttggcttaaagaaactctattgctaagatggacgacttgggcagtgtatttcacttttgtttgctgatgtgttgcatttatttgctttcacttatcaagaaaagagccaagtttttttttcttcttcttctttttctactcctccacctcattctctcctgtttaaccatgtgtgtcagaaggagagctatcaaaaggaagctatgcaagttaatcagtcagggcctgagagtgcccaggaaccgtttgttacaacagcaaagggaatgaagcctccaagcaacaaactaattaatacctctctcttctttgaagaaaatgacccaatattgaactccagtggattatacaacattttaatttactatctgctaaatggatgactactttataatatgcatttctacttattcatttactgacaacaccagtagtcattcaaattgaaccccctggccaaggtctaagagaaacctaactaggactagaagatatttaatatacactattatatactcatgcctcttgtttctaccaaacgagatgccatatggaaagaatgttgcacaacgctggcacacagagcagccaggaacttttccttgttgctttcttcttccctgcctctacttctcttcatgttgttattggtaaactgtttgctaagatgtactttccagataacaattcagaaaacaggtaggagacacacacccttagaaatatcaaaggcaaacttccttggaagtcaagtgaaaaactgctgaggagttaaaaaggcagcatggcaaggtcataaatctcactttattgccagtcacggggacatgaaaatctgaagacccttaagcctttcccctgaatcctaagacagtagggctacatgccctggaaataacttctggctcaaaatggactctgcaaataatccaatgtgttcctagggttgctaagtctagcaaatagcaatatagggtgtccatgtcccaggcgatatttgggacatacttatactaaaaattatttgttatctgaaattcaaatctaacctgtattttaattggtatttcccttcccccttatgagaaataggtgactaatgctacaatttaatttccagacctggacttttatatagattcattactttctaactgtgctactgaagcaatttaatgtccttactgtacatgtcctcatctgtcaactgagataataataacaataactttctcatagagtggttgtgaagagtaaatcaaataatctatacagtacctggaatatactatgtattcaatacatgcttgcttttattgtaattactgcagtattactgtttgcattaaaaatatttgttgaaagaggaaacaggttaataaacaaagtttagattttatcggaaagacagtatctttgctaagcaaggtagagaaagaagaagagtctgtgaataaattaagaatctctaaattacactgtaagattttcctgtaatccccaaataataattactgtcaggcttcagaatgaggagagcttgcagaattttcttgcagtgttttacacatttcatttttcatttcaattcagaataaaaggcaaaagaataagagtgaaacaactaagataagcccaaacaaaaatgaggaaaaggtgtatatgtaaattaagaacacatttattactagccttttttaaaaaaggaatgacagtgacctctagtaaaatatttctgtctagaggcaagattacccatgcctggataacagccaatgtttaagctcttctcttagaagtgtcctatctacctctcccaccttcatttcttcaagaagtcagctaagaacccatcaacaccaatacaaaggctgtaaaataacattttcctcttggctggatgcaaaaactagaactgcagaaaagttctcaataaaaattgtttgaatcgctatcaactcattctttctgctgactaggaagttaaataaataaataaataaaagggactccaagtcaccagttacgccagcagtttgcaaaaactattctctcttttgcaggagcaagggtcaacataaatgatttattgtctttatagctagtatttataggtatttgagggtgttccataggctcaaatgggttccttttctttatctggcctcaagagattaattattcctgtcaattcaaatctatcttcctgttaacaaatcccaatgggtcttttcccctactcaatcagataaactccagattctaacattttaatgatttttttctgcattacagtgctgcttaattgtatagtgtttaaagaatatgtggatctcgataggagtttttttatttccttaataagagagcctgacaactttgtcaacttaatgagtacacactgatgtttgctatgggggattttcctagtgattataggacttcttttctagagatgatattcccattttaaatgtttttttaaaaaagaacttggatggtcaagttcaagagtgagtaaattaaatggcaccctttgcacatgtatatgtgatgtgtccaacagaaagcacgaatttgacgtgtccaacagagagggaccaattttggtatattatcaactacctaaaatataaacagcactttaaagctttgggaacaaaaatgtatatgtaaaatattttaatctatgtttatcactctaaaattgggatactgtcagttttaagaaaaaggagaagaaacatgcatatatgaccacctttaatgtttgaaggtgtccaaagaggcaatgatgagaaaaaaagatcatgtattgtggaattacaaggatccactatatcacttactattatattatttctctgagcctcagtttcattggaaaaagacaaataaccaagcctatctcaccagttttgtttgattacacacagcattatgaataagaatagtgtctgacagtaggtattcaataaatgctaagtttcaatttgctctttttcaacattcccttttttttattatactttaagttttagggtacatgtgcacaacgtgcaggtttgttacatatatatacatgtgccatgttggtgtgctgcacccattaactcgtcatttaacattagatatatctcctaatgctatccctcccctctcccccttaaaatgaagagagaactgaagaggctacaacttgacttctttattattttctaatactttcattattaacctgacaggaacatgaacagggaaaaacaataagcacaaaataggaagagatcaatagcttgtgatgagaagacatgaatcttgtcagaattcagcatagaacacatgagaagcaaactttattctttcaacttacaaaatttatcttttcttctgataatggaacatttcactcaatacagagccgactattaccatgaattagttataaacacagatgtagaaaaagaaaaataatctacgcaatgaaagaccttctaatgagtacatgaatgtttttcaactctaggtaacaaatcagaagcccagggacaggaccacggtgtgaacacttttttaaagttccacagctgattctggagcctaataaagttagactactacactggtacagacatagatgctgcaatgtatctactacattgatgtagagggagcttgtgcctggaaggtaaggaagatctcaatcacagagttaaaaaaaaaattaataagcactaaagcatggtaactgaaaaaaaagtcaaaaacctttaatataaaagtctcttccactttcccccaacaattacataaccatgaggtctcttcctgatggcagcagcagcctgtctggagcagctgtggcagggacaccagctgagtggggaaggctccgcaggaataggtgggagccccatcccctaccgagttggagtcccatgcttctgggcgcagctgcagccacccagctgcagctccagactgggcatccctgctctctcaggggcatgggagtaccccacgacccccgcaggctcagaagtgcctgctcctgatccctggcctctctctgctcccagcaccggctcgagtgcagagtaaagttgcagctgagcccaggcactgttgcaactcagctgggtatgcgtgcactgaaagcagcactgacatgccaggcccctgctgcctcagccccctctggactttgggcaccaacaagcataggagggaggctgggggatggcggtggctcagtgtgggcctgcaggcacccctcggcatgaatagcctgggtaccacgaacagaggcaggaagcagacaggctgagagcagaaaggggtggatcctcgcccacttacaagccagggatgccctgaagcccgggggcagggctgcccattccaggtggagtccgcagccagaagtgacaacttaggtcctttttctgggcccatccatggccacccatggaccaaccagcacacacttcctcccttctgtgcccataaaaactcctggactcagccagtcttagacagacattgggattaccaactgcaggaaggagccacctacttggtgtctcgggtctcaggggtctcctcaacttgttgaggtgacctgcctgcagaaaggagctaccctcctgagagctgctttgttgctcaatgaagctcctctctgccttgctcatcctccagtagtccacatacttcattcttcctggatgtgggacaagaactcaggacccaccgaatggtgggactgaaagagctgtaccacagacagggctgaaaaacgccccccactcaccacattgcaggcggtgagaagagctgcagcccttcggggagcccagacctaggggctccctgagccaggggctctgcagttcctagtgtctccaagctttcaagtgccaccacgttccacttgcccaaataccagtgcccacagcagaagccgcttgcggtatgtctggtccagccgcagccttgcacagagctggcgcctggagctgcctgccccactgcggcagccagcgcgcctggctgtgcgcagtggctggatccaacgctcgcttgttcacacaccccctgccactcctcgcccggcccgcccttagcaggtgtgggatccagactggtagcgtgggccgagctcagcctatcaggacaagtgggcataacaggccctgtgggagcaagtaatactcaggcagaaggcaccacccaccactgaggcttccggctggcaaagtgacaccccaaggatcctgtgacattcccttaaagaataatctaaagggaaaagatccaaatctattattatattaagggttttctctacttcttccccgctctcaatctcatgtgcagatataccaaataatcaacactctacccagtttatttcatatataagtacattcagtaaagctgcccaatgttatcaaaactgtgaggggttgtaaccatcacaaaggatatacttaaactcatatttcattttgttgactctctaacaagcttcagaaacatggaaaaaatttaacctgggtagaaggaaggagaaatctggaagataaaaggagatgaggccaatgagctttaacagagtaaccctgggaaaaagactttgaagcagagagtgaagactattagctgtaatacacagggtcttgtgaatccacaaaaattttaaagactgacttggtagaacctataattgaaagaaaaacaccacaataataagaggcaataaggacagtctgcagagagtagtgcccaatgctacaatactacagaaagaaaactacaattgaccaaaccagacatggaagtccccgagctaaagccacattagagaagtagaagagagggatagaggagtgtttagaagcaaaatttggcagcagtgaacttgaggaataaaggagatgatttaaagactatttttgattgcttatttgagagataataacactgtacagggtttagaagtcatggaaatttatatattcatcatatttagcttgaacaatggaaatgggactcagcttttgcaaggaaaatgtatactttctggggttgacaggtgcagagatttcaagcaaaaagggctaccttcaagggaaaaaaatctaaaactcacctgcaaaaatttgcttaccaattattacttaattatttgcacacatttattttttcctttaaaggaccctaaattccttgtggtctttgcatcccccatgattcctagtaaagcagtaggctcagatatcttgaatttaatttgatcctaagtcataatttgatcagaagccatctggcctgggttctgaagtcagataaacctaaggcaaaaccagtttcatcacttgttagctgcatggcactgaataaattaattatcctctctaaactcagcttcctcatctgtaagagccagttgttgcaaagattaaaagagataatgtgtatgaagtaattattacaatgcctatcaaactgtaagcattagaaagggtagaatttattatttttgttattgagctctttattttttcttcacacacacataatccatagcacctgatgctacacattcatcagccagccagaaacccaggtaaatcaatgaaaaagaaaacgacactaatcaatcttccaatttttctactctgacaagattctggcaactagtggtgagggaaaaaaaagaaatctcctgcaaatatatatcatctttgtcatcaaaacagactcaggtaaagtcacaattagcataagtctgtacaaatgaaaaccaatttactaatgcaatactgttttattcaggcttcttcgaaaatccaggggaaaaaaatactccctctaaaaaacacaattcagatgacttgggttttgaaactatgcagaaaacagaaaaatagttttcattatcaaaaggtagacaatgttttgtttcaacaagaatgaacaaacaataaactaacattatggcccaaagactatactattcttagaatgttggtttagaattgaataaaacttattgtataaagtaatatgttcaaaggagatcctatcaggggagaaggagaggcaatcatctttattttgggcagacataagaaaataattttgtagccttagactaatacctagatttggctttgttctagacccagaaaaactatttttggatgctatttccccagatacatgtaaaaaagatttgaattcaaatatgcaaatggtattggactatgtcattttgaagcagttaagtttttaaaatccaggctattcctgttttgaaagcagtgccatttaatattgttcttttcttgctattcccactttctatatgaattgagtgggatctcaaatccccttgctaaatggtttagcaatacttaaaattcagcaaagaacattcccaccttcaggagacacctctcctttatcattatggatgactgacatataaacaaatgtgatgcccagaactggagtcagttctgctcttgaaaatattcatacatcaaacaattctccttcttcattttcataaagacagttctgaccatattatcatagctaaaggacaaagtgtatagctctcaaaactcaattgatcttagttatctaagtcttactttaaatgaagataacagaaatcctttctctatgtaaaaaggttaagcttgggaaaaaaaagtgaaagattttctggttcatcctaaataggctttggagaaagaattgctaagtgtgaaactcctcacctactgcatttcattgatcaaagggttttgtaaaacaagcaaatgcagaattttgagaggcatttaaagggcttgtcttttggaagttaataccctttgcttaatttatcattgatttccattctcttttcttctcttataccatcaccgtgtgtaagtgaatataacaagagtctcatttgtctagaataaagcttgaattgtttatgctacagatactcatggggcctgtaaactatgggatgtgtgcgttcattctagtcctgtcagcaccatgggatcctactatgtgccacactctgcttaagtggcctgctgctggctctactcctgcctcaccacagagcaggtgctctcagacacagcagatcccaagaacggatgctttgtacatgttctgttttcatactatctctccggcagcatatgagtagaggcccaggagcctgaaggaaagcacttgtgcccatcacaagcctcgtgggaggagagagagaagtgcttatttcttcacacattttttgattggacatctgatagtcaggcaaagctgaggcctgttctccagttaaaggagaatcacccagtactgctgttcctcctctctcaactgtactggttctaagtatttctctgtatccagcatagaggagacttgatccctccaatggctccaactagaaatgaagcagctttctttgctgttgccatgggctcccttctcccctctcctaaccttcttccctacactctttctctcctccttccaaaccctgggaccagaaaaataatattgttcatatatacaatgttcattttaattacattttctattatacaaaactaactgtcctgctcagaatgcttttcaaccttgtaaaaaaaataaaacaacaattatgtgctaagcaatacattttatattttctcccttaacatccctgtaagggtaggtattagggtcaagcaaattgaggcttggatagattaagtgacttggccaaagtcaaacaatcagtagtagagacactattcagaccaggtatgttcaaatgccaaagcccagctttttacaatgcccccatgctgctgcatatggtcaagatgtgaaaagcaaagcaaaaataagattatagcaccaggaatttgttgaatacaaatttgtttcccttcaagcttaccagaaaattatttcaatatatttcaacaaaaaacaaacactataaaattagttaaagtagcttaaacatttgatttgtattactgtgagtagaacacacagaagtttatgtttaaatgaatactggcaatggagtagaatataatgcaccttaattgatttatagatactgtgccttttaatagctcagttagcaatttccaattttaaccaatcctcttcaataagagcttgctcaaaacacttaacattgttttctttgaatacctacagctagagcaaatgttgcccaccatgataacatgatcagctaagcccgcagtaaatgttttactaccacaacccacatatttgctctggccagtggtttgccctataggtcagattgttcccgtgcacttacccgcagaaactaagttttgtgcttagtactcaagacggttatgttctctaaagtcttcaattctgtagtcacctctccactaatgaaaacttagagatctttgaccctaacttctcttcctatatgtctctgtccaactttgtaaatatacatatacattacctgtgtttacatcaatgaatttattcaactattctgcatgcaaaccaaataactcactgagttttgtttgtttgtttttcaagacaggatagactctagtttagaaaaaaatattttacttgccttatcgtgagaccataatgacaaaaataaggctctctatattatcaatttctctttattttggccagattcaagtgactattcatttccaattgcatattctatttcatttttgcatatctgataccatacaatcatcagtttatttctgtttccataatgaacattatttcttttcttagcccagtaatttccccaacacatgcaatcaataactatcaattgaatctgaattattttaaatatacataactagaaagagatgacatgattatatatttagaaaaccccttcgtctcagctcgaaatctccttaagctgataagcagcttcagcagtctcaggatacaaaatcaatgtgcaaaagtcacaagcattcctatataccagtaacatacagagagccaaatcatgagtgaactcccattcacaattgctacaaagaaaataaaatacctagaaatacaacttacaagggatatgaaggacctcttcaaggagaaaaaccaatgctcaaggaaataagagaggacacaaataaatggaaagacattccatgctcatggataggaagaatcaatatcatgaaaatggccatactgcccaaagtaatttatagattcaatgctatacccattaagctatcattgactttcttcacggaactggagaaaactactgttaatttcatatggaaccaaaaaagagcccacatagccaagacaatccaaagcaaaaagaacaaagctggaggcatcacactgcctgacttcaaactatactacaaggatacaggaaccaaaacaacatagtactagtactaaaacagatatatagaccaatggaacagtacagaggcctcagaaataacaccaaacatctacgaccatcaggtctttgacaaacgtgacaaaaacaagaaatggggaaagaattccctatttaataaatggtgctgggaaaactggctagccatatgcagaaaactgaaactggaccccttcattacaccttatacaaaaattaactcaagatggattaaagacttaaatgtaagacctaaaaccataaaaactctagaagaaaacctaggcaataccattgaggacataggcatgggcaaagacttcatgactaaaacaccaaaagcaatggcaacaaaagccaaaattgacaaatgagatctaattaaagagcttctgcacagcagaagaaactatcatcagagtgaacaggcagcctacagaatgggaaaaaatttttgcaatctactcatctaacaaagggctaatatccagaatctacaaagaacttaaacaaatttacaagaaaacaagcaaccccttcaaaaagtgggcaaaggatatgaacagacacttctcaaaagaagacatttatgcagccaacaaacatatgaaaaaaagctcatcatcactggtcattagagaaatgcaaatcaaaaccacaatgagataccatctcacactagttagaatggcaatcattaaaaagtcaggaaacaacagatgctggaaaagatgtggagaaataggaatgcttttaccctgttggtggtagggtaaattagttcaaccattgtggaagacagtgtggcaattcctcaaggatctagaaccagaaatatcatttgacccagcaattccattactgggtatatacccaaacgattataaatcattctactgtaaacacacatgcacacatgtgtttaatgtggcactattcccaatagcaaagacttggaaccaacccaaatgcccatcaatgataaactggattaagaaaatgtggcacatatacaccatggaatactatgtagccataaaaaggatgagttcatgtcttttgcagggacatggataaagctggaaaccatcattctcagcaaactaacacaagaacagaaaaccaaacaccacatgttctcactcataaatgggagtagaacaatgagaacacatggacacagggtgggggaatatcacataccaggtcctgtcaggcggttggggggtcagaggagggatagcattaggagaaatacctaatttagatgacaggttgatgggtacagcaaaccaccatgacacgaatatacttatgtaacaaacctgcacattctgcacatgtaccccagaacttaaattttaaaaaaaagaaagaggaaacatttgtaccaaatattatagaaaacatagacactatcaattaattggtcagaaagtatttattaagcaattattttgttaaacactgtcccctccattaaaaatatatctagactagtgttctgcaatagcaatctgatacaagtcatgtatgtaactttatatttcctagtagtcacattttaaaaagtttttaaaaaggttaaaagttttcattattatttaaatttttagtataataaagttattttatttgacccaagatacctgaaatatcactttaatatgtaataattatgaaactattattgactggagttcctacaccctctctaccataagggttttttccctaatatatctttatttccttattttctcaaaaaaattcagtaaagttcagtatactcctcctctatgaagccttccctgaccactggcatccccactgaccccacactctgagtcacttggcacactgtggacattagtaattacacataagtaagtgtaattagcttctcattacacttatgcatataaataaataagcagaaaattgagtgattttttttttcttgccagactgtgagctacctaaaggccagtccatgtcttttcatcttcctgtctccagtccctagcacaatgtgtggccataggaagtattcaaaaaatatcattcaaattatataaaaacagaagaaatagcactctctaaaaccaaaagagagccaaaatatatctccataagaatataagaaatgatttatgggtataggaggaggtacagagatttcttttgttgctgttcttttttttgttttgaggcaaagtctggctctatctcccaggctggaatgcagtggcatgatcttggttcactgcaacttctgcctcctgggttcaagccatcctcccacctcagccccacaagtagctgggactacaggcatgtaccaccacacccagttaatttttgtatttttagtagagatggggcctcactatgttgtccaggctggtctagaactcataagttcaagtgatccgcctgcctcagcctcccaaagtgctgggattacagtcatgagccactgcgcctggccagagatttcctcaagttgtttgcaattatttcaccttaaaaggaaaggaaaacaatagtaggcatcagcttgcatgctggaaattttcatacagaataatattatgatgaccttcccatgaaagagagaaagagagaaatatatataaagtgatatatgtataatgatttctatacttagatttagggagtagacatgttttattctaatagcaaaataattaaagatactgttatactggtctttaactggcccagccagaaaactttttatttactaaactcatcttctcaatgaaacaaaacaactgggccaacagaaataatttgctactcaactcgctcctagatgttcagaaaaaaatgagtcaattaaaaacagaattgtatttggaaaggatagtgatggacctgaattgtgattctggtctgctctgatggacaaaagtcatggggcaggaacagcggtagagagggaaggtgaagcacccattgttcaaaaactggggctgctagctttgtaatacaatattgtaatgtcccctttaggcccaaccccaccttctctgatctccccaggacagaaaaagataagaactttgcatctattgttagatttattcatcctgagagatagaatgcctaggccataacataacctatattaggatcatgggtgacagatgggtttctggtagttgttggcactgccttgtttactctgtgtgtgtgtttgtgtgtgtgtgtgtacacctttctccctttatatatcatgtatcaagattattggatttgatcaaatacatggttagaccaggaaagatttgaatacacttataaacttgacttaaacaaattccaaatccatttaacagcaatggaagatgaaattcttccactttttactttgttcatgtcaattcagagacaccactggttattaagacttcctcctatgactcacatcatcaaagctacatattcacacacatttttcaaagggaaaataacccacactttatttctgtaaagttcaatggataacagtaatctgtgcaagaataaatgcctcacaagcttggattatgtgaaaacctcttaaatctacatcccttgagaaaaaaaaaagtacagcactctcagatgcattacatggaccttgcttcttcatttttgactttcattaggaaatcgtctcttccatttgcccccaaatgcaaatgcttcttcaaaaacattttaaaatgttcaatcacataaaacagaaagcagccttcatgattagaaacttacaaggtttcagatgttatttctttaatccaattcatcaaatcttaaataggtccaaaattcatatacagtcctaataagctttgaaaagaatagtcctcgcttcaaacagaacagtactattaatatacaactggttaagtttaaaccagtaagtcataatgaagcaaaagtaggttttgaggaaactgccttaagcctccatgactttacaattccatattgagcactaataataaatcccaattcatatgtgtgactacataaatattcatgcagagttaaatgtgcacctataaatgtacacgatacatatgcagatgtaaatgcattttatgatttcagcttatgaaaatgtcttatctgttggttttggagaaactatcactttgatatccattagatgtaatatatgagtttatcattgtatcaccatcatgttataatgccattgtctgagatttatctattaaacaactcagaagtatgtaaatgctcttaaaatgaaaagaaaattgtgaagctattaaatcatggtcaataaaatatttctatgccagtcattatctaatcatctgactccatcaagtcttaactgcaatgatttccaaacccacttaagtacttttgcctcttcctctgcatccttgttataagaatggtaaattgcttagattagttgactgctgctgtaaggccaagcaacagccaagtttgaaaccaaaccaatgattatgtctataaagttaccctaattaacaaggaagcaatcctaagcattaaatggttaagctttagtattacctgagttctgctatttactcaacttaggaagtcagaaccacggaattaaacatttgtattttgatacagtttcttccataaaaatcatcacaaaattttaggagaaacactcctaaaaagctttttcttattgcataagattaaggaaaccatttgattcaaaggctcaatgctgataagctttagcagataataataaactctctaaagaaattatttgattcatactaatttgcattggtcttataaatggcaggatatggatggttgtgggatggaagtagcctagactagccaacagggaaactgttaagtgtataagggaatgcatatgttaaatagcttgatttagtcaccccacaatgtatacaggcatagctcagagatgtcacaggttctatttcagaccactgcaattaagtgaatattgcaataaagtgagtcatgtgaacttttttatttcctagtgcatataaaagtaatgtttaggctatattgtattccactgagtatgcaacagcactgtatcaaaaaatgtacacacattaactttaaaatattttattgctaaaaatgcaaagaatcatctgaaccttcagaaaagcataatatttttgctggtggagggtcttgccccaatgttgatggctgctgactgatcagggtggtggttgctgataaatggagtggctgtggcaattttgtaaaataaaacaacaataaaacttacttcattgactgactcttcctttcacaagaaatttcttggtagcatgtgatgctgttacagcattttacccacagtaaaagttctttcaaaattggaatcactcctttcagaccctgccactgcttcatcaactaagtttatgtaatattctaaatcctttgttatttcaacaatgttcacagcatcttcaccaggagtagattccacctcaagaaattactttctttgctcatccataagaaataactcttcatccattcaagttttatgagattgaagcaattcagtcacatcatcaaattccacttctaattctagttctcttcttatttccaccacatctgcagttatttcctctactacagtcttgaacccctcaaagccatccctaagggttggcatcaacttcttccaaacttcctgttaatgttgctatttttacctcctcccatgaatcacaaatgttcttactggcatttagaatgatgaattttttccaggagtcttcatttactttgcccggatacatacaggtatcgctatctaggaaacctataaccttaaaaaaatgtatttcctaaataatgagacttgagaggttaagttactccttgatccatgggctgcagaatggatgttgtgttagttgtcataaaaacattaatttccttgtgtatgtccatctgagcccttggaagactaggtgtgttctcaatgagcagtactatcttgaaaggaatcttttttttttctgagcagcaggtcttaagagtgagcacaaaatattcattaaaccatgctataaagacatgtactgtaatccaagttttattctaattatagggcataagcagagtagatttaacatacttcttaagggccctagggttttcaagatggtaaatgagcattggcttccacttaaagtcatcagctgcactagcacctaacaggagggtcagcctgtcctgtgaagccagcattgacttctcctccctagctatcaaagtcctagacaacatcttccaatagaaggctgctttgtctacattgaaaacctcttgtttaacatagccaccttcatcaatgctcttcactaaatctcctagataagttgcttcagcttctacattagcaccttctgctttacctggcatttctggttatggaaacagcttctttcctgaaacctcagattctttttctgcagcttcttcacctctctcccttcctttataaaattgaggagagtcagggccttgctctggattaggttttggcttatgggaatgttgtggctggtttgatcttctatccaaaccacaaaaactttctctatatcagcagtaaggctgttttgctttcttatcattcatgtgttcactggagtagcattttcaattcccttcaagaactttccagttgcattcacaatttggctgtttggcataagaggcttagctttcagtctgtctcagctttcgacctgctttcctcaccaagcttcatcatttctagcttttaattgaaagacagaggtatgaatcttccttccacttgataacatagggaccactgtagggttattaattgacctaattccaatattgttgtgtctcagggcatagggaggtccaaagagagggacagagatgagggaatgcctggtcagtgtagcagtaagaaaatatataacatttttcaatcaagttcactgtctaaacaatcacaatagtaacatcaaagatcaccataacagatataataatagtaaaaataatttgaaatatcgggaaaattaccaaaatgtgacacagagatactaagtgaacacacgctgttggaaaaatgtcaccaatagacttgctcaatgtagggttgccacaaaatttcaatttgtaaaaaaaaaaaaaaaaaaaaaaaaaaacactatctgtaaagtacaataaagtgaggtgagcctgtacatataaacatcatgttgtacatcataaacacacaatttttagagatccaggccagtttatatatacagggactgggtggtaacaatgttaaaaacaaataaccaaagaataggagggaaataataataacaatggtaaaaacatgttgaactctatccttgcattaggctttgctaactgccttaaacatatcctattttatgttcgtcagtgtttcactcattcaaatatattcatatacatctcactgaatataaagtagataaggaaactgaagcccagaaagttactccagatttcacaatcactgaattgttgataggggcttcaattaaaggtcagtcttatgaatgcacttaactattacactacaatggtagccaccttcatcaaggaacttagctgaatcttctaggagggctatgagtccatgaggagaactaatatccatttataagagattagttaaaatggaggttgtcggcaggttttgagtttggacaggtggtttggactcccagtatagagaccaaatagcaacaggagcacaggcagcaataagatccgggtgtataaggcaaaagtccaaagatttattcaaggcagaaagacccaggaggaaatagcttttgggtataaatcaggtaacattttgaaattcaagccacacatcagaaacaggtatcacaaagaaagcatttcaagatctgcaacaaggccttcaatccctttgccgtatttataagacaccaatctgcactaataagtgtgcacaattccgtggaggtagagacagggtctgcaggtcactgtagccgaataacaggtccctaggctgagtagtgctcatgcttctaaaatttccacttccaagttccaaatgctatgctttccccttttccaattaccactatcttcatccccatacatgtctattaggaaaaaacaacaataagacatctacttagttcagtcatctgggaaatgctgtggataatacagtactgtgggtcaaataacacattcaagaaccagtcaatttggtgaaaaaagaaaaatcaaattgcttattttgcatcatgcagagcaaaaaaattactatttgaatgttgtgcttttcaaatagttgtactgatgttgagtagacacaatcatattcaccaggcatctctacactgtcactttggtatattattttttacactgccttttctcttctcggaatcaaatttagttatcctttggggatgcttaattccttaatgtcaatcaccttttttttttaactaagcaagcaggttctttattttttcaactaaattctttaatcagcttttgttcagaaactgtttatttctatctgcattacaaatgctagatttaaccaatctatcaaaccaggataatacaaggaaggatattgtcagttcatcctttcctcttaggaacaaagatgccgtattttgtgctttaaaagaaaagaaataataggattagactaagattgaggacaagaggatgtcaaaccaaagaaaagcatgtggtccttctaaagctctcccaactagtatggggaattgtaatccattcatgctaagtgctttgactatgctcattatgcaaaaaccattagagcctagtatatttagttaccatagttctgcctactgggaactataattaaagcacatttgagcaaatgcaattttatttgttattaagcaactaaaagcttagtcaaccttgcaaatatggcattatcttaagattacaatatgagccagacagctatccaataaactttattaggtcctatctttattagctatgtcttgtattcctattgcaggagcattgtatgctgtacaacagtggtcttaataggtctaatagtttaggatgcaccagaaacacctggaaaagcttgtaaaaacacattactgggccccactctcagagtttctcataccttaggtctgcagtagggccccaaaatttgcatttctaacacatccccagaggatgctgatgctgctggtctgcagaccacactttacaaaccattgctttgctgtataaaatagtggttagagctttggagtgaaacccacctgggctcatgtacttgctcttctactaatacatacatgtccttggacaggttacttcatgtctccaagcctgtatcttaatccatatagtagggataataacatctatccaataggttggttgggataattaaataagattaaaagtatagaaagtgcttagcccaggtcctggcaagagagaaaccaatgaatgtcagtgataagtttattattgttgttaattttaaaaatatgccaagatctaggtcaacatatttataaccaatggtgtgcatcagactcaactgtagggcttttgtaaaattcacacagtgagacaccatccccctcagagatgttgatgcaatcaatatttcattgattctaagatgccattgatcataagatacaccattattttatgtatcactaagaaagataaggcagaaattaacccatgattattctcagtgaaataaatgaaacatagaaaaatactgcataatctctcttatatgtggagtctaaataaaaaacgtcaactatacagagagagtagcagttaactaggatgcacaggtccagaaatataatgaacaacatgaggattatgtaggttgagtatccctaatccaaagatctaaaatccaaaatgctccaaaatctggaactttctgagcacagacatgatgctacacaggtacctgagatagtggcaacactgccttctgatcattcaacatacacaaactttgtttcatgaacaaaattatttaagatattgaataaaaattacttttaggctatatgtatacggtgtaataaaacataaattttgtgtttaggcttggatcccatcccccagatatctcactatgtatgtgtaaatattccaaaatacagaaaaaggcccaaatctgaaacacttctggcctcaagtattttggataaaagatacacaacctgtagttaataaaattgtattgtattgggcatttgcgttaaataagtagatttagttgcctgcttttgtcatcaaaaaagtaactccatgagatgatagatatgttagtttgcttcactatagtaaacaccttactgtctacatgtatcccataacatcacgttgtaagcctcacatatgcacaataaaatttatcttaaaaaagtttgatcaaactaatgtaaagcacatccagatttcaaaaatgagaaaatatggggaaaaaagtacatactggaactgatgaaataaggtagctggagatataagtgtgggcttgcttcccaggttattgtgatgtgcaattctgattaaaaaccactaacttggctggccacagtggctcacacctataattaatcccagcactttgggaggctagatgggcagatcacgaggtcaggagattgagaccatcctggctaacacggtgaaatcctgtctctactaaaaatattttaaaaaattggccagtcatggtggcaggcacctgtagtcccagcttctcaggaggctgaggcaggagaatgtcgtgaactcgggaggcggagcttgcagtgagccaaaatcgcgccactgcgctccagcctgggtgacagagcgagactcttgtctcaaaaaaaaaaaaaaaaaaaaaaaaaaaaaaaaccactaacttagtcaatgtgacagctgcaagtgggactcaaagttcagatgcctcaaagctgagagggctcataggttggaatccccattcttagaacaagaatataacccaatatcataatcaaccacctaattccatagactgtttatgaaacaaaaaatatttcctcttggtgtaagagcacccaccctctaaacttagaagaagacttctcccactgaatagcacttacccacatgaactggtcatgttcatgaccagaacacatcagtcaatcagatcaaaggagagtatagcacagttagaaggaaggtgtcaagctgttagaccaagataggtttttcttcttaaacatgaattccaatcttgagatttgaggattatttagggagacaaaacatgatttacatttcagggagaagggaggatgatgaaggtcacatatgttaccaggacgtggccctagtaggcttctattttccgtcttgagttttaaattgcagtttgtaatttgtttcaaaacaaagaaagtagattttgtataatctgtttgtcttatcaagtttatggccactcccatttgccttcactctgggaatcttggatgaaggtggggaaggcatgcgcctaccctcaactttatgctaacactcctgcccataggaaatgcattaattctgtaagccatcacagaacaggacaagatcttatgacagttttatttgggagctcagaatttctaataacttcaataattatctccggtagtctccatgcacatgagttaattataacaagaaaataaaatacttatttcagcttctaaaaattctaagaatgtaaatctctaatgaagtgttgagataatacatagctgtttttacaaactttcaactaagaaaatttcattttaactcctgcctacctcatgaccacccagtcctctctttattattacttatgttaatattaatttaattattattaattttctaaccagggctcaacccagatggacaaacaaacatgaaatcagggactgccaaggacatttcttcaaggtccaaatagttacaaattgtagtgataatgaagttgaaaaacacatggatatggatgactttctcattttctcactatactggaaacacacacataaactatcaatgaaatctatacttcaaaaaatatattttcaaaccttagatacctcttctggtcctggtccatattgaattcctttctaaaatcagaaattaaagctttatcataatactctttttaaaactacgatgttcttaaatttttatgcttccaattggagaatggaacatacaaagtattggccgggcgcagtggctcacgcctataatcccagcactttgggaggccgaagggggcggatcacaagatcaggatattaagatcatcctggctaatatggtgaaacccgtctctactaaaaatacaaaaaattagctgagcatggtggtgggcatctgtggtcccagctactcgggaggctgaggcaggacaatcgcttgaacctaggaggcggagcttgcagtgaaccgagatggcgccactgcactccagcctgggcaacagagcgagactctgtctcaaaacaacaacaacaacaaaaaaaacgaaaatacaaagtatcatgaaatttaacaaaaaatggtcttatgtttccaaaaggataacactgattttattaaaatgtctacataatttaaatgactgcacatgtggaataaaatttaatataaaactcagtcacctgaataatgacaacttagaaacagtcacactggtcatagagagtatctgtcgacttgaaggagaaggaagcagccatgtctttataggaaactagttcctgttttactatagagatgacagggggttggggttttattttcattatttttttttttttacagattttaccttgatttagttgcataatgaatgcaacacctattttccacataagaagataaagactgatttgaaatttttcaattctgtccatcactgttgtatccaactgacttattagcatacaccttgctgcaagggttttatttttactgagggattcttcgtgtgcctcctcattttcaccaaaatgtatataaatctcctgaattttcatgacactgatgtggctaaaaattttaaatattttcagttctttgaaaatacaagaaaaaccttcagaaataagaattagccatggttcagaggttctgatttgttttaacaaaaacatcaattatttcaagttctctgctgactagaaaatagtggatttcatttgatatggcaaagcaacttgttatgttttgtgctaccataaaatgcatcacaatttatagtaattacctgaatattcagtttgtttctggtaccctcctctcagtcctacgtgtctgttagagaatcaaagggtactgcttgtctaagaaatatgctaaagagaggacaacacaatatctggagaaggaaataagaatcatcaaatgccctttccttctttgatataattcctaagattacagaaattgaagataacctagcacacatcacctccaaagagaacagaagaaggtcttttaacttaatcttgtagataaaatggattacaggagctgagtgcccagactgtgaggcagatcagtaacagtttcaacagctatattcaaacggtgttaactagtgcatcagcatcaacctagttctaaatctcagaatcatagaattcttttctgggttccatttgtttcaccatgttactcaatgtcctggaagaaaatagagcggacatcataaaatttgtagaagggagagtggccatgtggatgactgaatggggttggaagctgacaggttggagacaaggactatatcttaaattaataaaaataaattttaaagtacttatagaaatgaagtatccacaaatgaaaagtaataatagaaataaattgaaaagaaatagaagtaaatgtaaaatgatgtgattaagtccaaaaggacaattgttttgtacagaatggagatgtggcatagtagcaatacaggcaactaagacttagagattttagtctacagaaaggttaatgtgaatcaacagtaaatggaatatttttgagtgaatgaataaatgtaatgtattataggaggggagaggagggaaggagaaaaagagtagggaagcggaggggaggaaaagacaggagaggagaggaaggagaggaaaaggagaagagaatctgtataaaaggaagcaaaagccccacttatctctatatagcctggacaacccatgaagtactgcaatacaagcatggagaaactgagcacattcaagcatgacctgagatgtacaaacaatcaaatcaataatatccaagaattcctcgaagtacttgagcatatttaccctggagatctgatcagcatgctcaaatatcctaataacttcactgggaaaaagaattagaggtgttgtgtttgaccccagtggttacaagtaggacagatgtattagactctctaagggtaccttggtgtcaaagtcctctaaggacagaatggctcagcttgggagctactgatcactctctctcctgaagatgctgaaaccctgattggatgacccttggtaagacttttgcaaaaccaagtcaagtgttagataggtggcaggattagatgatctttgaaagtccctccaaaccttaagattccaatatgtaaacattttcctgtggtgcacattaaatccttacaaaagactttctctcataaagacaatgaaaacaaatggttagcctaagggaggtgaaccaatcttcagaaaaccctaagagactcccctattttcttgcttgtttgctcgttagagaactaatctcctataaaacaggaatttattaatatttctttgtcctctgctatactggccgactttgggaatttgcacacagcacactttatcttgctaaatataatagtctgtctggcattcttcctttgtgagaaatccttattcacttgcataaattatgtgtaaagatctgaagcatactttcctttcttcaatacagactattcccagaagtagcctgacacatgccaaacatctgctcccacatgcagctcaatacatgatattgatatgtattatcactgggtgaattctaaatacaaagccaatttagcacactcctgaacaattccctccttctctcccggccaagctgcagggagctcaaggaaatcagaataattctaatacttgcctaagcaagctataaccaggtaaatctgctaaaacaaaaaccacagtataacatttcaaaatctaataaaaattagatacacatgataaatataaatgttcatctaatttaatacatagctaaatacatagaagtattttttagtatctgctatacttacagtattgaaagacgttgctttcctcaactgtgaattcctgggtgtcttgagtgtttgttaagcatttatatgagcctagtccgtcttttaatgatcgaatgcaattatcgttcatgtggtacaaagaaaggtgaccagaatccctaaatcttgaagtttttctagtcatctatgaaagcctctagttctctaacaggtattttcacaaagaccttcagagtaaactcatttttactgctaactagggctttggacccaaacacctctctgctctctttccctggtgaagtaacctggatctcacataagcttggcagacagctcctatcccttgggctaaggattaataaaaccagccccagcagtgaatccgttatttccttcccaagtcccacactgcttctggcccctggcaaagccactgccctggcacaggttacatctgcccagaagaggcaggtttcctaactggtgaagtcattatacacatctgcattgcccaatacagtagccacaagctgcatgtggcaattagttcctcagatgtacaagccacatttcaactgctccatagccatatgtggctagtatacagaatattttcatcatgcgctactggacagtgtgccctaggattccattttgttctcaatttgggcaaacattgttcttggacttgggcagactttatctcccacttaaggtcagagtatgcaagggtttattcatttattcattcaacaaatatttatcaatcccttgtctaactactgaacatataaccacaaataaaacagacatggcacctactctcatggagcttacattctggtcagaaaaaaattaacgataaacaagtcaacacctaatggaaatgattctttcagctatgaatttcagtattagtttgtatcatttttagcttcatggtaacaagatattttggtttcattcaagtggatccatccccacagcagctggcctgctttctcttgattttcttcagatgacagtaactaatggttttaatatttacttgaatctagagtttcttcacctttgtttctttagaacttttactcaaagcttaattcttgcctctgtccttgattctgtcttgaaaggttctccaaactttaacttttcaatcatcagttttaaatgtaactcttaactatttatattctcaaatagtacaacaaactactaggcattcgcccttggaagataccacctcctcagctccttaaccttggcgatagttcttcagaatttctcttgaactattacctttctttcattcccagtgggccatactaactaagctgtcatttctcatacatgaatctctaaaacaacctccccaaaaggtttattgtctcaattttgtttccttacaattggtcatgcacactaaatcacaactactttaaaaactacttttaaaagtgccagtcattgcctctctcaaccttctctgcactagggaagctcccttgccccagtctttcacccctgaaaatgtacacctgtgccaagtgtgttcccacctttctctgtttgagagcacctgtcaggtgctaagcccaccactctctgcagtagttctcaagcaaccagagacactaacagatgagagcttcagcagtttggcagccccacatcccccgacctcacttaaccctagtcacagcttccaaaccagcaccacttcaagggatattggcatagcagccaagttcattggggctaggacttccaaagtcaggacagctggctctggggctaaaattgcagctgtgtttgggagcctcaccattgattatgccaagaaccctgtctgaagcaacaagtcttctcctatgccattctggggctttgcactctatatatgtcagttttttgctgcttagaacatctgaaaatgggtaatttatttttaaataatttatttcttacagtttaaggagaacttgagtccaaagttaagagaccatatctggtggacactctctacagtcctaaggtagtgcatggtatcacatagcgaggaagttgagcatgctaaagtgctagctcaagtcactcttcctcttcttataatgccaccagttaatccattaactcattaatccatggatagactaatctattcctatggacagatctctcatgagccaatcacctcttaaagtccctacttctcaataccgacacactgggtattaagtttcaactttggagggaaaaaatatttaaaccatagcaccctcttagaggccatggagttctttggcctaagggtggcttttctcatcctcttcaccatgtaaagaagctgtccccaccattaatagttctttcctccatgtctcatctatcttgtatgttcttttccctatacctttctcaggcaatctgagaaaagtggttggctcaaggtttgacagagggaagacaaataaatactgcatcttattagtcggggttctctagagtgacaaaactaataggataaatacatctatatctatatctatatctatatctatctatttatctatctagggagtttattaagtagtattaactcacatgatcacaaggtcccacaataggctgtctgcaagctgaggagcaaggaagccagtctgagtcccaaagctgaagaatttgcagtccgacgttcaagggcagggagcatccagtaaaggagaaagatgtaggctgggaggctaagccagtctaaccttttcatgcttttctgcccactttatattctggccatgctggcagctgattagatggtgcctatccagattagggtgggtctgcctttcccagcccactgactcaaatgttaatctcctttggcaacaccctcacagacacacccaggatcaatactttgagtccttcaatccaatcaagttgacactcagtattaactatcacaagtccaccccttgacaacttgaacctatacacgtctcctgagatcatacataatcttcaaataaagacaataatgaggtcataattacacctaatataatacaactatcctttatacaactagaaacgcaccaatccccaacccaaatgctattccatagagttaacaatacttaaatactgacatggatatgaggtcaataaatcttatgtcacatgataaaggaaaaaggaaatgaagatattttcttagtacaagtgtgtacatgcacaaacatgtttttaacaaagaaggaagaaatatgacaattacagtcctcatttctgcaactggtcacgtggtcatagctggtattgatgactaccttcttctactacccattctgtattccctttgcctttagcaagcacctcagcaggtcatggtttttttcctggagtgacccaaaccttcattcctgaagggtctgagccatctgcagtcctgcctggattgggctgctgtagtttcccattgaccttaatcacagggcatggtaatactaagagatgccctaatgaatctcctatattccctgcatacccttccttacctctgttgtgtagtagtagactgatttcgtcttgatagtctgggtcaatcaccccagacagcactgtaacccccttcttagcctgttgacttaaaggtaggaggagcccaaagtgtccaggtggcaatcttaacttccagttcaaaggaatcattgttgtgtctcctggtgttcctccctctggaactaagacttctaggccagcagaacataatattgtgggaacaggaagcaaaattttgctagtgggtcactaggagtaatggtgagtggtgccatcaaaaggccatcctgaagcatctggattgaaaggataatagaattgcctttggaagtcagaattaaaatgccaactaagtgacaatactttgcagggctggggcaaagttctccagaaggctgtgtatgctctgagccagcttccaatatacggtactgcttttcccatagccaggatatgcagagtccaggaatcaggggtggaagtggaagtggcacctcttattatcacccctagtgacccactagcaaaatttttgctacctggacacttggggttcctcctacctttaagtcaacaggctaagaagggagttacaatgttggctggggtgactgacccagactatcaagatgaaaccagtctactactccacaacggaggtaaggaagggtatgcgtggaatacaggagatccattagggcatctcttagtattaccatgccctctgattaaggttaatgggaaactacaatagcccaatccaggcaggactacaaatgacccagacacttcaggaataaaggtttgggtcactccaccaggaaaaaaacccacggcctgctaaggtgcttgctaaaggcaaagggaatacagaatgggtaggagaagagtgtagtcatcaataccagctatgaccacgtgaccaactgcagaaacaaggactgtaattgtcatgagtatttcctcctccttttgctaaaaacatgtttgttcaggtatacagaaaatatcttcatttgtaccaagaaaatatcttcattttatttcctttttcctttatcatgtgacataagatttattgacttcatatccatatcagtatttaagtattgttaactctatggaatagcatttggcttggggattggtgtgtttccagttgcatgaaggatagttgtattatgttaggcataattatgaccttattattgtctttatttgaagattacatatgatctcaggatgtgtatgggttcaagttggcaagggtggacttgtgatggttaatattgagtgtcaacttgatgggattgaaggactcaaagtatggatcctgggtgtgtctgtgaggatgttgccaaaggagattaacatttgaatcagtgggctgggaaaggcagacccaccctcaatcaggggttcacctaattagctgccagcacagtcagaatataaagtgggcagaaaaatgtgaaaagctagactggcctagcctcccagcctatatctttctcccgtgctagatgcttcctgcccttgaacaccagactccaaattcttcagctttgggactcggactggcttccttgctcctcagcttgcagacagcctattgtgggaccttgtgatcatgtgagttaatactacttaataaactcccctttatatatagatataaatatgtcctattagttctgtcactctagagaaccctgcctaatatagattttgtcattaccctactcagtaatacattatgactccctattatctatggaatcaagtttcttttttatgaagttattgccttgaaaagataaccctaaaattgaataattctgttatttttaccattttacttaggagtaagaattataacctgtttggttctgaaaatgattttagacctttcaggcggatgcaccttttggttcatgtgatatatacctgcatatgcctcattttatgtaattaaaagtttcctgataattatactcccagtttccaataaattcttccaccacacacacacacaacacacacacacatgcatgaagtagaagaaaagcttttagagatcatttactgagcttattgacacaaatgagagttttaagaagcacaagcaaacaattttagcatattttggccaactttatatatattaatatttcccatttccttgtcacgtgcatgaagcccacatcatgtctttttccacagggtataaggccctatgctcaatagcttgaattagtcacagaatgtctttctgttggcaacttttggattaacatccacaaattaaaatcagctcaacctcaaactaaagtatctggttatcattaataacttcgccactggacagaatgataaaaaataaaaagagaaaactcattaatttattatgatctcaaactaaatgtttttctcttatgtattttaaagatctgagaagcaaaattacaatttgagtttattagtaactatctgagtccactttctgttgcttataacagaatacctgaaactggttaatttatatggaaaataatttatttcttacagttatggaggccgagaagtctccaaagtcaagggaccatgtctggtgagagccatcttgctggcagggattctctgtggggtctcaaggcagtgcagggcagggcatcacatggggaggaaactgagcatgcttactcaggtctctcttcctcttctgataaaaccaccagtcacttctgatgacaacccatttatctattaagccatgaatacattaatcagttaataaaggcaggttcctcactatccaatcacatcttaaaggccccacctctcaatagtgacatactggggattaagtttcaacataagttttggaggggacatttaaatcatagcagtaactgaagcagaactactaaaagattgttaaaatattctaatcaccttttcaaaaatatataattcctttttcatgagggttaaatgtataaaaattcaaaaattcaagtcatttttttttttagacagggtcttgttctattgtcccagctggagtccagtggtacaatcatcagtctctgcagcctccacacttcctgggctcaagtgatccttccacctcaacttcctgagtagctgggactaaaagcatgtgccaccacccctgactaatttttttaaaacattttttgtagagacagggtctttcaaccctggtctcaaacttctaagctcaaatgatcctcctgcctctgcctcccaaagtgctgggattacaggcttgagtcaccacacacaggctgtaatcccaagtcacttttattatcataacctgctttagtaatcaagagaaagaaaattctttttatccttatgtcatattttattatggttgaattaattcttatagttagagtacatcctaaatacaactaaagaagttaactgatgcttaaagttactaaagcccaaattatttttacttttcttttcttcataataatgtctgtttctgttatcataaatgtagtggtctctgagaagctatgcacttttatatttgttactcagacctcttgaaaaatgttcaaaattattaatatacacaaatgtatagaaaatatccatatacattaatatacagaaataatttcctctcagtagaggagactagatcatagtgaatcaatgtttaacccatttcccaacaccatttaacatgagcttcaggccactagaattacctccattgacttagaaaagtacagaagacataagtcatatcaaagacaacaggaaaatgtttaattgtgtttaagtgcttctatatttgtatgacaatatttatttaacaaacattgatatagcacttgctacatcaggcaatgtttcaagcttttttaataaatattaattcatctaatcctcataacaaccttatgagttaggtaatatcatccctatttttcaaatgggaaaactgcgcgtaaaagaagtatcttgcctaaatccctagaatcaataaatggcaaagtcagaatttgaacctatgagtctggctccagagtctgagctttcaagcactactccatcaggctacctctcaatattctaaatcatttccatatttggaatctgatttaatataaaggtgttatagcttttagtcgtgtaaaaaacttttctttttgagatctgaaagtgacttcagatctcaaacacctaaggagacgtgctggtagagatctgaaagtgatttcactatgtggctgctcccacacaaacacccaatgtctccttgactctcatcccactagctcatgtacctcctgctcggcatccaccaaactctgttttctcctatagcaacacctaccacaatatttgtatattaagtgttacgttctttaaggacaagaagcatatcttgttcacagtttttttttttgttttttgtttgtttgttttttgagacagagtctcgctctctcgtccaggctggagtgcagtggtgcaatctcggcttactgcaagctccgcctcccaggttcacgccattctcctgcctcagcctcccgagtacctgggagtataggtgcctgccaccacgcccggctaattttttgtattttttttagtagagatggggtttcaccatgttagccaggatggtctcgatctcctgacctcgtgattcgcccgcctcggcctcccaaagtgctgggattacaggcgtgagccacggcgcccggccttcttgtttacagttttatctccaacacatgtacctgagcagacaaagcatgattataaattactcaacagccagagagttaaactaacttcttatcaaattacaacacctaaaataaataggtttcttctctatacctatgggagtaggtactcattccaattttaaaattagcatgtgtgtggaaataatcttgtgatttaaagaaaatgacactgcagaaaactacattaatgaatggtcctctccatcttggcacagagatttaaaatttgggtgtttcaaaattaaagacactaaagctcttcgtttaaaaaaaaaaaatgacaacacagatgcactgagcttttcaaactaaaagtcaggaatatatatcaagctactatcacaaaacacttccatcaaaaccctgcaggaagcaaacaattgccagctagcacatcacccttcatgcgaaatgacgtgcgtcattttgtgcaaaggacatcaaaagaacttgtcagttaaacagaggatttagatataccatgagaaaactttcatgcaccactttacatatttccagcaaaattgctatagaagcacttaaggcacaataatttgaacctaacttgacttaagtaaccaacacaaactacttttctaaaatgtctcctattttcataagtgatagaatttagttataaaagtcctactaactcttgtaaaataatctacagagacatggtgattcatttgctttcattcagcagcatttgcttgtaaaattattaattatgtgcctattatgtgctaggtactctattgggtgttcttgtacaaatcatttttctgccagcaaagccatatttttttgagttagtaattcccagatttttgtcaaattcaacagcattatgcaatgagttcttagtatgtacagtaaggaagagcagaattttagttgatgtaagtaattctacattttattttggataacaggaacatacaaactatatacatgcaacctgaatattcttattaactgttcattttgcatttctgtccaatttgaccagtgaattcactcaaatagtcaagttggctttggcatttaggtaggaccagtaggtccataaagtgagagagtcaaatgggtaatggaagacaaactccctcctagatcacaagctcctgagaataagaactgtgacttctatagtactggggccaaatgtatttcctggcacagactatgcattaatatatgattgtttgaatgaaagaatgacctcactaaacttctcccaaacatataaaactatatcccatctgtaaaaatttccagagggaccagacatgatgatggtcatttggtcattatccttattaatattaaccttcctaagtacagagatcccatagaggctcttagggtacaataaatcaaacctaagtacattaattaaccaatacaagttataactttactaacagttattattttccgttaaatttcctaaattctcttaatcttttatcactgaatctgtttttttaaacttttttcttatcttttaaattattctgattattaagttaaaggttaacaagataataaatcataactctgcttcaaagcttgccagcttaaattctattaacaatgcctgattattcaagcttatctcctttttataactttgaaaataagctgaaatctgcacctctaatcacagtgtcctgtaccctttcaactatacgtttgccttgccttccactaaatcctaaactagagcaggggtcaggttcttgttcctctttcttgccatcctctcaccctgacacgcactactgtatccacttcaagggcatgttcaggaaagataatatagcactgcaaaaatgggctactgggggctgggcacggtggctcatgcctatgatcccagcactttgggaggccaaggcaggcagattgcttgaacccagatgtttgagaccagcctgggcaacatggcaaaaccccatctttacaaaatgtacagaaaataaataaaaataaaaataaatagccaggcatggtggtgcgtgcctgtggtcccagctactccagagactgaggtgggaggatcacctgagcccaggaggtagaggttgcagtgagccactgcactccagcctgggtgacagagcaagaccctgactcaaaaaaaaaatgggggataggaaggcagagaaaagcaccccgaagccctcgggcggaaaattggattaaaaccttaaagagaagtaaaatattctcctttactgtctccatttcagtcattgcctttaaaattcatacatatattccactagtgctaacctaagagaatcagcattatttaatatccattgcctcagacactgttgtttggccaaccatactcattcccaggccccagccaccttcttctgtggctaggaacactaaatacttatttttcctgcttctcttgcagctaagcattgccctggacacagttctggctgatgagatacaagcaaaacccaccagagggttccctgaaaagattttgctttcatgattaaaaaaaaaaaaaggagaaatatggctggcattgtcacttctcccttcatcatgtcctgaacatacaatacctaggcttgcattatgtattttgcaaccgtgaaataaaaagcatgaaaatgaaaaacaaactcaatgggaatggtggaacagaggattaaacaggattattaagcaactaaacctatgcaaacaatcccctgttttcagatagcttgatgtgggaataaaagattgttgacgttaccgttacttacagacaaatgctttccaatggagatgctacttaagacagccatggtttaaatcctggttctgccttttactgtgtgaccttgggcaacttaataaacttttccaagcctccatttctcatctgtaaatgggcataagtgaaattgctacaatagcattgttgtgaaaaatataaaataatgcatttcaagtacttggcattgaatttggcacaaagcatttctctcaaacattaaaagcacattttaatactaaacacaatagaaatgttttaaaaataaatgttgcttttttctccaaataattacatataaaaattaaacatttagggtgttagagaagtcaattctttatttttaaaatcatcattatatatagtttaacttaagacaatttacaataagaattaaaatgtataatgtaaatgtaaaatgtacatttgtgtaattaggtagtacaaatattaactaataattgctatgtggattaaattttttatattattctaattattgtgatacaaaataagccatttcctccagcacaagatagactgaaatgactggcagtaacctcacaacttcttgttgccataccacccagaaacctgagacatgtgaatctttactgttccacttactaggttattttcaggacattcaatcatttctctttaatcattgaaggaaacagcaaatctctgtttgttgtttcgctttgttttagtcagaagcatttttgcttcacttcaacaagatcatcactccaattgtttctctttagcagcttatcttacaaggccagtaaaagactgtgttccgaagcctagagactttccatttatagctttccattaagcctcttaaaagtaggtatttacacaaattaattacttaaaaggtagggccttttatgaaatagcttttttattaattcaaagagattataatttttaatctaaacctttttaaaaaggatttgagtcgacttacaacaaaagacataaatagattaagattgttaaaataaaccaaaacatatgcaaatactgggaaaaaaggatgcaaataaaaaaatcatgatggccacaattatgcaaaacatttaactgtgaacttctactaaagcaaaaatggaaacagagttgatttttaaaatctcattatgttagagggaaagtgtatggtctatatttttatatgctgatactcagtgtagccttagtactaaaatttcagtaggaatttctctcatggcccttccccaagaaaaattaagttccataatacacagtgttttcatcagtgaggttcagtggctgctttgaactttaataaaagtcaatagcatgacattataccagtaattttaaaatgattttaagctatggaatctgaaaaaaatatgcagcagctaaatatataaaattatagataaataagaacttctctaattgaaacagagttaaagtgcctaaagctactataaccagtgattacagaatctgagtaaggaaaaaaactgtagccaataaactgatcacagtgccttgcttagttacaaatatacaaatgcaaatacaatgtcctaagctcttatgctctcctgacaaggttggggatgaggcaagaatgtctactctcattgctcttattgaacattatactgcaagtcccagttcaataaagcaaaaagaaaaaatgacacataaggaagacaggaagaaataaaactgtctttattcagaaagagtgtattgtgcatgtagaaaatcttaaaaatctacaaaaagccactaaatctaataagttaattgagcaagattgcaggatacaagttcaatagaaaacaaccatttgtatttctatatattaacaataggcaattggaaataaaacaaaatatattcacaacagcatcaaaaatcatgtaaaactaaggattaaatctaacaacaggtgggcacaggcagttcattaaaaattacaaattattaccaagaaaaattaaagaaaaattaaataaggatatttctatggagtgaattttgtccccttctctacttcagtttatatgttgaaaccctcaatgtgacagtattataaatgggtactttgataggtaattaggtttacatgaggccatgaggatgggccctcataattaattagtgtctttataagaagaaacaccagagagcgtgccatctctctctccgtgtgtgtgtgtgtgtgtgtgtatgtgtgtgtgtgtgtgtgtgtgtgtacacaaagaggtcatgtgagcacacagtgagatggtggccacctgcaagctaagagaagggacttcaaaataaaacttaccttcccagcacctttatcttggacttcccaacatccgtaactatgagaaaataaatttctattatttcagctacccagtctatgatattttgttatggcatcccaagctgactaagacagagatatacagtgctcatggatcagacgacttgaggttaaaatttaagatacgaattcactgcagatttttctataaactcagtataatcagaaataaaatcccactaggcctatatgacccaagaattccatttgtaggcatatacataataaaaaacagggactcatacagatatttttatcattgctggataattcacaataggcaaaagttaaaaacaacccaagagtcaatcaacaggtaaatggataaacaaaatgtggtatatacatacaatagaatgtcattcagccatgaaaaggaatggagttctgacatatgctacgacatagatgaatcttgaaaatattatgctgagggtggagcaagatggccaaataaaagtctccacaaattgtctcacctaaaaggaacaccacattttaacaactgactacacacaataaaagcaccttcataaaaaacaaaaatcaggtaagcaatcacagtacctggtttatattgctgacagaggaactaaatgggtaggaaagacaggcttaaatcactgagaccacccctctcacattccccagaaataattacatggcatagaaagagaatctgtacacttgggggagggagagcacagtgactgggggactttgcattgaactgagttttgccctgtcacagtggaaagcaaaagcgtgatgaactcagccagtgcccacacatgaagggagcatttggaccagacctaaccagagaggaagtgcccatctcaatggtctgaacctgagtttctctgcaagtcttgctactgcaggctaaactgctctgggatcctaggtgaacttgaaaggcagtcgaggacacaaggactgcaattcttagggaagtcctgatgctgtgctggacttagagccagtggattggggtggcacatggcctagaaagacaccagatgggccagctaggggagtgcttgtgcaactcctcccacaaccacaggcaggaaagcttgcagcaataaaaggactccttccttctacttgaggagaggagacagaagagcaaagagactttgtcttgcaccttggatgccagctaaaccaacatagggtagatcagtgggcagagtagtgaggcctgcatcctaggccctacctcccagatgacatttctagacacactctcggccagaagagaaacatcttccttgaagggaatgaacaagtactggcagaattcatcaccttctgactaaagagcccccgaaccctgaatcaccaacagcaatactcaggtggtataccactggccttgggtaagactctgagacatgctggcttcagctaccagctcagccatagtagcgcagagcaccaagtgggctcttagggatccctgaatccaggaataggctattggatggcacttatagacctgccctaggccaaaggggagcccacttccctgaagagtgagccccaggcctggcagcattgaccacaatctgactgaagagcccctgggccttaagtgaatcttagtggtggcctggaaaaactccctatgggctagtggtggtggtggcaacagggaaaggcttctctgcctgtggaaaggggaaagaagaatggaaagagctttgtcttatggtctgagtaccagcttagccacaatgcaacagaacaccaggtagatttctaagttttttttttaattctaatccctggctcccagacagcatctctagacctgcatgggttctggggaaactgactgccctgaaggaaatgacaaaatctgtggcttccccacctactgattgtagatccctagaatcttgagagaatataggtcgtagtcaggtagcaaatatagtggaccttgtgtgagactcagtactgtgctggcttcaggtctgacctgggatagtcccagtggtggtggccacaggggtgcttgaatcatgccatccccagctccaggtggttcagcacagcaagaaagacttcatttgtttaaaagaaagtagcagaagataacgagaatttcttcctggtaatccagggaattcttccagaccttatctaagaccacctaggtggtatctttatgagtctgtattactcggcttggaacccaagtctcttttgaatatctagaaagccttcccaagaagaatgagcatagagcatagacaagctcagactgagaagactacaataaatacccaactctttaatgcccagacacagacaaacatccagaagtatcaagaccatctaggaaaacatgacctcaccatacaaactaaataagggaccagggaccaatcctggagaaacagagatatgtggcctttcaggcagagaattcaaaatagctctttcgaggaaactcaaagaaattcaacataacacaaagaagaattcagaattctatcagatacatttaacaaagagattgaaataattaaaaagaatcaagcagaaattctatagttgaaaatgcaactgatgtattgaagaatgtcttagagtctcttaataacataactgctcaacaaaaagaaagaattaatgagcttgaagacaggctccttggtaatatactgtcaaaggagacaaaataaaaaggaataaaaaataataaagtaagcctacagaatctagaaaatagcttcaaaagggcaaatctaagagttcttggccttaaagaggaagtagagaaagagatgagggtagcaagtttattcaatgggataatataaaagaacttccaaacttagagaaatatataaatattcaagtacaagaaggttatagaacaccaagcagattttacccaaagaagactacctaaaggcatttaataatcaaattcaaagataaagaatcctaaaagcagcaagagaaaaaaaacacacacacaatagaactttaatgcatctgtaagcagacttttcagtagaaaccttactggccagaagagagtggcatgacatacttaaagtacagaaggataaaaacgttttaccctggaatagtatattctgtgaaaatatccttcaagcatgaaggagaaataaagactttcctagacaaacaaaagctgaaggatttcatcaataccagacctgccctaaaagaaaggttaatgggagttcttcaatctgaaagagaaggacaataagcaataagaaatcatctgaaggtacaaaaatcagatagtagaaagcagaccgaaaaacacagaatactataacactgtaattgtggtgtgtaaactatgtttatcttaagtcaaaagactaaatgatgaaccagtcaaaaataacaacaactttttaagacacaaacagtacaacaagacaaagaaaaacaacagaaagtccttacttgtcaataacaacataaaatgtaaatgaactaaactctgtaatcaaaaagcatagaatggctgaatgaatttttaaaaaaagacccaatgatctgctgcttataaaaaacatacttcaactataaagatacacatagactaaaaacaaataaatggaatatttcatggcaatgtaaaccaaaaaagaacaggagtagctacagttatatctcataaaataaatttaaagacaaaaactataagaagagacaacattgttatacaatggcaaatgggtcaattcagcaagaggatataacaattgtaaatagatatgtacccaacacttgaacacccagatatataaagtaaatattattagagctaaggagagagacagacctcagtacaatagtagctggagatttcaacatcccactttcaacattgttgattttctgcctgggaaatctgtccaaagaaacatcagacttaatccagactatagaacaaacgcatctaatagatatttacagaatgtttcatccaatggctacagaataaaaattcttcaactcagcatcattctcacagacagaccatatgtcaggctacaaaacaagtcttaaaacattcaaaaacaattgaaattgaaataatataaaacatattctctgaccacaatgaaattaaactacccatcagtaacaacaggaattttgtacactaaaaaaaaaaacatgaaaattgaatcatatgctcctgaatgaccagtgggtcaatgaagaaataaagaaggaaactgaaaaatttcttgaaataaatgataatggaaacacaacataccacaactcataagatacagcaaaagcagtactaagaggaaaatatatagctttaagtgcctatatcaaaaaaagaaaaacttaaacagcctgatgatgcatcttaaaaaattagaaaagctagaacaaaccaaaccccaaattattagaagaaaaaaataaacatcagagcagaaataaatgaaattgaaatgaagaaaacataaaagataaacaaaaccagaagtttgttttttttaaagataagcaaaattggcaaacctttagccagactaagaaaaaaaaaaaaagagacgatccaaacaaataaaatcagagagaaaaaagaagacattacaactgatacaacaggaatttaaaggatcattagtgactactatgagcaattatatgctaataaattggaatatgtggaggaaacggataaattcctaggctcaaacaacctacccagattgaaccatgaagaaacccaaaaatggaacagaccaataacaaagtaacaagattgaagctgtaatgaaaagcctgccagtaaagaaaagcctgggaaccaatggcttcagtgctgaattccaccagacatgtaaagaactaataccaatcttactcaaactatttcaaaaatggaggaataaatacttccgaattcattctataaatccagtattatcctgataccaaaatcagacaaagacacatcaaaaaagaaaactataggccaatatccccgacgaatgttgatagaaaaatcctcacaaaatactagcaagctgaattcaacaatacattaaaaagatcattcatcatgaccaagtggggtttatcccagtttcaacatatgctaatcaatcaatgtgatatatcatatcaacagaatgaaggataaaaactatatgatcatttcgattgatgctgaaaaaccttttgctaaaattcaacatcttcttatgattaaaaccctcaagaactgtatatagaaagaacatacctcaacagagtaaaatccatgtataacagacccacagttagtgttatacagaatgggaaaaaactgaaagcctttcctctaagctctagaacacaacaaagaactccaatgtcaccactggtattcaacatagtactgaagtccttcctagctagagctgttttctgtttgaaaagagaaagaaatacatggtgtccaaattggaaaggaaaaaatcaaattgtccttacttgcagatggtattatattatatttggtaaagcctaaacacttcaccataaaactgttagaactgataaacaaattcagtaaagatgcagaataaaaaatcaatataaatagtagcatttgtgtatgccaacatgaaacaatctgaaaaagaaaaaaagttcttccatttaatatagctacaaataaaacgaaatacaaaggaattaacttaaagaactgaaaaaaactctacaatgaaaattataaaacactgataaaagacattgaagatacaaaaaaaatgaagacattccatgttcaaggattgaaggaatcaatattgctaaaatgtccatactacccaaagcaatctacagattcaatgtaatccttgtcaaaataccaatgacattatttacaaaagtagaaaaagtaatcctatgatttatatggaactacaaaagaccccaactagccaaagatatcctgagcaaaaagaacaaaactggagaaaccacattacctgactttaaattatactacagggcaataacaaataaaacagcagggtgctggcataaaaacagatacctagaccaatggaacagaatagataacccagaaacaaatccttattttcaacaaagctgccaagaacatatattggagaaaaatcatctctttaataaatgatgctgggaaaagtggatatccatatgcaaaagaatgaaactagacccctatctcttgctatatgcaaaaatcaaatcaaaagggattaaaaacttaaatctaagacctcaaaccatgaaattactataagaaaacattggggaaaatcttcaggacattggactaggcaaagattttttgaataatactgcacaagcacaggcaaccaaagcaaaaatgggcaaatgggatcacatcagttaaaaagcttctgcatactaaaggaaacaatcaacaaagtgaaaagataacccacagaataggagaagatatttataaactacccatatgatgagaaactaataaccaaaatatagcagtagctataaaaactctataggaaaaaatacaataatctgatgttaaaaaggggaaaatatctgaacagacatttctcaaaagaagacaaatggcagacgggcatacgaaaaggtgctcaatgtcactgatcatcagagaaatgtaaatcaaaactgcaatgatatatcatctcacaccagttaaagtggcttatatccaaaagacaagcagtaacaaatgctggagagaatgtcaagaaaagggagccctggtacactgtcggtgagaatgtgaattattacaactgctatggagaacagtgtgaaaattcctcaaaaactgaaaatagagtgactatgcgatctagaaatcccacccctgggtatatacccaaaagaaaagaaatcagtatatcaaagggatagcttcactcccatgtttgttgcagcactgttcacaatagccaatagccaatatctggaagcaacctaagtgtccatcaacagatgaatgaataaagaaaatgtggtacatatacacaatggagtactggagccataagaaagaataagatcctgtcatttgcagcaacatggatgagactggaggtaattatgttaagtgaaataagccaggcacagaaatataaactttgcatgttctcacttatttgtgggaactaaaaattaaaacaattgaactcatggagagagcagaaggatggttaccagaaactgggaatggtagtggggatgtggtggggcagggagtgggaattgttaatgggtgaaaaaaataattagaaacaatgaataagacctagtatttgatagcacaaaagggtgactatagtcaataataacttaattgtacattgttaaataactaaaataatataattggattgtttctaacacaaaggataaatcttaaggggatggatatcccatttactatgacgatatacattgcatgcctgtatcaaagtatttcacatgccccataaatatatacacttactatgtacctacaaaaattaaaaataaaaaacattttaagaaccattacactaggtggcatacgccagatgcaaaaagaaaatattgtatgattccacttatatggtgtataaatacctagaattggaaaatttccctagaataggctcattcacagaaataaagtagattacagattaccaggggctggagggaatgaggagttattgcttaatatgtacagagtttctgtatggggtgatggaaaattctggaaatattggtgacacgacgatgcaaatgtaattaatgccactgaattgaatacttaaagatggttaaaatagcaaattttatattttttttactatactaaaacacccttatttacaaaacaaaaccctaggagacttttttatgaaatctacaaattgattgtgaaatacatattaaaatgtaaaggatccacaatagccaaaatcatttgaaaagaactaagttgcatgatttgatctgaagactcacagaaacactacaataatcaagacagcatagtattggtgttaaccgtagatgtattgatcaatagatgacagaatgtcagaaatagacacatatatgatcaattagcttctgacaaagtgccaagataatttaataggaagaaaaatgttttcaacatattgtatggaacatcaagatatgcatatgaatacataaactctgacctttcctcagatcatatacaaaattaacttatcaattacagacctaaatgtaaaaaatctcctaaaaggagaaaactttgcaaaaaaacccaaaagtgataaattatatcaattcgttaatatagaaatatagactataattacatgtgtttgtatacatacatgtgtccagaacttaataacctgaatcttagcaacaagaggacaaaaactcatttaaaaaactgtcaaaagatttgaacagacacttcataaaaatacaaaggccactaagtacatcaaaaaatgcacatttaaaccacatttagttaccattacaaagtcattagaatggctaaaaattaaaaggctagaacgagtggaattctcatacaatgctagttgcaaagtaaaatattgccactactttgtaaatctgtttggcagattcttataacgttgaacacatgtctgccatatgacccaacaattccaagagtaataatcatatgccaaccctgccacaataaccatatcagatttattcatagtagccacaaaactggaaaaaaacccaactatccatcagtatgtcaatggatagcccagttgtgatacatcctttcaatggaatactactaggcaatgataagagaatagagtattgttattatcattacatgcaattacatgaatgaatttcaaaaacatttttctgagcaaaaaaagataggcacactgtatcattccatttatatgaaactctaaaataagcaaaactaatctgtaatgacagagcacacatcattgattgcctggggttgtggctggtaggagagaggtgtgactacaaagtggcagaaagaacatttttggataataaaaagggtctatatctttatagtggtggtggttacataagtgtatacatttgtcaaaactcatcaaactagaatggatgcatgttgttaaatgtaaatcatgcctcagtaaagaagattttaagagtagaaataaggatctatacccattactgaatctacattatatacttgctgaggctgtgacagagtgcatcatcaacgcaatatggctaagcttacccacaagtaagctggaatgtgggtataaatcaagtttaaggataagcagaataccaggtaactggcaacaccagaaaaaatttcttcctcctacccagctgggaaatatccacagtcttttctactgcaatgtacatatcccagattaaacaagtttgagagtcaggagaacactatatgacatcttcctcctaaaagatgacaactgctcttggcagtgggtacttgagacagaatttaggaaacctctgccatggctagctctcgaagtataataattagtaaaccactttatctgggagtgataataagattttgtgcatttttgttactgccattgcctccttgaccaggacagtccactaatactcagtcttccacctccaaggtagtcctttaagaatttgttcagaaaccctaggtttcagccaggaatgattttaaaacattgaaagcataaccaagtgatggtgtatatattcctctttgcacagatataaatttattgtgcagtttttctatgttgtttaataaagttcactttctctagtgatcttacaggcaacttctaatactactactaccattaatactaatactatggttctcaaacactgcatgttcttaagtcaaattcccagaggtctggggaattggggtctaagatctggtctaacctctctctggtgatcctagtacagatagccttcaaacaatttgagaaacactgcactgttccattgctctgccagggacacttaactttttagtcctccagttaggtgggagtgagttgactgacaggctagataacaaccaaatacataatcaaaatcaaatgtatcataatgtactttcaacaagttgtccctcatgaagacatagcatgattatttttgcatgggacactttacaactgatggttgatgtttacttcgttaaatgaattttaaatacaagtggcattgattctataaacagcaacatcttaggaaaacatcctgtaaagaatctccacacttagctcctagagaatggtgacaaggactgcttaaaagaacatgaaatagtttggtgctatagattaaatttcttctgagaaaaagtgtgaattttacaggtggcatccagatggagaattagtcccttcccacccacatgaagaaagtctataaaacctcttccacaacaggagaagaaagggaggacattttgtgccaagaaatttttgcaatttgtgtactagaagagtactgcaactctctggagcactccatattatgtgtagctgtgtcgtgtcaaatagaacagatactaaactacagaaattgagttaatgaagaggtaacacgtcaaagtctaaacttgaacaatggtagacagactaattgttttctacaattatatctgcttttagttttgaaaatgaccaatccagcatgagccagcatgggtcagcataggatacagaagattactaaatagatgggaactaagaccataacagagagataatccaactacaaccagctagagatattcttagaatcttgtggttaagggttttaccaacaccttgacaattaactccaaaacaatatgtaggtgtatctgtacactatttatgaatttttctgtatatatacttacattaattaattgtttagttcaattttaacagttcattttgctgagtggagcccttcattctcagtaaattttttaaggactttataaacacatacattattaataaaaagtactcaaactaggcgaatccaatcaatagttgcaattatgatcagataagagcacttatttaaatagtggctcttaccttttaaaaatatttttatgaaaattcaccacaaatactttaataaaatgagttatatggatatgaattcaattactatagctctagaaccaggtgatgaaataacaaaatgaaacagaaagattgcagaagtaataaaacagagtgagtggcaaaagaatatcattaataaaataataagatcaaagaaatgaatagacaaggttgaaaactaaattactcactagaggaaacatttgagaaacatcacagtaatgcagataaaagacacagaaacaaaaacaattatttaaaagtaatatatacagaagatagaaaagataggtaagacaataaatgtgacagaaaatgtattaaaagatatggtacaacaaagcttcaccgatattgaggtaaaaaataaacctgtatattgaaaggacacgagaaattcctggaaaaatttataaatgatcatctgtaagaaagtgctttagtgaaattgtttttccccaactttaaggatgaagaaaaataacttggctatcagttcttgctatccatccttttacctatacatataaacacagagagatttccagaatcgtaaccttcaaaattataatgattatgtctagtaggtgaaatttgagttattacatgtttctctggactttcctctattgcttgtatatttataatgaacatatgttacttttataaaagcaatacagtcattaacttaaaaaattaaagaaggaaagaaagggatgaagaagaaaagaaggaaagagacaattattgatttgcctagatactattttatcactttcttagttacctaatcattacgaaagaggaagaaaaggaggagaaagaagaagaagataaagaggaaaaaaaccatcattttgtgctgatcacagattacgtatgtgaagtcttgggaatttctgcttatgtctgatatattacaactttactgctaggaacttttttttttttttttttggcctagtattttgaagtatctgaaagagaactccatatttgtagaagcccaactgggctactgttaaaaggggtttatattccataaatatttacattctgctctacaagagctgagaaacaacttgatgtgcctgttgttcccatttaaacaacaacaaaaaaaataaattgtgaatctttctctacatctagtatcttttctaccaggtctctggtagaatgtcaattccctgaaaacacagattgtgcttttgctttgttccagacaatatgtgtctttttagggtagaagtactaaaaaatgaaaaataaaatgctaagctaattgatggttatgatatattgtttcaatccccctaaggccaggctgtgaactatttcaaccagacatagtctccacaaagttgtagatctgagtgactctgccaagcatgattctatttgcaataagtcttttacagttatctactattttctcaatcactcccttgcatttaaggtttagcaactagttcactgtatacctctccacgactactccatgcactagctttagtaactccaatattccttatcctctttttctcctgtgttcacctaacaaactgaaactctgttaaaacccaactttctatctgctccctacttgcacctcagcagctggaagtagtcaaagaaaaacattcatttgaattaactgattttatgtaaacttttaggaaagaattttaagaaatgccttcattttcttaaatttatgaccacaaatcttagaaagacctccccaccacccagcatccttctatgtttccataacaaattcattttcccactctctcaaaaatttgttttacgtattttcctctggcctcaaagcctccctcaatactccctccttccaccgtccttcactctcatatgatgaccttgacttctgtttaactgaaaaactaaaagtaatcagaagaacatctcctgattttcccatcaccaaatcttctaacttacttgtaactgacccattcacttcatttttcctcctaatatgagggatgaaatctccttggtccatataaaccaactcttcacagcgcactgaattccagcaccaacatttaagaactttgcaactggaattttcccctcctttgctgcttcctcttcagttttcctctctcaattggatcatttccatttgcatgtaaacatgttgtaaaaagactctcaccttgcaaagcaaacaaacaaaacaaacttccttaattctatttgccccttcagcttccgtccatttatctgcttctttggcaaagggtatctactctacccgctttttctttaatccactccaatcagacgtctgtctccactactcccatgaactgttcgaatcaaggtcattaacaacctctatcttgccatatttgtgtctcaattattcagtctctcaagagtattaacttaatggagaatagcattgttgtcaaacactagctttgcttgacttcctgtgaagagtgctttactggttttcctcttcattctctggcattttcttttttcctcagtttccattgctggatcctcctctcaatattctccagagttcagtccttgaacgtcttctcttctttatacttagttctcaccagatagtctcaagttccattgtattatatgatatatacgcatcccctatttgatctgtttccctgaggagccctgactaatacaataacctttcctctttgcctcctatggagctctggaatcaactcaatgtggaagatgtctcaccagtgtcaatcctttccttctttcttagtaacagtcttttattttacgtagccagcctcagtctgtcaactgaagtcgagtagacactgggatccttgatggaaggtggaacccatctttccctaaaattctacgttggagagaaacaattccaattcctccccctagcaaaggcaaagagctgcaaactctttacccctttctttcagggccattattttccccagataatctcagaaatatttatatataaaattaatacaaattgctggttggcatggtagatacagtacttgttttcatttatgctaatgagttgccatttttgtttaattacccctcacctttttaaaactagagaatacattcatcactcatgactgtaggagagatttttatcttaatatggggggtaaaaatataagggtttctagtctgttttatgctctacttctttaaaaattttaattcttccataagaaaacatgttaccccttagggaaaaatccttgattcttcccatcactctgctttactttatattaataacttgtttcattaatttttactattaacttttgacttctagcaatgttttatcactagtggattgtttcagaccaccatagggtaatgtggtaaggattaacaccttaataaaagataataaatttttcgcattttttgaaagttcaggccaagacaattttcatgtaatcatagttagagaaagctttttcacctggcttttataaagatgccaagtgaaactctatattaaaatatgttatcaagtatctccttaacttaaactgatacacatagctgttacttaagaactccaacagaattataggactcagaagtcagagatgccccaatctagaagtcattgtaacagagctcctgttaaaactcctaacttccagtagttattgcagattaacaatgttcagagcattgccaagcttctacattgccataaaacactgtatttatacctaaaagagtcaatttaccagatcctcttaaaattataataggcacccagatcctgaaaatcacccacactacttgtcaggattaattgtttctttggctttcatacgaaagtgtaaaaacaatgaaacaaagaaagacaagcaagcagaggaaagtcagacttaagaggtacagtctctaccagttgctccatttttatctttctggcagaggctttaaataggtatttgattatatgatacaaagagtatagggttctttctagaatttctcatgtagacccaaatatccagccagggttgaacactatcttttcaacattaacatgataggtagaattttaaccataaccctcatgttgcaccacttagcaactgactgattcaaataatgagcttccttttagaaaatcttagaaacacttggatataagaatatgaaagaagaagaaaacatgccaaatgtcaaccatctatattttaaagtaaattcatgcttataaatactattaaaattctccctcatgcctcaggacctgggcactaaattgtttgcaatgcatttgtgaaaagtatgtgctgttctctaaattatttcaaactgtttgtgttttatgttgaaatttaatctcagtgtttgttcagacaaactattaaaagtaaaacatttacctaagccttgtttttgtcttgtaatggcatttctgcttgatttaatttaaatctgttatttttaagtcaattagtagtacaaaaacaatattcaaaagttccatggccattttaaaaacagcctctgttcccaggattataaagcatcaatcattggtcatgacagtatattctatatagttgaaggctgctttctatatagtgaaagtaaaatatatatccgttgctcatcaaagatgtcaactgctttgacttttccgcttttcaaatatgtttttatctacatcagtgtaataaatcatttataaaattctcattaagaagcattacataacacatgccaccatcttatctaacatttctaaatcatacacttcatttgcattctttcttcttttagtttgccaggctatgttgagccacataacttttcctgtagtgacaggggaaaccaatgatccagttttttttttttccatccctgcacaaaatcagtttgactttgattaatgtgacaccagtgggggcttgactaaattaactactactttacttgttaagaaatcaattctttcagctgagaatcaaactgattgtgtttcaagtatgacctagagtgatctttatcaacattaagagaaccagtccaaagcaatagctaaagaataaagtattttaaaaatggcctaaaaactcattagctgtatttacattaatttggaattttgatcatttatacctatgctcttctgagtttgttccataagacgctaaagtgttaatgaaacactttactcacatgtgtattgtaactatgtgggcacttcctagaatgacattctttacaaagcattaatgatacagaaagtataaacctgactcagtaagtggtacctcatagaaaacctcaacattgctcatgtaacccactgagcaggaaataaatgcaccgcaggaaaatggaagcttcactctaacctatgttcttaattctgagtatgttttaaagaaaagtaaaaatgaacagaaaatttttactttatcacaaaaattacagagtgctaaaatgtcacaaattactgccctactgatttggaattgtgaaaaatccagattttttttttctttgttgaagtttgtatttgatccagtatagaaagaagtcattctcctttaaattcttttcaacccgtatagcatggtcagaaataaggcttagtttagtatctatatgtctttttttttctttttgccatggagttgcactctgtcacccaggctggactgcagtggtgtgatcttggctcactgcaacctctgcttcctgggttcaaggatccccctgcctcagcctcccaagtaggtgggactacaggcatgcaccaccacacccaactaatttttgtatttttagtagtgtcagggtttcaccatgttggccaggctggtctcgaactcctgacctgaagtgatccgactgcctcagcctcccaaagtgctgggattataggcatgagccaccacacctggcttatatgtcttttatgttaatacttctctaatatttgccaaactctctttaagaaaatttatctcagcctcaatctccctcaaggcaacagaactggccaatatttaataatgtcattttcatcacattatattgatttttatagttgccttctgtttgcaacagagaatactggttttctgttcacggtactaatataagttttctctttaaatgaatttagattgcaaagtgaatcaatttaaagagaatattgggaaataaccgtacaggtggtaagcaagtatgtcaaaaaatcatgaaagtagtaaaaatggctggatgtcaggaagtaactatatataaaaccaaacaagaaaaaatatatacaaaactgtaaagagaaaaccatctatttgaacaaattaatttcaatccttttcccagtatttgcataatatcatgtttaattctaaatgatgtatttattaaagtgggaccattaaaacctttacccaacaacattgtgatagtttctcactcagtacaatataaactcaaaaactgtaaaattcagctccttagtgaaaaaattctgtaattcagaaacttcattgaacaaatgcttatcaatcactcagtatacccaacacagtgagccagatttgaggagggacaaaaacatttaggtatccactcattaattcaaaagctgttttttgagtagatatgatattcaaagccacttgttgtgtaggatttaatgaaagaaagagaaagaggagcagaaggaggaagaggaaaaggagggagaagaggaagagaaggaggaggaaagtaattattaaataagggtcctgaactcaaagagattaccatctagttcattattacttattattgtccttgagttttacttattatactatatcattttctcacatattatctcttttttaaaatccatgtattactcagtctgtggtaatatttaggagacatttcttttgaccatcagattctatgaaactcaataacaaattcatggaatacaaaatagcacaaccttaaaactcacagcaatacttacgaaattggacacccttggcctttcacatattctttgtgaaaggggagatgctgccccagaaaaagtagtcaacattcagtaaaataaactcactgtggtaacttgaacatatgcatttaatgagaatccacatgcaaagcataacttgaaggtttaactacataaattaaaattgttctaagctgttatccttcacaaatatagtgcttccaatttttactaaatttatacatctcacttaggatgtgcagttgtgatcatgatatataatgtttattaaactacttgcatatatagccgcctcttcttcctctttactctgtgcctgaagcctaatgaagacttctacaaaaaaagacaaaacctattgtgttctaaggaatagttgtagttttttaaaatatgaaaatagattgtgatgttcaacacttaaagcaaatttttcatttctgattcactgaagacagatttccaacaaaagctttataccatatgtactcacatatcactatttttaaaaattaaaatcttacagaaagattacaagacttccttcatatcctaaactttgtgtgatagtactttcttaccttctcagcctagaatgccttccttctgtattttaagtggatgatgcaactggcatgaatgctacagctgccctctaatccagcctctcatttgaattactttgtaccttccacaccaaaaaacttgagctggcaaatactaatatcagccacctgtgaatcgacattaatcatttcataacttaattgtcaccaacagtattgaaggaaaaacaacatttggtgtcaaagagactgaaccagaaaactggccctaaggaaatgtgagtgtagtgatcctagctgggaagctctctgcgcttaactgtcaactcacctggattctgggctaactctgtttcctctgcagaaaatgaaaaaatatgagatccaagcacctgcaactcctcaaatccacctgaagccaatccatctgtgttccaataacccaggcctaggtttccttctgacaagatcgatttctacttggttctatagttctactatatgcatcctttgctgtcttttcttctcattctgtatacccggtgtgcccaatactgtgctagcaataagaaacaaagaagagcaagtctctcagagcagggatgcacactaattcctaggatttcagtatcttatgtgacagctttatctaattttcctttccataaaagtataaatattttaattttttgcaatgtgaaaaaaatttaaatactccataattgcaggcatttgggccttccgctctacttaaatagcatttttactgccttggatgtcataatgaaagcatttgcttatttttcttgcaatgtttttccttcagttcacatcacagcttctatgatggtcttgggttgctggcttccttaatggtgccatcatatagaatcactggagtttcctggtaattggaaataaatacttcaaaattattttaccatgaagctatttttaatattctgtaagatttgtcacttcccttttattccttttacaccttatttaaggagaaaataatatccttgcttcaggaaaaagaaaaaagagaagatttccattgtttctatcacaaatccaaaatattctcaagggtttagaaggtgtattagcatcttattgtttagtcctactgcagccttcttgcagccagaaggggaaacactattcacacacagagggtggcagagaggggacgagaaacagcttggggtcattgaggtcattgctaagacagtgaaccagctctgggcctcttatttctagactttctgttaagtaaatgataatgatccttgtggttgaaaccacttttaatcaggaatgcttttacctgatacccaaagttaccctgatatccctataaacacagcttgatcagttaactagttcaatcaaggatgggtgggaggactcacaggctggagcagagaggcggccagtttcaagtgatgcccattctgggcttcccaatccagttttctctgagctgttttctgtagttgggttttctacagtgaacataaactgtcaacctctgctcagagagtcatgacagcagaggcatggagaccagcagaatgacctcacctccaccttctcccctagtgtaaacacttgacccatggctactacctaatccacaaaggggaaaggaaggcaggtgcctgtggaccacatttcctatggaaatgctataaacaggagtgtcctggctaactggctctctggtggggatgggggatgggggatgggggatgggggcagtgggcagggatgaagagttaccctgatgtgtagcctttcccaagttttgtggtataagtaatcttaccatagatgtcaaactgctaacagatcagtaacctgctgacaatattcctgaacatttaactattgactctggaaagccagataataatttaatgagttctttttcaggagctgtttttgtttttgagagaatcctgtgaactaagagggaactctactgaaggaatgtcaagcataaaacctataatcaaatcctctcttcatggagcttatagtccagctgcaagttcagcaacatgcaatacagaagcaagaatcacttgcttataaggtaagatgattataaatgcaaattaatgtaaagcaaattgacatataagcacctaagacaaagtgcatcagcccatctcataaggtggctgaaaggtccaaatgagattgtagatgagaagactcttggtgagttatgggccacagcagaaatgtaaaggatcattcctcttggtgtgcagtgaggataatcagacaaggcaccatctggattcccagaacatggtaattgataatgacaaggtcaaagatggaaaggcagaatgcctggggatactgagaagacagagaagcaaataggggccgctggcctcaaagacagtggagcaaattgtgttcaccgatccaaattattttctagcacaccatcgctgcctttttcatcccatttattatataaccatgaccaagactttaacttatctagtactcaaaagctccacctgcgaaagtgtcttcaaggggctgcttttaggatattcaggatgaagacctaaatgatcttcagaatagccttctacaaattcaatgtctcatcatgacttagtaggttagcagcacggcctttgggactgaattctgactctgccacttgctagctgtgtgccttgtgtaagtaacttaaactctcagtgcctcagtttcctcatctgtaaatggagatggtaatatttaactcataatacggttgtgcagattaaacagacataaatataaattacctaggacaatgcctagcacatagtaagaactctatagctgatagatattattggtattgattttaagagtataacattcaaaatttggcttaaaattcttaaatggtaaagaaattataggcaattaaattagttttgccacctgcctttaaataagatggttctaaattggctaggatgctttctttctgccacttagagtgtcaacttcaacttaagtgtggccttcctgtgaaggaaagtcagttgacgagtagcaagaaccgcttcatacttcaggcacatccaacatgggaggggagaaaggaaagagaaggagagagagagagagagaaagagagagagaagaagaagaagaggaagaagaaggagaagaggaagaagaagaagaaagaagaagaagaagaagaagaagaagaagaagaagaagaagaagaagaagaagaagaagaagaagaaagaaagaaggagaagaaggagaagaaggagaaggagaaggaagaaggagaagaaggagaaggagaaggaagaaggaagaaggaagaaggagaaggagaaggagaaggagaagaagaagaagaagaagaagaagaagaagaagaagaagaagaagaagaagaagaagaagaagaagaagaagaagaagaagaaaagagagagagagagagagagagaatgaacatgaaccaaagaagaaagaggaagagtcattctgagcatccaatatatgtgtcctcctattacatcacatagaccaaaccactgtgtccagagatttgtgatatgctgataggatggagctggaatgtttctttgggaaaacggaggttcaagtaggaagagaaaaaggtaaggggatggatactaggctgttaacctacaaatggcaagtatagttttaaagccattttctgtattcatctgttgaccttaaaccataaggtacaggctattcaacaataggcatgatttgtactttcactgttcgcaattccgaccactaccctattacatctaaaacatgaatctggctgcttatccttggattttctacctccataaaatgataaagagaatgttccttatatacagaatacctgagctttaccagcaccaggactggttgttactctatgtttttgatagagctgattttcctatttcattagggagacatatatcaacatacagaaggttgatgtataaaaaagaaataagcccaaccagctgaaagaggaagaacttaatttattgctgaatagtgacaatcaattcaaatgattttagttgaactgacattaaattataacctcttggtttaagacatttgagagaatgagatccaaagaaaaagattgggcatatttttaaaaattccttgaatatctcttattcactgtttttgccatacaaacaagcttagatatttgacttaacactgccctagttctcaagcctctagtttctcttcatgacagtagctttctattatgatagatgaaaacccaaataacatttattctatcctattggaaaacacatgaaaatgtccaggggagaagcatctctaaaaataataaatgaaatacatccaccaataaagaggaatagaatcgtggtctctgatctcctttttgaggcactattcctcccacgggagttagactgtagcagaaatctaagcatggccctaattcctacattccaatcctagatacactaaaaggagcagaaccaggtgaagtaaacttaaaaggaaacaaagtctttatgcattccaaaaacaacacttttctctgtgtgtaatccccataatcaaattgatgcttgaatgacaaagcaagaaaaatgatataaaattggggaaattaagaatgatataatcgtgttactgcctctgtgccctatatatctaaatatgtatctatcaaaaaacctctccaacagaacatggtgacagagataaatttcagtttgacaaatgcaccaaacaaaaaatgaaatgtatcataaaccattgctctttctcaatccaaacagaaaaaaattcctaaagaaacctgcattctttataataactagggtaatgtatgatgtgttctctcaatttctgaaatactatgtaagtcacgaatctaaagccatgcaaaagttatacattcacaatatgcttgtagaagattcatgttaaatgtggctttgctcatagttttttaaaactggtagttttgactacaaatactaaaataaagtttattaaaattttttcacttttcaaacaatcatcttagtatagagacactgccttattcatttattcattcaatatattcagataattcactattttctataaaagaaaaatgcccatcttgattaatgagatcatctatgaagcaattgtgctaactttcctaagtttcatacctattaatttcaaaaaatttccactaatttctgcattataagatcgattgaatgggaacatctaatctgtctttacaaaaccctttattactgcaactataatctgtagattttaatactgttttctgatattttcatcaatactgcagaagttgtccatatctatcacaaaattcacgacctattttaagtagctaagttctcttaaattttactacaaagtaatcccaaattatctaaattgattattccatgagtcatgagcaccaaaacatggtatataaatgagtgtactgcttgatggagaacattgatcagctgactcctgttcacccttgatcttgccatcccacatgtaccagcacccacaaccctacacgttgtactcctaggtgatggcaataagaatacagaacagctagagctatttgccaagctgcagaaatagcccttggtgatataaataaatgatgtcacaaatgacaccaagttttcaagcttaagtagctagaagaaggtgtcatcattttcaaagaagaaggtgtcatctttttcagaggctagaaaattgagatggggagctgatgcatgtcatttggaacttcttgagtgtggggtgatggagaggcattccagttaaaaagcagtaggcagtcagatgtgtgataactgaaacctgagtaagaaaactgggatggaaatgtaaagataatactcatctgagagaggggaagattaatccagagagagagaagcagggacagaaaaatagaaatataaatgaatggatgaatattaacgaaaatacttaaataatgcttaaagtgagaacagagtaagaggatgaaaagaaatgcatttttttaaaaaagaaaaaacaggaaagaaaatccaacaaaatatattcattattaatttattcaaatatttattgagaatccactttatcctaggcaccgtgttagacactggggcaaggaggaatatacagattcaaagtaaatatggccgctggcctcaaggaatttatagcctagtgaagaacagagcaaagcactggacaaataacacacacatacacacatacagaccaataagagtaattgtaataaatacgcaaaaaagaaaaaaatcaaaaacaaaaacaaggtccaggtgctgggcatatataaagggcagctgcctcactttgcctggagtgttagagaaagttacactaagaaaatgacatacctggcaaatgagtaataaaaaataataataaggaaaagtgatcaccaaagtcagagggagcagagtcagcaaaacaccaaggaagagaagaggaaaacacacaatggagagcaataaagagccccctgaaaatcttaaagtggctttttttttttttttttaccatttcctcctccatttaccatcctagtccaaaagccaagtgtaagcaggcagttcagggctagggtttgggtcagggtggacactgctaacttgttacccaatacacattcaccagttctacctactaacagaaccccacattttttaaggtagcaatgagcctagacaaattactaattttgccggcctgccttgtagctaggggtgactatgacaactcagaccaaaaagtcatatgcaggaggctgctaaggattaccaggaagttttgctttcccaatggtaacacagcccctttctgcttgacacctgattttctttttcttaccttgaacaacaggttggaagtggatcagtcatcttgtaacatgaggcaaccataagaatgaaagccacgtactaaggaagacaaaagggaaaaacagacgacactagagctttgagggcatcctggagccactgcatcagttccagactgtctagctgtacactttgttacgtgagaaaagcagactcctatatggttaagtcagtgtagaccagtttcttttacttgaaatcaaatacaatccctagctgatacagggttgtagtgggatgggaggaggagttattattgttaaggaagtgatcaaagtagggatgacatatacagaaacaaaaatagaaaccatttcaagtccctttttacaatatagacacagttactacacaaacacatgggataatcaaactatacaatgaatgtgttaccttatttaggataaggctttagaattataaacgttatctcttggaagctttgtagctttaaactattgaaaactggtatatttaaagacacagttgtcacatcataacattgtccttaaaaacaaactttctccattgctgtatatgactcaagaccatctgagaaggtaatgggagtgttgttctgagagctcagccaggtgctatagcaaatggttagacatttaaatagcattatttatcataagtaacatgaaagaattatcttacagtctgattccaaaatgtatgtcaatttggcagtaaaccagtgcctttttaattataaagcataaatagatttctaacatttttcttttcctaattatacacactgatttgtcatgacactgccattttgcaggatatgtaaaaatcagctctggccagcttgaacaagtattacaaacaccaagaatcattacacgggcacactctataacattgtccattgccgcacaaatttcactgtaaggtgtgtccaatctgatacagctttgaagtcaaaaaccttaagatttgaatcttatctctattgaatgctaattatgttacccaaagcaagtcacccaatctgtctgagctttggtttcctgaatacctatattttgtgagtattaaatgagatcctttataaacaaacacaatgagcacaaaggcctatctacaccactgcaagctctctgcaaacattatctcctttctcttttgccctttctctacactgaactacatttgaggaattttcattaaaagaaacagaagtaaaagctagtaaaattcattcctacagaacagatcccaacctaattaagtgtaacacaaaaagtgagtttctacttaaattctgaggcaaagattataaatacacagaagcccaaatgtggcaattgtgcctattatcagaatagcatgcagaccataaaaagaatattttaaggactgtttccattttcaaaaggctagtaagttagtattatgtaatcacaaagctatgctagaaaagaactttcagcagtcactctcattttcccaaaaatacagtgtgggtcatatgcctgggcacagccctgagcagagagaggttgcacttgggggtagtgctccctgatgaattcaccctgctctcatctttctgtgatctctcacattcacagctgtccatctccctcaccttgaaccagcacagaaataaagaaaacaaacatctcccctaggagagcagccagaagccccttaccaagcatcacctccctgatgagttgtctttctgactatttcacttcttttagggcagtctggcaggcaagggacagtaagaacaaaatgtttataactctagtgataaaacagtagccacaatcatggatacttagaattcatattttcctgcaggaactaggtgtgaatggtatcatcatcttggccaagctcaaaaatgcccattcatttaatacaaatgtgttacctcactggttccctcctaagaaggtgaggggaagaaccatcatcacctagccttgtaattattcagattacatttcgttttatgtgacagtggtcaaatttgtattattcttctgttgccctaattatcatcataaatcaggaaacaagaatctcaatgtccaattaccattcagaatagatagagataggaaattaaagctccttttaagtgggagaaagggcaattccacagagcttcccttagctaagggaatggatactgtgctgaatagtacattattgaagaagagataagcgattgtgtgatgtgcaattgccaacactttctattctttcaactttagttttaaatgcttacaaggaataacatcttcacatttttcaaaaggctgctacaggagaaagccacttatgctcacttatattcacaagtattgcaaatacagcaaattattacttaaagaagaaagaggaagagacacagagaccaaaagaaacagaaagactctgaagtcttggcttccacactgtataggactttggccaggaatgttttccactgaaaccctgccctcactactatcctacacctccccagctgcttcctttaaggaactgaagccagaaaggtactgcagagggaaattttttttaaagaaatcaacttctcagaaatataataagcccaagcctaaactgttgttttctctccttggtaatttttatttttctaatgataaaagtggctactaagtgatgatactaatttccagcaatttaactatatgttacttctcaatgtactcattacagctatgtcactgtaggtggtataaaaaggtgagtcaatccagttgtttggacagttcaatcaatgactcaaagtggtagatcttgtaactctgtttaattacacctaaattaaatatccctagtagactttattcagaaaaagacaatacacatctgtgatgtcactagaaaaatctacttgccatgctcttaaaacagggacctcagctattgacataaaaacatttttagaaaaaagatttagccacacaactagtaatagttattaagtttgttagactgaatccaaccatttttaaggtggtaaatacaagattagattcagattagaaaggatactagaaaatacaatgaaaagatatgtgcaatttttatgtctctgactttagaggattttttaacaattttgtgtccttccatttcagtttcataattgagttgaatgccgatgaaacaatatgtcatccaaacctaagtcctatgttgtaggtgattaataattgatgacaatattaaaactgctcttatcagttctaacttttctggctaggaactagctggctcacagcccaaacatcatagtaagccatagttaaaactgcctttggatcttattagaataacaccacttattttcttcctttgaactgataatgtttctttttttttttttccaatacaaattttattatggcagcacaggtcactgtgtggtaactgtctgaactctaagcaatcttggaagcagtggttcttaagtatagttccaatgtggtctgtaaggatcttctagatgtttgaaggatttgtccaaaatttaattcatttaaaaatggagatgtatttaaatatataaatcagtttccattgcaaatgtcaacttataaaagacaaaatattatttttttaaatttaatgactataataattctttaccctacccaaagcaccacagaccactcatgcacccaaccctgacaggggaagagagatggagaggcatgggggtggagggaggaatggggtggggaatgaagggagaataagggatttcgcttcaggccaaaaggtatgtaagaataggttgggtccacagtttccaagatcatgacttctaggaagaagcatatgaatcaggaaagaaagacatcagagacagaaagagaatactttttactaatcaaaaaaatctcattaattgtaatgcaagagtattatacttgtaatgcaagagtattatacttttctgtacattttgtttcaccaatcacctaaattttacagctttttacaataactagaaggcagtgtagcatagtgacttcagtccaaaacccagttctcccacttaatttctctaagcttcagtttccccatctataaaatgagagcaagatctatattatgagaacatgtttttaaatacctagcaagatgctcaattgacggtagtaacataataaattagagtaggtgactttctagaaacccagctatgccccctcgccttagtcttgtgtggtctagcattggtgtgaagtaactgcacacttccacttacagggtgatttttctaataccctgaaaggatacttttatgttttcggtagtactttggttttcccaactgttttcttcataacgggttttctcggcttttatcacaggtgttttttctttatttagaagaaaatttaaacaattataaaacgttgtttattcatccattatttatagtttattattatggcaaatctatttttaaggctttgttatgaattagtgccaacaaccctcagaacaaaatttaaacaattataaaatgttctttattcatccattatttatagtttcttattatggcaaaacctatttttaagtctttgttatcaattagtgccaacaaccctcatgttattcatagaaccacacagtatgcaaaagggacagacactgaaaatactttccaactgtacataaaagaggttaattttcaaacccggacagtggtatttaaggagaaaatttgtctccaaatactcacaacagctagtcatattctaaaacctaaaaccatgattatttctcctttaagttttaaactattaattttacatttcaaagggatgttagcttagagccaaaaggttttgatcatttcatcaactaaaaactgtaaaactgaattcatggaaacaaaccccccaaaaatctccttggctgacaaaaatttccaatttcaaatccacagtcatccttcattcagtgtttgcacagctccatggaatcttgtttgctcattaaagtgaggccctccataaatagaaaaactacattggaacccactatgtaacacaaaatttctaaatattaaaagccataccatctgaagggcattttagaaaatgatcagtaatttttctaagatgtattcctgacactgcctgtaacttcaaaatatctctgcatgtagggaggactatttcacgtgttccttttgatattaaagtcttttctccaaggctaggcctgtaaataaagtaataaagtagcttttttaaaagagggaatttagtcaaatatggaactggttttacatcactgcactgctactcatttgcttgacgaaattgatagcttgtcaagtcttgtatttggctattaacagctgccacctcttctacagcattgctggtgcatattcttataaggattaaataaggtaagattaattaatatgcctggcccagggcatggcacttagtgagcactgaggacatgacagctgttaatattttaatagcaattatttcacaattgctatgaagctaagggagacagaaagatttgtccagcattcaccatcaggggtttccactgttttctggggcctattctgtattcatcattaacaatgacaacaacaattgagatgttaatacgatagtcagaaaatagagctagttactgtggaactgggtctccctgtttccacactcgtcctgtcctctccattcttcatatgtcactcaaaagcatccttctaacacacaagagacgacatctctttgctgactgaaaccctccagagacttcacactgagaataaaataaaatccaaactttcctgtggcccacaaggtctcccagaaattgatccctgacctcatcacatatcaggtcttccctccttcgagtcacactggacttatattcctggttttagcacctgctgttgcctttgcctgcagagctcactcatgttttcacatggctgggtccttcttttcatgcagacatcagctccaaaaggccacctcctcagggcaaccccaccacaccctacctagaaaagcctcatccctcccactccactgccctgcccttcatacgatctcaccaattccattttatttccttcacttcctcctatgtttttgttgttgtttttatttatgtaataattttatggaaaaatctctgcttacgaggacataaacataaggccatttcccctaacagtgctatgtcaactcccccttcctgagaggaatcagctcctttgtagaaacttggccaaatcctatagcttctcagccacttgagcctaagagcagtcccactttgacatttaagacttggccctattcattttaaaatatccatctcaaaatttattcaaatctaggctcttcctgttcccagaacaaggtagactacagggtcttttgatagagagtggagtgaaatcccctctttttacacacttcttttcataatctccttaaacttcttactcttctttcctcagacactagacccttggggaccatcaataccagccaccatacccaggagaaaagctgcatgaaggaagagactctttattttctattttgcttgactgctatgaaacaacaatattgtcccccatccttttccttgccaaagtgcagtgttttagctccgctatgtgctagtttagagactgggagctgcctctcttttagtcccacagtccatttgttcatttattcacatgaacaaacatgtactggatgctttgtatgtgccaggccctgtgctaggtgcaggaacaaacatttcttggagtttcctgtatcttcaatatttacatttattttttttcaagttgtgtaccactcactggaagtcaatatcctgtccagagacagtccacaagggagctggcgaaaagcagactctattttctctattagctgtatcattgtcattctgaaaaatagaggagctaggcttgctcccagtagaagcaactagagctactttaatttaacaattagaatcatatcatttctaggtgatttatatatatatactttaagttctagggtacatgggcacaaggtgaaggtttgttacataggtatacatgtaccatgttggtttgctgcacccatcaactcatcatttacattaggtatttctcctaatgttatccctcccccagccccctgccccctgacaggccctgatgtgtgatgttcccctccctgtgtccttgtgttctcattgttcaactcccagttatgagtgagaacatgtggtgcttggttttctgtccttgtgatattttgctgagaatggtttccagctacatccatgtccgtgcaaaggacacaaactcatccttttatatggctgcatagtattccatggtgtatatgtgccacattttctttatccagtctatcattgttggacatttgggttggttccaagtctttgctattgggaatagtgccacaataaacatacgtgtgcatgtgtctttatagtagaatgatttataatcctttgggtatatacccagtaatgagattgctgggtcaaatggtatttctagttctagatccctgaggaatcgccacactgtcttccacaatggttgaactaatttacactcccaccaacagtgtaaaagcattcccatttctccacattctctccagcatctgttgtttcctgacgttttaatgattgccattctaactggcatgagatggtatctcattgtggttttgatttgcctttctctgatgaccagtgatgatgagcattttttcatgtgttttttggctgcataaatgtcttcttttgagaagtgtctgttcatatcctttgcccactttttgatggttttttcttgtaaatttgtttaagttctttgtagattctggatattagtgccttgccagatgggtggattgcaaaacttttctcccattctgtaggttgcctgttcactctgatgatagttgcttctgctgtgcagaagctctttaattagatcccatttgtcaattttggcttttgtcatcattgcttttggtgttttagtcatgaagtctttgcccatgcctatgtcctgaatggtattgtctaggttttcttctacggtttttatggttttaggtcttacatttaagtctttaatccatcttgaattaatttttgtataaggtataaggaaggaatccagtttcagctttctacatatggctagccagttttcctagcaccacttattaaatagggaatcctttccccattgcttgttttcaacaggtttgtcaaagatcagatggttgtagatgtgtggtgttatttctgaggactttgttctgtcccattggtctatatatctgttttggtaccagtaccatgctgttttggttaccgcagccttgtagtatagtttgaagtcaggtagcgtgatgcctccagctttgttctttttgcttaggattgtcttggctatgcaggctcttttttggttccatatgaaatttaaagtagttttttccaattctttgaagaaagtcagtggtagcttgacagggatagcattgaatctataaatcaccttgggcagtatggcctttttcacaatattaattcttcctatccatgagcatggaatgttcttccatttgtttgtgttctcttttacttcatcgatcagtggtttgtaattctccttgaagaagtccttcacattccttctaagtttgattcctaggtattttattctctttgaagcaattgtgaatgggagttcactcacgatttggctgtttgtctgttattggtttataggagtgcttgtgatttttgcacattgattttgtatgctgagactttgctgaagttgcttatcagcttaaggagattttgggctgagactatgggattttctaaatatacaatcatgtcatctgcaaacagagacaaattgacttcctcttttcctaattgaatagtctttatttctttctcttgcctgattgccctggccagaacttccaatattatgttgaatatgagtggtgagagaggtcctccttgtcttgtgttggttttcaaagggaatgactccagtttttgcccattcactacaatattggctgtgggtctgtcataaatagctcttattttgagatacattacctccatacctagtttattgagaatttttagcatgaaaggctgttgaattttgtcaaaggacttttctgcatctactgagataatcatgtggtttttgtcattggttctgtttatgtgacagattatgtttattgatttttgaatgttgaaccagccttgcttgcatcccagggatgaagccaacttgatcatggcagataagctctttgatgtgctgctggattcagtttgccagtattttattaaggattttcgcattgatgttcatcagggatattggcctaaaatcctctttttttgttgtgtctctgccaggctttgttgtcaggatgatgctggcctcataaaatgagttagggaggattccctctttttctattgattggaatagtttcagaaggagtggtaccagctcttctttgtacctgtggtagaatttggctgtgaatctgtctggtcctggactttttttggttggtaggctattaatgattgcctcaatttcagaacctgttattggtctattcagagatccaacttcttcctggtttagtcttgggaaggtatatgtgtccaggaatttatcgatttcttctagattttctagtttatttgcatagaggtgtttatagtattctctgatgatagtttgtatttctgtgggattggtggtgatatccccttttatcattttttattgcatctatttgatccttctttcttttcttattagtcttgctagcagtctatcaattttgttgatcttttcaaaaacccacctcctggattcattgattttttgaagggttttttttgtgtgtctctatctcctttcagttctgctctgatcttagttatttcttgtcttctgctagcttttgaatttgtttgctcttgcttctctagttcttttaattgtgatgttagggtgtcaattttagatctttcctgctttcttttgtgggcatttagtgctataaatttccctctacacactgctttaaatgtgtcccagagattctggtacgttgtgtctttgttctcattggtttcaaagaacatctttatttctgtcttcatttcattatttacccagtagttattcaggagcagattgttcagtttccatgtatctgtgtggttttgagtgagtttcttaatcctgagttctaatttgattgaactgcggtcggacagacagtttgttatgatttctcttcttttgcatttgctgaggagtgttttacttccaattatgtggtcaattttagaataagtgcaatgtggtgctgagaatgtatattctgttgatttgaggtggagagatctgtagatgtctattaggtctgcttggcgcagagctgagttcaagtcctggatatccttgttaattttctgtctcattgatctgtctaatattgacagtggtgtgttaaagtctcccattattattgtgtgggagtctaagtctctttgtaggtctctaagaacttgctttatgaatctgggtgctcctgtattgggtgcatatatatttaggatagttagctcttcttgttgaatggatccctttaccattatttaatgcccttctttgcctcttttgatctttgttggtttaaagtctgttttatcagagaccaggattgcaacctctgcttttttttttctttccatttgcttggtagatcttcctccatccctttattttgagcctatgtttgtctttgcatttgagatgggtctcctgaatacagcacaccagtgggtcttgactctttacccaatttgccaggctgagagatggggagcctccttgttagataaagttccatttttaatagactttattttttagagttttagttttacagcacaattgatcaaaaagtacagagttcttatatgtcctctgtcccccaacctcaccatacaacaaacacacaacctaccccattatcaacactcaaaagattctttttatgtgcctggcgaataaaaggtgttcaaggttttatgctgagtcagtatagtcttgaccaagaaatctgcccaggtgaggagtggggttttctgaaggcagcaccctctctgctacccttccagggggtggcgatgattcttttgcctttcctcaagttgagtgcttcaaactcctactcctacacattggtccagctcctgcaccttggccactccccagatgcctacaagtggagctgctctaacacctgaggtcttctccctcatgggaggaaaggggatagctcagctctgaaaaagcactccccagaaggttcacccctcccagtcttcttatactgactggtgcaggtgggcttagtggtaaggttggttcttacccagtgcctctcaataaatacttcaagagagctattccaggggccagtagcaccttcaacttagaaaaaggggcacttaattttctggtcctcaactttgagccaaagccccaattctaggactaacgggggaataccgttgatatgtatcagtttactctctgtttatctcaactcattcttttattaatcttcaccatctcagtctatcctcagcacctagaacagtgtctgacacataatagtactcattaaagatctgttaaatgaattctatttggaacacttctaaaccagggaattaactacatcctaatgaaacccataacatgctgaatagtactggtagttcaaaataaaaagaatctcgtgtccatttagctaaaatgtgcatctatttaacctatttcggccaacttaacaacaggaaaactactttttttcctacatgacatcccttttaaatgttcttggatagaaaggatgtccccgactcctctttttcaccaggcttctaatgttacatggtttccagacccactgaccatcttggctgaccctctctgaagaattaatattacttttaagatgtggtctaccagtgaagagcagctggactataacttcctaagagctggacaatcctcttctgttaatgcaggttgcacttgcattaggtttggggcatttgttatataggattaatttcttcagcagaggaaccacacagttggttcacatcaagccaactgtgtggtcaacacaaaccccaggttttctttatgtagattactgtcaaatcagacctccacatcctgtattggttcaagtcacttcctgaaatataaatgctgaatcttaaatttagctccactacatttcttccttttgtttttttccccttgtttcagtatctagaggctttaaaaatgttggtatcatattatttgtcattatctgcaaatttgacaaacatatttctctatgtccctatttatactatttttttaaattatttattttcaattacctgaagagaatggagccaaccaagagccctgaaatgttctagagacctccatctggattggccctttttgaacatggctgctcctcccactgcaaatccacctaaatccatctaatggtgccctcatgcagttcacatttttattgtatctctctgttacaaactctaaagcttttaagaaatactctgttgaaataaaaatacagtacatcaacaaattaataagatcaccttattctcaaaggtatgtttatgttagtgcaatatatgtatagagttcacttattttcttcataaaaaaatcatcgagttatctgctaaagcactaaaaactatcctaacatcaatactgttgttctgaacttccaaaaatctttgtacctttgttgaaaatctcaatacctctccatcttcagattcttcttaagctccataagtgcctgcagaactccaccatttccagggccaaatcttcacattctttaatacctaagaagttctacatctgtgtctggggcagtgacagtgcctagaccttctattttctcctcatctaccttaggaattaattagttgttcatattcatatgtcttgtcctccctgtcccaatttgaagattattagctcttctagaaagaaaaaaatagaagtaaatgaagatgtgaattggtctttcttttctccatatctatcctatcacaccatcatgtccaagtggtgaacctattcttttactattcctgttattccaaatttaaatctaaaatatatttcatggttcagcacttttcaaagctacagtttgttctctttgtgaggcccagtgacaccactgtgctcatcccaggaacttaatcctcacagacatgctccaacagctctcacactttctactttagcgtttcctgtaactgtgcattgctatttccctcaggactcctgctccaggacactgtcacattcaactcactttcactggttgggtgactggcctctagcagcatttcagaggagtgagctctttttgcccatccgtccacacccccatcaggtcacactcctgggacactcaaattgtgcagtctaccaccaaagaagactattccaaccatctttctagcaatgctctgctccttatagaaaattgaagccctgtactttgtaaaggttcatttactgtctcaatttggggtacttaaaaaatcaatagcaatcttaattcccaccagagataaatagcccaaatctttaactatgcatgaacaggggaaatttaagaaaatataaaaagaccacatagccctcaaatcatccattccctttgcagaactccaactctccccagtatggatctcttccagatttgggtacaagaggggatgactaacagcttgtggtttttttctataagataagaaggataaaagttttctatttttaaattttatttttgcttttttgttgttgttatttctactaaatgctgaattgaaaagcatcttttgctgtacaatctagagagaaaggcttctatctaaaacttctcccaaaggccattctagatatccttaatcagtggatctccagaaactaccctgaggcctttcgtttccttttttttttttttctaacatggtatcttgttttaataatattttcttgagcatagtgacaagaattttttcagatgttatttttgtctcctggtctgttgctttatttttttaactcaatttacaatgtttcctccacttaaaaattataaaaatcttcttctgtgttaacttctaattcttttgatctatagacctacgtaacatatgctttaatcagattgaatagcaatattctctttctttggcttcatttctccagcctaaaaatcttcagcttttaatttttttttaagtttttcccaatgttccatattacaagccttacattattcttgagacttactccaaataatctctatggcccctatgtcagattaggacacctatatctctagtaataatattaattataattgtaagtagtagaaatatctaaacatttattgagcacctatgtaccatgaactgatcagctcattttacctgtaccacttcatttaaaccttacaaaaattttattttacagatgagaaaactgaagatttaaaaggttaagtagtttgctcaaagttatagaaatcatgtatgttagaaccagaattcaaacctggaaagctgggttctttctccaaatctcatgtacctcatcatggctttctattgattatgcagaacactatatacacttctcccacaaacctttagatagaagggactttcctaagtattaaaccacaactcctatgttttaagagatatagagaacaatcaccctcatataaattctggacacataaaaagaatagactccattaataatgaaagctaaaatcacatgtgtaaacacattgcttttaatctattcaattatttccccataagcactaactgtgcatcacaaattatggtgtctaaaagacataccacaagagttaaagctgggaagattcattgtcattctctaatggaatagttttctgaaagaatgaaaattctgaatctctaagatggaatgcctccatccactgtttctttatcctgtttatcaaattggggaaggaaatgcaagacaaactacacagtgatatcactgcataattaattggtacatctctaccagttacatataaatacattttcttttcatgtactttaatttaggagttgcaaaccaaccatgctaagcagccaaattcagcctgcagaaaagccttaattgtcttacacaaatgcatggacagtctccagtttgccattggcaatactattccctattgtgtcacagctggcctgttatgatatgtttatatagcttgtaacaaccactataggcatttgagtttatgacccttgagcagatcaaatgactacagacagtaagataaaagcccatattacagacctcattatctgtactacaggtacactgccccaaaataaacttaagaggtaaagcagctaatccactgcacaaaaaaccaacagttgctctgctatactaaccttattccccctgttccttcccttttccctcttcatatccagacctaaatggcaaagtttatctttgtgcttgttgttgactcaagttcagactaggaggctgcagagtcagattacaaaattggttatacaatctatgtcacagaggtacatccctgaccttacacaaattcagtgttttcactagtacaagctccaggggataaaagcaaaattgtactcactttatccctcaaataactctgaacattgctgtagagtagatcatggagacaaaattggttttttggaaaagaaaagaactaaatatcattctttcctccctaaaaatagcactactgtaggaaatctcataaaactctgaactttcactcaagccatttcaaaagtgattggttggggtgggcatgaaaaaaaatatctgcagagctttaaaagcaaatatttttaaaagctaggaaagtgagcatggtcataaacgaaagcagctcagtttagattggttgccagtaaatagccagaaaaagaacttcagccttcaaaaagagatttcaaatacatctttgtatcactgaaataatgccaatgttggaaatatttgaaaatatttgcagagctgtattttagacaacgaatgatactccataaaaaacaattcttttcccactgtggggcagaatgtcaaaacatgacaagatcactagcccagatcccctggaaaacaccatagaatcatttcaaaggcaagagattacaatgatatttgccttgttaaggctgtgtctatacggtgccagcaaacccttgattaggttgattcactcaagcaaccagtcgatttcgtgaaacatttactcaggcctgtgtagtttgcataaattaaccaagtgattgattgactggctggttggattggttggatacttggctggacttcaactgactgctctcccacatccgcttcagccacttggagcgcccagccacagtagtctcttcccaattccactctccacaaggctattacttgtttctcagcttatctctctaactaaatactgagctcctcaaaaggcaggggcagcttcctctctatcttccaccttcagcacagtgatgagcatcagactccacatagtgtgagaaatcagtcaatggtgtggcaacttacaagctgccctttgacataattggaatctgtgatgtttcttaatccccacagatttcatcatgcctagagggacctattaaaaaatgttagttaattcttcccgtagaggagccacacaggctcccatccccatactgcttccctctcagatggcttttttcactctgttctcctcttgagcctctccctcttctaattccacatgtcacgacttccaccaagcattccctgacaatatgacaggtatttctctcttctgacttccgctgttacttgcccccaacatttgggcttttaattaccaactactggcttgctctatatttatcagtattattgcgtttcactcgcctcaaagattatgaagccctttgagatttggaccagtatatttgttaagctaattccagttggctttcttgtgaataattaacaagtcataactatcagttgtccagtgttctacactttatttcactcaattggtataagtgcagttctaattcttatacctacaccatattaaaaaaaaactgaggtatagaggagctaaggaatctgcttatgatacaactagtaaatctcccttgtacccttcttaatggaagtggggtatctttctgttcagtcgcatatcctaacaaaaactcttcagttttcctgcaagaaaactgcaaccctttctccagcattattgttaaggaagatgactgttaacacagaatccacaattttaatgcaaactcatggctacccaatctgtatcctcaactaggtggaaggaatcctttgtatttgatggcctgcctggagcacctatatattgcccaaatactcaaaactttaatgcccattttgcaaggaagagcagcagatccccaccctgggatccccatagtattggccctaataggattgcttgtattgagttgctactttgaaagttgccatttggtttggtcaatcatagagccaaatgtggggtttgaccatgggtccatggctaggagattgtaaggacactgcttgttacgccgcacagagtgcccttcattatgattctggggagagagccctgtctggttttagtactaaggacagacttttcccagagcaattgttctgtcttttcttctggatcctacggcattttcaactaaccaggtttttctttttggttagagctaaatttatgacctatcctaagcaagtaaacaggttttatagtcatcttaatcttgctcctggttctatttaatgacccacatttacctttccttttaattttctcctgcttttaatttaaaatagacaaacagaaggataagagccagagagacagaatattgcttacccctcagcttctctcagtgcctttgctcaaccccacacttcctcccacataatcagctcaaaaaactgatttaagaaaatcattttacatgatggtgaaatggtttttaaccaatgtttgaatcatagatccctttgctaagggtatagatcttctcactaggaaaaaaatatacaaccctatcaaaaatatttcaggaactcatggatctctgaggctgaagccatgtctatggattccagagaacaaacccttgcttgggtgcatacacaaggcttctggtatccccaatttgcctcccaggacttgctccaagcccagaagacttgggggaattttccaagctactgtcaccaaggaagagcccaggtctctcacctgtctgagcctctccctcccccaacctcacttctttcctccctgaccaaagactgtgacatgctggtccctcttgctctgttcttgcccccactttatgccacaacttacctggcattctggacactcatctgcttcctttctctcaaagtattaccatcctgctgcatccatcagcccaggctgcaaaccccaaagttttgctgtctcacaatttcaaaggaggatagagggagcaaggagtgggggctactaggaccttttaaattagaggacaaagaggttaaaggagaagcctgcagaaccacaaacaatagcggagatatctcagccctgcagaacacaggatcacaaggagtcatagctagtcagatgctgaattccagacatgtgcatgcacgtgcatgcgcatccgtgtgtgtgtgtgtgtgtgtgtgtgtgtgtgtttagttacactatatatagtgtcaggaaaaaactgccaacttggatgcttttaatatgtacctcagaattaatgaagaaaaagtgaaaacatggtttgactatgtaaaagaaatgccaattacagttacatatgaaatacatgtatcatttttgactattaattcgtatggcagtatacatatctaccactaatttttattataaattgcacttgatttgcatactgaatgttgttttctgtcagttgagcctcaaaatttgctgctcacaatttccaacattaaaggagacgttgacaggaatcatagcttatactccttttgtttttcccttagcatctaaataacatagcaagatatgcctggaaattgataatctagctgtggagaccagagtttgtacacatacctgaagccactgaagaaaaatataagacaatacgtaagaaagttacagtacacatgatttatagaaaaatacgagaggagaggatgggccaaagtaagaaaacaacatgaagaaaatgagctttgaacttacccttaaagaaaatatagcatataaatttggtgaaaggacattccagtccaggcagaaaaattgttttctctgacacacaagatatttaagatctaaagaactgtttatttcatattagtgtgctcattacattataataagcttcgagtgaactcacataaagaacttaaaaagattattttttaaatttatttacctacaagtatattcttgtcagttaaaagaaagagaaaataaaaaattcagaagacagaaagctacctataaaactttaataaaaataatccattgtaaaaatggaaaaataaaatctccaccagtgaatgacatacaaaactttatattatctgctaaaatggagtggtaggtatttctttatcttcttggtttgaacctaatagaacaatggctgtatttgaccaactaacaactagaaataatgacagtggatagtgaattcatttaatcatggtaaccatagccaaacttattataacatataaagtgaaatgcctgaaagacaaagttaaagctaaagactttgggaaacctccaaaataggtaggaggtcaaagagagccctcaccccacagttgtctctgaggcttagcaaacttagtgcactgcaatctgaaatcagagggacccattatggaggctgggtatattggcccacttcctctaaaaagtaaaggttaatacaggattaaacatgaaagtagtttagtaggtgttatgggatgcactaaacattcatatgttgaagttccaacctccagtagctcagaatgtggctgtatttagtgacaaggtctttagaaaggttaaaggactaataagttaaaatgcagtcattatgacgggcccagtccaataggactggtgttcttataagaacaggaaattgggacacagacacagagagaagaccaaccgaagacacagggagaaaagaaccatctaaaagccagagagggaggcctcagaaaaaagcaaccctgccaacgccttgatctcaggcttttaacatccagaattttgggaaaacgaatttctgttccttaagccactgagtctgtggtatttgttgtggtagtcccagcagactaatttatttgggggaaactccttggggaggaaatgaggagggagcctgtggagggtgggaaaactgtgagtccacaatgctggtctggtctgctcttgagtgagaaggggaaggggaaggagaaggggaaggggaagggcaagagaggggaaggggaagggcaagagaggggaaggggaagggcaagagaggggaaggggaagagcaagagaggggaaggggaaggacaagagaggggaaggagaagggtaagagaggggaaggggaagggcaagagatgggagtgggaaggggaagtggaagggagaagaaggggaagggagaggaaggggacggggaagggagggggaaggcgagggggaagggagggggaaggcgagggggaaggtgagggggaaggtgaaggggaagggagggggaaggggaagggaggggaggggatggggaaggggtatggaggggaaaggggaaggggaagggaggggagggtgaggagggaggggagggtgaggagggaggggagggtgaggagggtggggaggagggaagaaggggagatgggtgggggaggagggaggggaggagggaagaaggggagatgggtgggggaggagggatactatagtccaggtctaaggcaagttttgcaagactatagaggagtcctgtatctccaggaatgggctgctttagtctccctgccatgctgagtcagcaaccaagaacagttcacgggcagcattggtgatgggtttcagagcagagctgttgggtttgtcagtttattacattccaatacctgagaggcacattctcatggccaccacactggaagacctccatcactgtggacagtgcccagcaaggactttacactcagatgccacaaatgcccatccaaatttccactgaatgaaccacgtttcctattcagttaccgatgtgaaactacagaatcatctcattttctctcaaggacaaatatttcatgctctacaagagtaaaaccagtgtagccaaaccccactgactgaagaattatagctacataaaagataactgtcctgcaagttacttctgtattccttgtgaaaaaaaaaaaaaagagactggctacccaaattaataatgtaaataaggacagtgatggccccactgaggcttgtccaaagcaaggcccagtttactaaccccggaatgggaagatcaaacctggtgttgggagtttggtcccaagttaccacacaaactcattctgcttctcacctttcaagcctaccttctttcctttggatggggaatcaaaatgcctctttcttaaagctacgagctgtctaatatgctacatgaggaagagaatgggaaaaacaaacagtacatgaatagaaaaatgtgctggatttaaagcaaaaagatataactaatctgacatgtaagtccaatccttgcatctccaatatgtagcatagtggttgatagcaggtgttcaattcatgtttgagaaataaataatggcaaacgcattgaattagagttttatagtgattaataataaatgaaagtagttcctttaaatgatagtaattagcatgtctgtggtcaggcaaggagggggtaaattacccagagcataaagttgcagtgaggctcttcttaagttctctgaatcaagggccagtcccaaaagcaggggaacaaaatggggcatagacagtggactgggatcagcaggtttcagggcaggtttgcatctgtaggagagaggaggctgaggtgttccattttacttcctttacaatgccggtgcagggtaacgtttaggcagggaaggctgaaatatatgacatatgggctcccacaaatcatcatcacctcaactcaaaatttatcagtgtcttccttgtacttataaaatagaagtttccattcactcattaattaattcattcatttagagccaatgatcagacgctatgctatttggggaaacacaaattaacaaaatgtattctctaccatttaagaggaagacaaatgtaccaacaggcaattatagtacaatgtatgagatatgctgacagagattatgttctatgaacaaaagttctctacaggaatatggaggaaacagactttattccagtgaacagtttggaaatcagagagacacagcctgctgtgtaaaatgaagctatgttccggagaacaatgagagtgttctgttttatagcaaaacctcctacccaggtttccagtcaggttggtttatgcaaatgaacgatggaaactagcttagtgctggttggctggcacagctgagttttgattgatcaatacagcttagccctgcttggttgatacagctgagccctgtttcatccagtcgagtcgagggagctctgattggttgagctctgattgagctctgtttggtttccaaacccaaaaccaggagtcttggctgatgtttctttctggtgagaggaggggggattgggcctccgttcatcttggcactaacaataggaactggtttagcttgattgtagaaagagaggtcctgtgatacttttacatctttctgagaacacaattaccattccttcccccagctaggaccacctggttctgttttaactttgagagcctcagcctcaaagattccattttcagtctgccaggggaatactttagagttcaaagggcctccagagcagagacaggggaaaatacctgtctgcagggtaagtaacaggattgcaacaggttggcatttgaactgggccaagtagagcaccagagagaaaggaaatgggttatatatctagacagaagagcaaagaaatggcaggtgccaaggcacagaggggtcatggttttgattaagatgaagtggggaggtgcaatcggtgataaggttttaggaagaaacggaaaaagaattttaaagataaaaccctttgcagattgacaaacctgacaaaaacaagaaatggggaaacaattccctatttaacaaatggtgctgggaaaactggctagccatatgtagaaagctgaaactggatcccttccttacaccttatacaaaaattaattcaagatggataaaagacttaaatgttacacctaaaaccataaaaaccctagaagaaaacctaggcaattccattcaggacataggcatgggcaaggacttcatgtctaaaacaccaaaagcaatggcaacaaaagccaaaattgacaaatgagatctaattaaactaaagcacttctgcacagcaaaagaaaccaccatcagagtgaacaggcaacctacagaatgggagaaactttttgcaatctactcatctgacaaagggctaatatccagaatctacaaagaactcaaacaaatttacaagaaaaaaacaaacaaccccatcaaaaaatgggtgaaggatatgaacagacacttctcaaaagaagacatttatgtagccaaaagacacatgaaaaaaggctcaatcatcactggccatcagataaatgcaaatcaaaaccacaatgagataccatctcacaccagttggaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttaacccagcaatcccattactgggtatatacccaaaggattataaatcatgctgctctaaagacacatgcacatgtatgtttattgtggcactattcacaatagcaaagacttggaacctagccaaatgtccaacaatgatagactggattaagaaaatgtggcacatatacactatggaatactatgcagccataaaaaaggatgagttcatgtcctttgtagggacatggatgaagctggaaaccatcattctcagcaaactatcacaagaacaaaaaaccaaacaccacatgttctcactcataggtgggaactgaacaatgagaacacatggattcaggaaggggaacatcacacacggggcctgttgtagggtgtggggagcggggagggatagcattaggagatatacctaatgttaaatgatgagttaatgggtgcagcacaccaacatggcacatgtatacatatgtaacaaacctgcacgttgtgcacatgtaccctaaaacttaaagtataataaaaaaaataaaataaaaaataaaaaaccctttgcggataggtggctctggagtcacctgcaggagatgctgggtagccaagggcatggtaaggcaatggacttctgaaagaacaatgaccaagaggtttctagagattagggggacaggagtcctaaagggggagctggagaataccaaagacaaacttgatttgttttacccttttcacacaagttacatatttttaaaacctcttcttaggacctaattttctcaagtcttgcttaatcccttgctcagaagggagaggtgaacagaggaaggggttcccccagcagcactgagctggctctctgatgaagtgggggcacctgtggaggggaagctcagagctcaccagatactgccaacagcagctgcacaggagggtatctgagaggaagctactgttcccagaataattaactctcttcagaaatcatgggcacagacacacaccctctctctgaagcagaaccaagctcaagggctggagatttcctgttccccaccatcaggtggacagcccactctccctactccacctgcctacagacaaggaagatcaatctgggtggctaacacaccttgccctagagtaaccaagattagaaagatgcatctacttttccacatgggacatgaaattgagtctatttaaaagttctggcacaatttagatattaaaattaattaaaataaatctgttactagcaatctacctaaattatgcatacaatgtttctcagtaggtactcttttgaactaccgtttagctaaaaaaaaaatcaatcaccaaggaatttaagtaccaaagtttggcttgaaacttcaaatccctccatgtcaagcaggaaagcagagctaatttagagggactgtccagccagggatggtgtcaggcaggctgagggcaatataatgattttgcagggaggtaattaaatgggacataacagcaattatagcagcaacggctaacatacactgaccacttccagtgggtcaggcaacaacatgctaagtgctttaagtgtattattttcttcaatctttttctttagtacacaaaaaaagtacaaaggaaaatatagcaaaacctacatatccaccacccaaaatttaaaaatgacattttgtcatatttgcttcagatttttttattttaaaaaagttgcaaatgaatttatactcccaaatcccatttccctctctgtttctcctcagaaacagccactatgtcatgaatgtggttcatattcagtgacattttcatattttaccatatttatatgtgcctataaatattatagagtattattttaggtttttatttcctgaaatcttttatcaactcaaatgcatgacttcaaagtctatcactgtggattaatttgttccattgcacttatcaactttgaacatactgtcagggaagaattttattttctgttttattaaataatgtataaatagtgtggcatattcatattctttgcccctgttttctatttcattatctggagttttttttttttcagtaatttgtaggagtctttgatctatcatatatcccaatatcttccaccaggatgtggtctagctttacctttgttttcggtcttcagtcattcaagagatgcctaactccaggcagtctaatccgttattttttccttacctgatatcataaaaatatccttttgtatctatatctacctatctatcctgtaactgtattctacatacagtcataaagtctcctttttttgcatttggtctctaatccatcttcaatttatttttttaaatggtgtagagacttaattatattttcatcaaccacaacaaaaaaatagattccattctttcttcactaattggcaatcccacctccaccatatacccagatcccacacgtgcataacttctcaagctacctcttctgttctctctatttgtctatccctgtgctaactccaaagccccatgtcatgtactgaagcttttttacaaatcaatatataggcaagtctttgttttttgcctgtttgcttgggtttcacaattgtctggctactctttcaattttatatttccatatgaattatagaatctgtcaaatctctcacacatacacaccacaaccagttgatatttaattggaatttcacaaaatgttttaattgattgtgactagacagcttttcaatacagaaacatcccacatatctaaataagcatagtattatctctctaatcatttcagacttttctctcaataacgtttatattttctattttttcctaagtaacatatagttttagttgatgttatgaaaagcattttttcaggtgggcggatcatgaggtcaggagatcgagaccatcctggctaacacggtgaaaccccgtctctactaaaaatacaaaaaaattagccaggcgtggtggtgggcgcctgtagtcccagctactcagaaggctgaggcaggagaatggcgtgaacccgggaggcggagcttgcagtgagccgaggtcgcaccactgcactccagcctgggcaacagagcgagactctgtctcaaaaaaaataaaaaataaaaaaaaaagaaaatcattttttctgttacatttttaatgagctagttctggtacagaagacagagttacttactagcaaatgtcactgtgggcaagctctttatctcgctgtgcctcagttttctcaaatttcaaatgggaataatagtgctacctaataaagttactgctggtgagagataaataagttaacacatgcctagtgcctggcacatagtaattaaatgcaaatgttagcttttattattaaaagaatattaatttgcatattgattttatatctaacggccttgaaaatttatgaattatcttgaattttcttttaaataatgatatactctgagtatgaacaaatttactttcttctttcttcttccttataaacatttctctttcttgccctattgtattacccaggactaacaatatcatgataaatggaaaaagaaatagcaacgttcctgtcttactctctttaaaagacatattctaaaattttcacctttactatttatgtttgctgtcatttttcgctaactataatactatttatcaggttaaggaaggccccttgcattcctagtttggtgtgcgatttcatcatgaataggtcttgacgaaggcatttgattttctctaatttaatccctacattgtagtctacactgaacatttagcaacaatatacattgggccaggggtcagcaaactacagcctacgcaacctgtttttgctgttaaaaattttttttaaaaagtttattggaaaacagccacacccatctgataacatattacccatggctgcttttaagccacagtgacatagttgagtagttgatacagaaaccatatggcccacaaagcctaaaatattgaccatttgaccccttacagaaaaaaactgctcaccctgatatacagcatattaaactgctcttgttacaactttcactctaaattgaggggttagtgaataagcaggaaaggaggccaaagagttttaagttttttttttctaacttctcctaatctctgttccttctaccttctttcatgtttacatttctctctttcctcttctctcttcttccccctttctttttccccttctcctttttttccccttgccattctacacttttaaaaagcaatgcagtccagatgcagtggctcatgcctataatccagcactttaggaggctgaggcaggagtatcagattgagcccaggagtctgagaccagcctgaacaacatagtgaaatctcatctctacaaaaaacagaaacacttagccaggcatggtgattcatacctatagtgccagctactggagcagctgaggtaggagaatcacatgagaaccagaggttgaggttaaggctgtagtgagcagtgatcacaccactacacatagcctgggtgacaaaatgagaccctgtttcaaaaaataaaaaataaaaaagcaatgcaaaatatcttcctttgattaaataaacaataaaactgtccaacatttttttcaatatgtagtgataaccaatatatagctaggtgctttactaagttactttaaaattcatttgctcaacaaacatctattgaatgctatttgcaaggcactgttctaggtgtctgaaatataacagtgaacaaacaatgattcctgcccttgggaagcttacattctaattgagggaaatgaacaataaaaatagagcaaatagtaagtgatgaaaaaaggaacacacagaaaatggtaagcgggaaggggaggggaaagaactacagttgtgtaaaggatattcagcaggcctctttgcaaaggtgccatctaaacaaagatttcaatgagagcatgaacccccaagcccatggcaggagcattcctggtgtgtccaggcaatggcagggagattgggatagctgggacagatgaagcagagagaataggaggtgagatcagagaggttatggagaccagattgcagaggccctggtgggctttactctgaccaaaatgagaagccactgaaagattttaaacagaggaataaggtggtctggcagatttttaaaggcttacctttggccattgtggtgagtacagtttatagaaactgcaaagccattcaagaggccatggcagtattgagaagaattcacgtcatttaatctctcagcagttggataagatatatactatgcccttcttccagatgcagaaagtaagatgtggaagtttaaataacttgccaagtcacacagctaatataaagcagagctggttttaaacctagagtccatccaaggtcaaaggttggtatctgaagttagactagtttggatttcaccttgtgaaaatgcttcataaactatttaatgtatgatattataattaagagtttcatgattttagactaatcatgtatattttatattttatgaatttttagataaatcatacttctaaaataaaaaactagttggatgctatagttccagactcctggattttgttcttgaatggcttatggataaaagcccctaagttttcacgtattagatttgcttcaaataaacctatagacttgggaatttatttactctagccctaggaactagaggctcgccattatattcttattctcccatagagtttcaaattatattctttaaaagacacttcatgactggagtgttgaatcttcttttttaagcctgctgactgataggtagattccatgttcaaatctcatcttgcacactgtaaatatcttccatcataattttagtaggtctagaaaaatcatctctctctctgttaaacatacacatacacacacacacagaggagcaacattactggcaagaatgataatatatatggaaggatttactaatgaaatatttctgtatattcttcagtgacaaactgggtggctttatgttaaacaacataaaagaaagtcatacaaatttgatctccagtttattcgtgttgagtttgtaaaccatgcacactgacgcaggtttacaagtaaatgatgttgagaaattcaaacacatacatatgtgtgtgcaatccatatgtggaaatgcagtcaataatttatatcaaccagccacaaatatttattgcaattattaaatggctcctaggcacaatcttaggtcttggggattcagtgctaagaataaatgggcaaggattcccatcctcattaagcttatagcctagtagggaaaccaaacaataaatacttagaagtattaggagagccatgagaaggagggaagatgtagagctgttcttaacatgggagcaaagccaggccagcatggtggagggacgatggtcacagaagacagccccatggaagtgatgcttaagctccacttgaaggacgggtacaggttatcaaggagaagagcaaagcagtgagggaggaaagaacttctcaaggaaagagaagggcttgtgcttgatagaggagaatccaatgccttaggagaaagaagaagtgggggagtctggtgtgcgtggtggaaagcagcacaaggtgggtgccacataaagtgatgctggagacaggcaagggccaggtcaggtagggctgaaagatatggatttaactttgaggacaatgagatgccacttaggaaggatttttagcagtagaatggcatatttagctcttattttttaaaggtcagtctggccactatgtgaagaatggactggaagggaacaagaatggagcacatttagaaggccattgcaatcacccagatgagaagtgcagtgatctggacagaagcagagacagggtagatgaaggtgaacagtttcaagtcaacagggactgactgtgcgtgggggatgtgtgaacagcaggagctgataaggagccctcattttcggacagggagggtaccaagaccattcagaagactggaaccatggaggaaatgctacttcacaccaggtacgaatccatttcaagtgtgttttagaggtagaggtaggagtgaaggtccattccagcaccaattctccctaccaacctgaattgtttattgcaaaagattttatttcattggtctctttttactgaaggtataaatggagtgtcatcttttcaaggagagagaaacagatgccctttgagaaggggagacggaaggggaaggaaagttctgaaggcagaggtgtccagagaagccgaagcatgcaatgggaggcacaggagtgagagtgaacttcaatagacacacactgacccaaaagagttgtgcatcaaagacacattctgataactctgcaacttttgcagagagccgatgacgttctaattgtaacatttccctttttactttttcttccttggtgaatggtggtagacctattgattacaccataaagataagagggaaaagaaggaatgactgcttttctcatataattatctttttaaagtccttgtcctggtttgcacactcaaaaaggaacacagaatttgcaattatagggaagttatttctgagcataattaaatgctctccatctttctctcacacaaaagcttgcaaattccaagctagtagatttttgaatcctatcaatcatttctatttttaaattatattccagatttattatatgatatactaattataatacaatatttgcaataatgaaaatgtatttgaatagtcaattggaacccacaagtcaactcctagatagatgccttagtggctctgaaaggtggtccccacttgggatttgttaaaatgcaaacacctgggccccactctgggtgtacagaatcagaaattcagggagtgaaactcaacagtctttttaataagccctccagttgattctgatacatgttaagattgagaaccacttcttcagcagtgtttcccaaccttttcccttcgtggcaaaaaaaaaacctgcacacgtaccctgaacctaaaataaaagtttaaacaaaagagaaaatgatggcatttgtacaataccccatgttaagtggataaggctgccagaggcttgccccagaccctatttgtgttggcctgagcagctcaccgtaaccttttcatgatccaccagcagaaaaactcagatctgaagaaactcacaccagtgcaaaaacaactatatatacattctttttgttaattatggcaccatttccaacaatgaaaaattatccaaatacaaattaacaaattgtgacatatttgtgcatagaaatactactcacagttacaatgaataaactggagttccatgtatcaacacagagaaatctcaaaaacataatgttgagcaaaaaaaaaaaaaaaaaaaaaaaaaagcaggttataaaacaatgcatacattttgataacatttatatagtatttataacatgctgaacaatactgaatattgtttgtggcatgcccacatgtagtaaaatcataaaggcatgcataagaatgatacatagcccttaggaaagaggaagaaggggaatcagggatgtgtattcatggggctttacccattttatttcttcaaatatctaaagaaaatatagcaattggttaagatgtgacctggggagaaagggaatagttacacatgggtttcttatatgacttgatgtatttttctgtatagttaaaatgtttcatgaaaatttttgataagaaaaaaaaatcagttggagtctgctatcaatttatccgagttgtaaacccaattttgtgttagctctttggtgttgggcagattactttctctctctgggccttcatttcccatttgcaaaatagaaggggctgagttcagtgacctctgaagctctctgcctcttgcaccctcttcaatatatattggtgctcaaatagaaatactcttagccccttctctttatcccctctatgcataggcaacaaccttctcagtagttgttccctgtccagctgtctaccttaatagccccttgtttacaatggccccagcaaatgggctggggactaataacacatcacaaagcaggaattgtagaacctgtgtttgaagatatattttaagacaaagagaataaaaataaaaccagaaaagtttggtacatagacaagcagtgtaggatttagaaaatgaccttgaatttgcaagcaacctttccttgaaggagaatcttttccctgagcaatgaatttcactaagtgaaagagaatttcaaatcaacattacagcaatgttcactactttattcctactctttaggcatcacctctatctccttatcgctcaccccaacattagatatgattcaatacaactaactagctttttcaatgaaagaaagcttagtttctcatgtttaggaactgattcctttgatcttccctcaagttacgacttacataggcaattccctttccaaataggctagtttgtagattctgtctttgaatgtgctcagtcatttcaacaatattaacatcataatattgatgaactatgcctacaaagggcgactgattttgactaatttattatttactacaaaatatttccaatgtacaaaaaatatactcaccatcaatatgtatttttaagttttactaatttgcacactcaaatcagcagaccaagttaaaatggcatcttctaccttgtgatttgtgacaccatatcacaagcttgagggttccatgctcctttttaggcacttggtgagtgtgatatggtaggaaacatatttaatgtatggttttagctctaaaattcactgactaagtggttttaggaaatcattcaacatctcttggcttcagtttcctaatctatgatatagacaaaatggactttgttatttacaaggtctccccatctttgaaaccccttggttctatggaatgacctaacaaatccattgatctggcattgtggccagtctcagtctaagttttgaactcttttggttgagaaatgataaactcattaatgagatgcaagctagattcaatgcagtgtgtatatgtgtgtgtttatacttacttatattgattatatacatatatgtgtatttcatttaacagaaggggctggatgcagtggctcatgcctgtaatcccggcactttgggaggccgtggcaggcggatcacaaggtcaggagttcaagaccagcctgaccaacatggagaaaccccgtctctcctaaaaatacaaaaattagctaggcgtagtggcgggtgcctgtagttccagctactcaggaggctgaggcaggagaatcacttgaacctgggaggcagaggttgcagtgagctaagaccacaccattacactctaacctgagtgacagagcgagactctgtctcaaaaaaaaaaaggggggggggaatatacatttcatcttggttattatacaaaaaattcccaatatctggcacataacagcatacagttaatacttactgaattaacaggattcattttaagttcatactatttgatatactatgctagtgacattaaatgacaatttctcttttaatccttacagtaactctgagaggtagatacttcttaactggtataggtttacagtactactaaatacgagtcaggattctaagtctgacttggcccatctcagtgataatattaatacccaaaagatagacatatgctttgtaaattaattttataagagcttcacccttgtatatctaattacttctaacaggcattcaacattgacctacaactttatatttcttccttagtactcccctgaaatttcttactattcactgttatgatgtgcctcgctgctgattaaaaaactaactcaaaactaaaataatgagggcccaaaatgagaattacttagtgggatccatccagaccttattcttatttaaataaatacagttgactttactacctgtgaatgactgactttggaaattatttgtggtacctattttatcccactaaactgcttaatatatcatattatgtacatcaacctcataactttctttgagggggttattagtctgtttggttataaaatgcagtcaataatatgcattgcattacagcaaaacatctgacagaaaacagaaaacaacatacccaaacagaaaagatggaaaaatgtagactggatgttagcgcaactagtaactcgttgaacatttgtacccaaaaggctagtgaataagagaagaacctcaacctggaaaaagaattgagccacaggattctgttctggacctctttctgttctcaaatattatcaatggcttagatagaaaacaaggtcctaaaaatgttaagacaaaaacactgagtgggataataaataggttgtataaaccaaaatagatatggtagtgtacagatatgggtcaagttgaacaaatcaaaatttaacagagataatcataagatcaaaaataataattctcaagtgcagaatgctaaaaaaaaaaaatagttggcagctacctagacagaaacatagaaactttggttggcaataaattcaatatgaaccaaccatatggtatgactacccataagctataccacctttaggtacaataatagaaacaagaaatttctgtaataatagaaataaaattttctcagagaggtgagattataggcctgctctccttgccaaagataacttaattccatgctgcagatggattttggtgttgaaccttaaagaaacagacaaactggatattcaatttcttataccagaagaagggaacatttttttaaatgatgtttttcgtctacagaaaagaaaactaaagaaggacatggcatctatctttaaatattttttaggtagtctatggaatgaaaatagtcttcatctgaaggatccaaagaggtcaaatgagaattaatacgctcaaataaaggagattgtgacttggcacaataaagaaatatatggtatggacttatcagaatgtgagttctcccatgttgggtagagggacaaaaggctgaacaaccaattagtagaatattgtatagggaattaagtcactagtgggagctttgtctgaatgaattttgaggtctcttgcaaacctgaaagaaaataaatccataatctacaaatggcctaaaagaaaggtgattgcaaaagacttattcacattactaacggtctcagcaagatatggtgtgaagtccaatctgctacccatccccaaatatttatatatacacacacacacactcacataacacacatatgcttcttatcaaggtggaaaaaacaccaaagccctcattagctcagattctactgtttcaaatgtgtaacaatgcagaagaaaataggatcaaggtttgctatctctaaggggaaaaaaaaaagtttgcgaagtgaattgctagggtaaacaagattctgggaggaagcttgaccttacaaccaaagtcaaaaaaacacaccattaaaaataaatagcttatgatttctgtacaaataaatcttcccaatttctcaatgacccattctttaactcagctcaggtatgactgaacagttataagtccttgctagcagtccttactgaatactacacacacttgaaaataataaagttattaaaattttgtttaattcagctttcctttgaactaggcattccccaagtttaaattaggtttcattaatttaagttatttcaggaaatttttgatgatatgttgctctacattattcttgagtacagataagcaagaaatggccatagatcattcccagccaacacaaagtaattattatctagaaagagataaaagtaatattataagtaaactattacctagaaagagataaaagtaagtaagtagtccaaaactaaccttaaagaagcaggagatcacacaaacaggccataaactgtagaagcacattaaatccaaagctgccaaattcatgacatgcctggcaggtctgcatgggtgcacaacctgagcagctgcccagggcctgtacacagaagggaggtacacttagctaatgatctactgtcaatgtcttaaaagtgtcaataatttttgaacactgggccccacagattatgcaggtggtcctggagactggcacataatggtgactgagatatgaaaagcaagcaagtaaaatgtatacacaccggcaaaatctaaaaatagctccatttattaatgaaaaacaatatcctgtaatcaagacacagcctgttggttaacgttataaagaattactttgcttgtttaatgtgtaaaccaatgataattcacaaatttgctaattgtttttctgtagatgtgagctgtcaaccggtggagcttaagtattcaaaagtaatcaaccaccatttcaaattccatcaaaaagtcatgtatcactttcaggagacatgaaattttggtacatttttactggagttgcagaaggagtgataaagcaaaagtgaattttaaaacaacaaagcaatctcctcacttcaccacagaaaattaaatgtagtgaagcagctttgtgacacttcagacttttccagtattctctggattgtgaactgacaaagctacatatgagtgaaaaaaaaaatttgaacttttgctcaaattatattcaccctaatgtggattgtaaagttcctttcaccagtgagaaacatacagctttatatccacgtttacagaagagaaagagttaccaaaactttaaatatcaaaaatatttttatgccactgtcttatatacttcagcataactcatttctaaacatgtaaatctagaaatgaagcaatcagagggaaaagttaagatgaagaatcaaacatcaaatccatcttggttctagtctaacaaatgtttccccactggatttcaagttcatgagtagagtctatgtagctctggagaaggtatttaatagtaacctagatttatataacaacatttgttccaaacaacatttgcatacatcatatagtttgtccatacaatatccctataaaaacaagaaaaaaaaagcatcctcatcattttaaagatggtagaactgaggcacaaaacatataaaggtttttccaagatttcacacatatacaaagtaaaacatatttgaaaatcatttctcctttttaacatatctctattattaaaatctgagtgcaagattattgttataaaatgtatgcccagaaaagatattagttacaatgtaatttcaattataaatcattttacctggcactctatgaggcactaaataatttttaacaaatatgcaaattaaaagattatattttctaaatctcattgtgaaattatgtttaaatttagcaccagctcatatcccacaaaaaaaaaaacctaatatagggaaaacttgtgatagaaacagtctattaaatgaaattatattttgatttctaaagctgccttgcaagaacagaggttacaatttctagaaggagccatatacaaatttaaaaagagccataattcatgcaaagaaacattttctaacctgtaatttatagttcagctgcctttctaaaatctcaagcttttagttaaataattgtagatttgttgctcagtttaaaaacccttctggaatcacgtctttaactggcgttgtgacgtcttacgtcatgatgttgcgtcaccacgtgatgacgctgtgccatcacaacacatcatcgcatattgacacaatgtcatggcataatatcatcaaattaaattcatcagcactccccacagcctggccccaggaagggcaagagagctttaaagtttctctttgttcttgtcaacacactcctggttggtaggcgagaacagcaactggacaaatcatttcctggtctattaaaacttcctagatctcaaattaggagaatttgaaagttacagcttagagttggaggaaatagttttcacggggatagatttcatggcttgttactcaccttgccccataactagttacacttgaatcccattttaaagataaacatttataaatgttagttcctcctttttttcccaggccctaaaataggatcatatttaggctggtgaaaaaaaaaattaatttgtttctaatttcttgccctcaatgtccaccttcctcaaattgttttccttcaccacaacattcctcttctataacattctgaaatagcaagtaatggaggataggaggcagatccagtcaatagttttgactacagacatttatataaggctggagggtgtgttgaaagctgtgagagagggccttttgccatcacaggcttggtgacaagcagagtctccgtgttagcaactatgataaacctgggcatttggatgaaacatttatctgaatgttatctgaattaacttatgaactcttccaaaaatatgtagttaccagttcattaaacataatgggcggtttgtgcagactgtcagtgtgtgacctctctttcattagttcatttgctgtgtgccagacactgttctaggtacaagggctcagatgaaacagaagaaacagtgtcaccttgaggtgctcacagagcaataagggagacaagtgagcaacagatttcaagacaacctgctaagggctctaatgatgatatgacagagtgttctgaggactcagaaaaggaaaggataatctagggttgccaagaagatcctataggggagagaacatatttttgtatcttgaaaaatgaataggcagagaagaaaaaaattccacattcaaatgcaagaattggacaagttggacatgtgggagacaccaaagtattagactaaatccgtcattttgtagatgttttctcaaaatgattggttcatataaattttttttttttgcttttttttttttttgttttttttgagatggagtcttgctctgtcacccaggctggagtgcagtggcgcaatctcagctcactgcaacctccacctcctgggttcaagcgattctcctgcctcagcctcctgagtagctggaattacaggtgcacgccaccacacccagctaatttttgtatttttagtagagaccaggtttcaccctattggtcaggctggtctctaactcctgaccttgtgattgcacccgccttggcctcccaaagtgctgggatgacaggcatgagccaccgcgcccggcccatataaatgatttttaagaggtactgactcacactcatattaccataatccttcatcataattacaaatagcctctagataactcatgaatacgctgcatcaatgcagtggagttttcttgtaggagcattttccatccatgagaccaaatatgttccttctctctttgtaaccaaataaaaactgaaaatcaaagccacttgtactttcttgaaagcatctgactagccataaaaaccttggcaacttctcttctggtgtgtacataaagatggattaggaatatccctgctgctgattcaccttttaaaacaagcactggaaaaacacttcagcccagccaatgataagtggttatatattctgacattaagccccacatgaaagtcactggtagacattttctacagctaccataatcctcaagaggtgtttagaaactagacataacaaaagaataaaaacttgaggggatttcagtcctaaaagacttcatctttctgagaattacatgacatcgaaaggcaagttttcaaacaagtttctaaaatgtcacttttaagctagacaaacacatatctttttagaggttatgagagcaattatttaaacttgataaaatatttaatgtatggctttgaatctttaatgtatggccaaataaatactcatatatgatatatacacatatatattcattaacatatatattttataaaatgatacaaagaagagtactagtacctacactccaaaagacatgcaataagtaataatttggttacagaaagagagaaaaagttttcaaataacaatcctttttcactgatagtttatacaaaattttatcatgaataggatagtaagaaacaagatacaatatgaaatttgcttgaataagtgatatatttagtaaatggaatacagaaaatataggcagaatatctgctgaaaataggaacccaatgatatataacagtccaatatggagttagtgaacttcttaagatttgtttctttaagaattataagtatggcatgccttttttaaattccaaatccagaagataaacaagaatagcaacatgagaaattcctagtttttgcagatttagtcagctgtatattaatgtacttttcatctagatagaatttaagcaacagatgcatgtagcaaaaaaaaaaaatttaactcattttgtgtctttcagagcaaagaatcttttgtagtagaataatcacccatcatttgcctacttagcaagttcagggttccacatatttgctttttcaaatagggacacatttgtgcaaatgtgtccagttatatagtgatagggtggccctgaaagtggggctgaacatgttcatatgaaacttgcctgcctccatgttgcacacctaccttgtatacctgagacaggtataacaaacaactgcacttattctttctgtccccatagcttttcttctacttctttaggactcctaagattcacatgaactgaagcaaaatatccacagagagacattaaactttatttacttacatgaataattttctttaaatcattgaattcacagaaaggaaggggtaaaagtactcctgcttattaaggactatgctagctactagaaattgtgctaggtgatttacatatgttatctcatttcgtgcagttacttatttaatgatcttgaaaaggaatacaattattaactaatacaaactacaacattcagctgtttgaattaatctgatagctcatcatttttaaccaaaaaaatacattaacattttcaagtgtctctatgaactgggcattattattttaaaattaacccaacttattttcccatggttactaggtgaatgggcacagatcaagctaccaatttaatcaataatttctggctttggggcccctgcagcagaatattcatctccacctttatcttcctttcccccacacccttcctccccctgctgatgcttgtggaagctcaagttctactgtgtttccagatcttcctctaccatctggggtgttgactgatatctctctgctatcgttactgatgacaggactttattaatgtcatctcagtgtctatcttgtcactgctcaattcaggcctgcagatgctaaagttgggaaggatacttttcccaccagaatgtaaatagtctactgtacttccatactggatgttctttatttttcacactataggagagccccagactgattaattaaagaatcctaaatttaagttaaagttggtgaatctcaattttcaaagcagcttcttgacctccttgatgctggatcatccaaaatttcctacagaagaaaggctgccaggcgtggtgatgtgtgcctgtaatcccggctactcaggaggctgaggcaggagaattgcttgaacccaggaggcagaggttgcagtgagccgatatcgtgccactgcactccagcctgggcaacagagcaagactccatcaaaaaaaaaaaaaaaggagagagaaagaaagaaaagaagacgaaaggctaattccaggtaattcagacaaagagatcatgtggggaaaaggcagatagctaagctggtgaagccaggtgtgcaggaggatcccagcaaatctggggaaacaaacatgactaaaaaggatacaccaagagaggagctggcttgacacagcatgcaatagggagtcattgccatttataaaagaaggaatggtgtaataaaagcagcactgtagaaggattcaggaggaattggaggaattccaggagtcagggccaccatgacactgcaagcatgaaagctggggttcagctggtgtcaggggacatgggggtgtaagagtccaaccagagatgttttcagcaaaataaatgtcaggacttgtgaacacattgtatataagaaatactgtaggaatggttggtacttttctttatatatctggtagaatttgacagtgaatccatcaggtcctgggctttttttggttggtaggctatttattagattcaattttagagctggcttttggtctgttcagggaatcattttattcctagatcagtcttgggagggtgtaattgtccagaaatttatccactgcttctaggttttgcagtttgtgtgtgtagaggtgttcacagtagtttctgatggttgcttttatatctgtgggggtcagcagtaatattcccttcatcatttccaattatgcttatttggatctcctttcttatcttctttattactctagctagtggcctatctattttattaatttttttcccacaaaaccgactcctgctgggtgtggtggctcacacctgtaatcccagcactttgggaggctgaggcagatggatcacaaagtcaggagatcaagaccatgctggctaacacggtgaaaccccgtttctacaaaaacatacaaaaaattagccagacatggtggcaggcacctgtagtcctggctactcaggaggctgaggcaggagaatggcgtgaacccaggaggcagagcttgcagtgagccgagatcacgccactgcactccagcccggatgacagagtgagactccatcaaaaacaaacaaacaaacaaacaaaaaagcaactcctaagccaggccaggtgccatggctcatgcctgtaatcccagcacttagggaggccaaggtgggcaaatcacttgaggtcaggagtttgagagcagcccagccaacatggtaaaaccctgtctctactaaaaatacaaaaattagccacttgtggtggcaggcacctgtaattccagctacatgggaggctgaggcaataggatcacttcaaccagggaggcggaggttgtagtgagcagagattgcaccactgcactccaacctgggtgacacagtaagactctgtctcaaaaacaaacaaaaagaaaaaataaataaataaactcatggtttctcatgtctccattttcttcagttcagctctgatttttgttatttctcatcttctgctagctttggggtggatttattctttctctaattcttgcagttgtgaaattaagtttttaatttgagatctttttgacatgggcatttagtgctatgaatttccctcttaaaactaccttagctgtgtcccagagattccagtatgttgtttgttctcattattttcaaagaacttcttaatttctgccttaatttcactatttacccaaaagtcattcaggagcatgttgtttaatttccatttaattggatggctttgagtgattttcaaagtcttgactttctatttttattgtgctattgtctgagagtgtgtttggtattatttcagttcctttacatttgttgaggattattttatgtccaattatgtggttgattttagagtatgtgccatttggcaatgagaagaatgtatattctattgttttaggtggaaagttctgtgaaggtctataatatccatttggtccaatgttgagtttaggtcttgaatatctttgttaattttctgccttgatgaactctctaatactgtcagtaaaatgttgaagtttttcactattattgcacagaagtctatgtctctgtgggtctctaagaacttgcttcatgaatctgggtgttcctgtgttgagtgtatatatacttaggttaggtctttttgttgaattgaaccctttaccattttgtaatgcccttctttgcctttttttattcttcgttggtttgaaatctgttttgtttgaaattgggattacaactcctgcttttttctgttttctatttgcttggtagattttcctccatctctttattttgagcctatgagtgtcattacacatgagatgagtttcttgaagacagcataccattggatcttgcttttctatccagcttgccactctgtcccttttaagtggggtatttagctattcaaggttagtgtctgacaaaggtctaatatcccacatctataaggaacttaaacaaatttataagagaaaaccccattgaaaagtgggcaaaggacatgaacagacacttctcaaaagaagacataaatgtggccaacaaggatatgaaaaaaagctcaatatcaccgatcattagagaattactaatcaaaaccacagtgagataccatctcataccggtcagaatggctattaataaaaagtcaaaaaacaacaggctggcaagcttgcagaggaaagggaacacctatacactgttggtgggagtgcaaattagttcaaccattgtgggaagcagtatggcaattcctcaaagagctaaaagcagaactaccattctaaccagcaatcccattactgggtatacacccagaggaatataaatcattctactataaagacacatgcatataataaatttcattgcagcactattcataataccaaagatgtggaatcaatctaaatgtccatcaatgacagattgaataaaggaaatgtagtaccatatataccatggaatattatgcagccataaaaaagaaccagatcatgttttttgcgggaacatgcaatagctggaggccattatccttaggcaaactgatgaaggaatggaaaaccaaataccacatgttctcacttataagtggaagctaaataagaatttatgaacacaaagaagggaacaacacacactagaggctacttgaggtgagagagtgggaggagggacagatgcagaaaatataactactgggtactgggcttaaaacctgggtgatgaaatagtatgtacaacaaaccccatgacacttgtttacctctgtaacaaacattcacatgtacccccaaacctaaaataaattaaatgttttaaaaaaagaaatgcttggaagctaaaaagacaagcacaactccaaataatttgaggatgaaagataagaagagtgttgggctactgacaaaaatgaggatgtcagagggctgtggtggtggagatggaaagtggtttaatttagatgtgagcaagtcaagatcacagcagactgcccaagtggaattctcattcttttgttactgccacagttgcagagcccaccagcgaagtctgggacagagatggtgggggcacctatttcccagcacaaaccttttcaacaactactaaaattcctggtcaaaatgaaccaaacctattcattctttcatttaaaaaaaattaacatgtctttccctgtaaaaaaaagaaatgaatttttctctttcttactcaaaaactgatcttcagaaaatcattgaaatcattcacgattctgaaacttttgctgaaaagctttgatgtattaaaaagaataattacttaaaaaacagatcctttgacactccagattggaatttgatgacttttttcccacagtgattcaattaattggtttttcttaatgtttaatggtagcaaagtcatcacattgaagaaaccttatgtcatttatcagcttcttctccagagccctgagaacacctgatgattatttcaatccaaccaatcactcactgaacacataatcatgaataatttagtagagcaatagatccattacttaatatagtgctaaccttttataatgcttatacctggggagaggactaatatctgtgtcacagaataactgatatcaggccttgggttttgaaggtaacattgtgacttatggaatatctaaacgcatgcaattataaaccacattatgggaaaatagttaacctttgtgtagcatttaagagtttacaaggtactttctcagacattatctcatttgatactcaaatcaaacctgtgagaaaggtattctttatttttttttaatttaactgacacataattgtacatatttatgagttatatagtgatgttgtgatacatagaatgtatagtgatgagatctgggtaattagcatattcatcaactcaaatacttatcatttctttgtattggaaacattcaatatcctgcttctatttgaaactgtatattattaacagtagtcatcctacagtgctagagaacacaaacttattcctcctagctagctgtaattttgtaagctttaacaaatctctccccatgtctcctttccccctacccttcccagcctttgctagcctctgctctacttttttcttcgattagatgaatcatttagcttccacatatgagtgacaacatgtggtgcttaatgttttgttcttggcttatttcacttaacgtaatgaggtattataagtgaggacagcagggctcagagaggccaagtggtttgcctaaaactgcctagctattaagtggcagagctgagattctcccccgacagtctgtgctgtctcttgtaccagtattcactctgatgtgataaaggcccaaatgccaacgggctttctaaagtaggctctctccattccacacagcaccaacagcctacccatgtgagggccctgttgcccttcatctttgttgaccacctccctctggtggccaagagttctcacatgagaaccttcaagaggagcatcataaactaccatttctagagcaaaaaaatgcttgtttctcaggaaccaaatcacacatgagcatttctgcaacatatacccatcatcctgtagcaaaggaagccacacatctggtagtaacaggtgccgtattctttttttaaatgattcctgccatgtgacagttcatgtaaacagcacacagaattctacccaatcaagaattactctttatttaaaattcttaaaggagacttgccttgctgtaagctaattttgtgaaagtttgttttgcctattcaatatttagcttgatttccgaaactatctggaacagtctttactaggtttgtctgtttctctctctgagactgcctataatagataaaagcaatgctttatttccataatctgctcttgagagttcctcattatgcttaaatgtctcccctttgttttaaagggtattatcctgcattcaatgcaagaaattaaaagtgtcattagataaaactgacatttcttttatagcaaaagtaaactcaatccaatttagaatagtatgtcaggttccatctttacttgttagataaatcactgttacaataatcttcattttcatcttattattattatttaaattttttacttacaaataacagcactccaaggatcatgtaaaacttgaatttaaacaaagttctgggaaaggtggctagtgattcagggagaacagcaaagggagatatggtttataattacacctatttaggtaactgtgccaaatccctttagaccagtgaaagcacacaacagagcagatcctttcccactaaataaacaataaataaataatttaccatgatatggtgagccttgagttttcccccattccttccatccctcgtattagtcaaggataatttcctgaaatatctagtattaatgaaactcttttatgaatcaaaattgtaatcatttagaatctgtgctcaaaagatgtgggtggtttgatagtcaaaatcacattatttaggggaacttgtagccagcattccaaattcaatttattaactccctcatcaatagccagagtatttgacaatttattcaaagctttcaaacatagcaagagacaataagaatgccgtgcctagtgctaaggggattccaggcacattatcagaatgggggcttgcagtgtaactaaccatttgtggatgcatgggacagcaacatttcctgagacatgggacttttggtgctaaactcaagacagtcctagacaaaccaggttagtcactctagggtcaggttgagggaaaaccttcaactagaactggggcacacatggagaaggatttcttcctagaaacaggagaaaagctgcctcgctgaagccagagcacaaggtcagagctggactcaagaccttgatgcaagagcaacaggagtattcagttaaagctttttaccaactaccgactgaagacaagattggtcccagagcaggagacaggctgaatcttggagtagagatgattacaccacacagtgaggaggaatatgggaataaaatatccatatttactgaggggataagaagaccttatcctcctggcctgtcttctctttgtgctctcctgttagctgaatccagtcagctgtttttctttcatttatgccaggatgcatcactttatacttaagcatgtgtggacagagaaaagctcccactaaaacactgacataaagagaggaggatcgcaccagaattatagggcttccctgcttttgtgaaggaaaagtctttaacgttattataaacataatatatggtactcagattggggtttctgttatattgaaccattttcattggaagacaaagtttctctcccctctttccacaggcagccagtacacattgttgtctccattgtaaccattattttatttttatttattatttaaagacagcgtctcactctgctgcccaggctggagtgccacggcacgatctcagctcactacaacctccaccctgtgagttcaagcaattttcgtgcctcagcctcccaagtagctgggattacaggcatgcaccaacatgcccagctaattttttgtatttttagtagagatggagttttgccatgttggccaggctggtctctgactcctggcctcaagtaatccacctaccttggcctcccaaagtgctgggattacaggcataagccactgtgcctggccaataacaaatattttaatttaaaaaaaaaagaaatcacccctttgtgggtaggaaattcttttgtaaagacagggattcacgagtatgacttgctgccagggtgaggactgtacacttaggacaaagcagatgagagaaccccaagaggaaagtagagaactgttgacattcacctcttcccaccagaaggtttctctctcagaactaaaagttagtgatattctatatgctgatttattttactaaaggagataaatattcctttacaaatgaagcagaaatatggtgtcatgattaagagcatttgtttattccactggttaaatgtatgatcctagttttgtaacctctctgagacaaactttcctcatttgataaatgggtactataacccacaactggcagggattttctgagaagtcataaaatagcaaacgtagaatgctatgtccaacattagtaggtgttcaacaaatgttaattattttccttcctttttccctgccaatatcctatctgaaaacaaacaaataggtcactatcaaatttgaaaaattattcgtcatcacgatttattaccaatctcagtaacaggatgatgggcacattcagttcattttcttttaaatttaccttagctttcaacatctaacttgtctttaaaaataccattcactaaaataagtggatatctggtagagacaacctgatatttgtacttgaaatattctaaaatgcacttggacaatcaattcatccactcacttatgtgtgtatctgtcgacaagtgtgcttgtttctacataaggatcattatatacaagccccattctgagcgcctctgtgtttgattgttttctaagaaaaatcatgatttccaggtggaacagtgagtactaccctttaaaacctctgaagttgatttttacttatatcacaaacacaggcatcaaatggaagatgagataaagttcaccaccagctttgaacagtaaaaatgacagaaattgggagttctttctgaaataatgcatagaagtcaatacagccaataactcttcctaaaccttgtccaagcaaagacgcttcaagtcaccataaaccatgatgtgtcccagaagctcattgaaaacaatgagctagcacagggattattttcctcaattttgacttttattactagtgaaaattaagagctatcaccatgtgtattctcacaagcacattatatgtataaataaattggtttaactctctcaataattctgaactgaagggactatgattatccccatgttaaagacgatgaaacttggaaaataacccagggttttagaactggtgacagcaaagttaagactggaacgtgtctcttgctgaattcaaagcccataatctctagccattaaactaggtaagagaagaaaggtaattttttctttttggaaatattataatcctgcctaagaaaaattctgaaacaggccatttcatcttcagtttctaacagcattaaataatgtaacagaataggtaccttcgttttaccttccaaatcgtctagctagtccaaatatctgggtctgcaaacggcattttctgagtcccaggttccagatcatccttactatttcacagaaaataacatcactgccaaagaagttatttctccaaagtaacttcttagacttgacgtatgtagtttaagcaaatgtcctttaatgttctcttcatcgtggctggggaaaaaaaatacctaaaaagctctgagttttattcacttcaaaaaacggaatcacaaaagatttgaaaaaatgtcctagtttttcaactcaactttaaaaggttttttcaaatggttaatttgatatcctagagtattcagcaggatcccttaatgaacttaaaactggactttttttctacagacttggtgttcagataatgatttaagaccacctcaccctgccttctttgtgcatggatgtcattagactcaaagtcaagcatgaaggtgaacagacattaatgtaagaccacttagagctacgttctctgcatcactcacaacaagcctcctttattagcccctgacgggggattcattagttggtcggactggatcaaaagctaggtggaaataacccttcctggcaactcagacgtttttcctatttctcttcttatttgtagaggtcagttcatagataataggaaacactgtaactcaaaagataatgtggtctctgaatgcaaatcaaattaatagattaaaaatatggtgacatggttgaggttcatagttgatcttttctatatatacatatttttttttgccagaaataaatccaactggcctcttctccactcaagattttcaaactgaatatcagacccccaactgaaattcagtatggtaaaaatagaaataggtatctttgctttcagtattttccctctctactcccacatgcccagctttgctatgtggaatgccactgataccactgaaattaccccctgaactccagtttctctccattccctttgattgctcagttcttactcaagctgtcttcagtgccgctcttcttcccaccgagacatggtgaggtttatgctgttttcaggcatagacaactagcttccaccattctgtgtaatatatcgtgtttccttgcctgtgcacacctggttcacccaaacatcaccctgtacacccaactaccctgtagtctcagctcagcaagcattctcccttcattttcctcatacttgcatttgagggtgtcagaagctctccctatctgcacaaactctccattcacattttactgagccagttctttcatacccacaaagagttcttatgtgcgcccctcttccaataggatctctgagactgctaacatatttcctaaaagtttcccattatctgtagaataaaatatgatcttcagcctggcctttaaggttctccaaggtctcactgtgtttgtggatttttttttcccaaccactccagattatattgatctctgaaactttttagcatttatatctgcatcatttgttctcaaacttatgctttcttccactgtttcatgagaattttatgtctgtttgttgcccatcctgccagcactaaatgctgaaccctcatattatactttttttttttttgcagcatctggctcaacacacaaatcggggcacttaaaaatattaattcagtaagatggaatgagtgaatgagtgaaaatagagtgctacctagaaacagagaaacacaaaggatgttcaatttggggagagaaagctgtaggtgtttttccaacccacatgatacatcttaaacattatttttagggagttcttgaagatgggcaagataaggtcagacactgttctagttcacttttttttattttgacaaggcaccaggagagacaaagctagcccacctctctttctttttttttttctttcttcaaaaaaggccatcctcgcttccttttcccttttccttcaaaaagtagtattctacaggaaaaactctcagaggaggggagagaaagtgaaggggaaatgagaaggagagtcagtcatcaccgccacagctgtaggaagaacgccttcctctgcccagaaggcaggaacaaacaccacccgattccagcccactgagcagacctttgagagggatcaaacttctaagtactggagggacctagaaaattgcttaaaagccaggaaggatcagccacacaaaaggcatgcagggcagaaggccagtgcctctggatcactctgaacccatgaacagaagagcggagtaatggtccatgactgcaaagggggcagatgagtaagtacagagagatgatctgcgccccatcagtgaaaccctgaagatgatccttcaggatgcttataatggttgcaggttttgagaagacagatacttttagaggggtcagggattactagctgagaagcttccacttactctttcaggaaaatgaaagtacaggctctgttctctgcatcacccacaagactcgtttattaccccccaatggtgtggggacctttattagtcaggggaatgattattattttgtctaactccacaggctgattggcttggctttcccaaagtctatgaaactaaaactgaccccgcaaattaatagaaacagcatgagtcatttgaagttcaagttttaggagccactcaggttctcacgaatcatgaggtgggagcaagccaccagatggagggctcgaagagagacccagccccagaggatcctctagattgcaaccagcttttttcagacatttttatatatataataagactgtgctcctccaactagacagaaagtcctgttgaatatgagtcattggctcttaaatagtttgaagtttttgtaaggagtttttgtccttgaaaatccttctacagacaagactgaaacattaatcaaaccttaggtaaccaaaggagtatcctttcatttaacttgtgttttcagcattatagaagttttagtagtgctgtaatgtttcacatacaaattgctgtaatgtgttttgcttaataagacttggaaatggaagtagttgctactgataagcccagatggcaatacaatagtatcctgaattaatctgatattccaaacaattttaaacttttaaataatagaaggtagcaataaaatagtattctgttgattataatctagaacatgggcaacattattggggtaggggtggctactggggacttcagtgtaaaactcagtctttttgtcattcatgaaaatttaattccacatagtcaatgttttacatttccaattttcattcacccatcacatctgagcaggaaattgtgcaatataggcaaaggacaaggacagcagagggtcacaatatgtgtactggaaaagaatgaggcagggggctgctcctcctctggggacagagcttctgagatgtccccacttgccctgttctaggtgatgagtctcagctttgtatatccagcaactcaattttgctagccaccttggaactggctcacaataacccacgctatcatttgaaatgagaagatgattttcagacatgcctctcgagataacccaaagcatccttccccattatacaagttgctttgcctgtaagaccaaaatatttcatccagtctcctggccctgtctcctaacagtgctggatattaatcaactgccttctatatgctcaccactcccccttttaaaagctagactgataatatctcttgctggcacctcctcttggataagttagtgccttcctcctgccacagctggatagttggattcactgacagagtcaagccctgcctagggctcaccctgatctcttgattgaaaactttggattttaagatgctcctcaggtgttcatgagtgtctcatttacaagcagtctcccaagcagagtattccaacagaagactggcttcatcctttgtgtattcttgaaactaatttcattctcagagttataggtgtgtttccttcctatagacagccacattttatgtaggagtcttactcattttgtataaaggcttattttattttcccagagatttctgtggtaagaaatgctgtccatagttaagttcctagtaaagatctcaggggtaaaggtgggagatgggatggtggcagccaggatcttataggttcaccaggtgaggctttaagctcaatctataggttacccagttaatcacaggtaacaaatagtgttttccacaaaatgtagcattactttaagtcctttataattacatatttcccacaattacttagctaatggaccactacagaaaatttggctatattcatagtttagtaaaatggaagtgattacaaaaaataaaattgatagaaatacactaaaatatttacttgataaatgcattcataaattagttttagttggaattttaaacttttagtcagggcgaagtatatgtggggcagggggtcggggggaggtacatctaacaacagagaaatcaggaataaataaggacacttgtcttattatccatgatataaatctaccttctttggttttgaatgggataatgtggagggagtagtagtggcctacgaagccagccaagaagctgttgaatctaatttatgacatagtccagacctgtttttgagccacctgccaaggggattcttcccattattgggggagggagaggaaggcatgtgaatagccagcactaaccacctggttgggctaatgttcactgggatcctgaaagaaagagggcaaaacagcctgctcacccatacctgtctcccaagctcccaccagtttcactgacaagggtagcattagttaggcgaatgactccctatcttattcacctttataccacccaagagcacccagcagaaggcctgacacagagacagtgctacaatgtttaatgaattgaattgtatgctggccaatattaggctttacaattgttaaaagatggtttgatatgcttagtcttgtcaaaaacattgtatgtaagaagaagaaacttgagaaaggtggtcagtagagagcctcttcgactaatagacagtttgagcatctgacagctgcattagaagcagaaattggtaaacaacttgacatagtatagcaaaacattcatgaaggcagccctgaatcccaaacagggatggataacctgaggacaaggaaagaaaaatgaggcaaatagacttttaatgctgtaatatacattaaacagaagccctctatttctgttccatgttcagatccatcttgagagcacagcaaacactcagagtatctgggggagaaggtcagttttcattcatcattatcagcaatgaatagttactaaaaggagtgaggctttgagcccaggaaagcagaaagaacagagagagtccccaaggctgggatgaggcaggaagctgctcaggaggattagcgcctgacgtggaagtggtttcccattcttctcttttattcctaagtttcctccattcttctcttttattccttaagtttcctccaatgacgacacccagatcttaatgccctttaaggagtccctgaagagcaagacctggtagggaccgcccaggaatctggtggctgactagagccccaagctgttacagggccatttgctctgctcttggccatcgtgtccattccaaaactggctttggcattcattgggctggtctggctcaaactctataaacaaatgcccttctaagtaaggactgcccaagtggagaacagaagtcacgtcagttatgccttatcattctcagggattcacagtattttagagctgtctgtggttaaacagtggacaatttaggccaatcaaagccattaatgaggaagaaactaaagtccagagagatggaatgacttccagggtcacacagagcccaagggtgagccagtccaatccttcgaccactacctgcaccccatatgtatgtgctgttctccctttatagccttcgttactgtgtgtcccatattatttccatattattttcctaagtccaggtcttcaatggagtgtgtgtgcagatgtgtctgtgtgagtatgtgtctgtatctgtgctgagcagggcaactgtgctggaataagagcttcaagaggtcttcagagagcccaggtattcactctagccctctctctggtgttcagccaagcaaatgtcaggagttttcataagtaatatttctctaactggcttgttctttcccatgtaacccagatctcaaccagaatctcttccttccttgaaatttaaactgtattcccctaaaccttaatttgttcttcatgtgcatccatgaacttcccccaaattgctgtgatttccagagcaggttccagccttgtgtgcttctaagctccttttctaacacaagttctagttatagcctagctactggggtgaaggtgacattctctgtcctatatcatatgtgaaaatcaaaccccttccaaagactcctaaccaaaacaaaataaaaaccacccacacagggccactgtgaatacgagagtatgagatatagagtcagtttgcattaaaacaaaccacttcgaactgaccagtagacatgcccattttttaattacgttctctgccaggtaacaacccccttggtaactcaagttttaccatcttcttaacttatttttactcttctttctcattatcttgctccccctttctcctcctttcaagattgcttgagattctgtatccttcttgttctactacttagaagtagcaactctcaactggaggggattttgttcacgggggaacatttaacaatatctcaagacatttttggttgtttcagtgaggaggtaccggaacttgacatgtagtaggtcgaggccagggatgctggtaaacatcctgcaatgcacaggacaggtcctacaacagcaaattatctggcctcaaatgtcacagagttgagaaggctgtaggttgggaaaccctgatctatagtgacttggctatagccatgtctattcaaataccaactacagtcctaggcatatccaaattctttccaccctccttagaacgtggcaatagtttaaaatagcattttcttacttcggttgcactaacaagatccagatggaatgtcacctcccctggcagcctttcctggtccctctttccactcctccatctgtgctttcatgacactttttacacaccaccgtcctaccatccgtctaccttgttagaccatagccgcttagcagcatagatcattcccttttagctcctctagcacagttcctggcatagaattggtgtttaataatccttgtagaatgaaactgaatcttcagagcagctcctccaatcttagtatcaagcctgacagaagagtggcgattatcatgatagctgagggcaatcataactcttgttagagaaggtacaaatgtcatggggatgactatatgatgatgcacggtacagccttggttgaaaagaccacacttagtgtgaagatccaaagatgactcaacatggctcttagagacacccattgtcgacagaggatatcaacctgagaagatggtccccatcccagttttcagtgatggcatcacagctttcaatttgcattgcaatcagggctattttaaaggaagaaatgtaacagcctatctaaatattgctaaagcacacataaatgccaatttttcttgactaaggatacgtggtataattattttagaattaggagtaattttccaaagctttgtaagcacttcattaagtaatagaatttcaaatagtaacttctagataaacaatcggttggtgagaaagaaaaattgacattcatctataaggaaaaggatgtatgaaagaaataggaaatttcaacttaacacttctaatcaataattttgatctcatcttccagatactgttacatcaagccatccaaccatgatatataagcataattgaagtattaggcaatgacatttatttatatatacatgtgggctttgtgtttcttttttctttctttctttttctgagacagagtcttgctctgtctctcaggctggagtgcagtggtatgatctccgcttactgcaacctctctgcctcccaggttcaagtgattctcctgcctcagcctcccgagtagatgggattacaggcacccatcaccacgcctggctaattttgtattttcagtagagttggggtttcaccatatgggtcaggatggtctcgaactcctgaccccagatgatccacccacctcagcctcccaaagtgctgggattacaggcgtgagccaccacgcccagccgtgtattttttaaagttaatgacaatcaaactttgatgccttctaaggatagatatttcatcatttcctttatttaaagataaaaacaaatagaaaatagcagtgaggaaaagctaacagctacagaaaccaactggattttgcatgacatcttccctgccaaagttcatgccagccgattaccctttctctaccctgcctcagcttcaaacaactcccctagagcaaatcctacctactgtagacccagtagctgtttccccttttttcttcctcagggactactggttggcagtggccatttgcctcgggatacattggccctgccagagcccaactggtgaatctcagtttagttagttatacccagtatttatcaaacaaaaaggcccccaatggagacttcgtaggtatttttttttccttaagtactcccaaacctccgtccccatcctgtaaaagtttaattccacagatacaatgtcctttggaggaacataaacgattgtaacacctaagattatttttgtccctgtggtacacagaaaaacagccccataaagacatccacattctaatctctggaacctgtgaatatggtaggttacactgcaaaggaaaattaaggttgcaaatggaactaaggtagctatccagctgaatttgagacaggaagatgatcccagatgattctggtgggcccattgtaaccacaagggtccttaaattgggaagggggaggcagaggagtcataaatgagaaaggtcatcataaaaaaaagactcgcttgatcattgctggctttgaagatagaaggggaccatagccaaggaatgctggcagcttctggaagctggaaaacagagcaaaatagattaagaaaggagcacagctctgctgaataattaacacaccttaattacagcccttaattattgggcttctaacatccagaaatgaaagataataaatctatcttgtttaaagccactagatttgtggtcatctgtaatagcagcataggaaactagcacatcccccatccccaagaaccaattttggtcaccacggtggcaattctgccaccactgagaatgtatagtctaactcagtcattgtaatctcactcctttcccaggtattaatttaaaagtaggcatgtgactgaattctggccaaggagatataagcgtcccctggaagtctctggaggctttttggctcttaaaaaaaaaaatggagagattcattttaagacaaacttccctttgtttttctatagatgtcaccatttacttgtgatccctggacctgctaccaggagacaatgagggctgactgataagaaagaccacatgctaagggtagaagcacagaacagtgggaaggagctggatcctcgctgcctttgtttgcagagggacacaaccagccaacacacttccagacttcttgctatataggaagaaaaatgcactcattatttaagctagttttgggatggctctttcctgcttgccatcaaaagcaacctttcttccctttaccaaaaataaacgcattctataaacaaaacattcatcattcagtatccccttgttagctcaaatttaatatggtcagcagcgatatttaagggagaagatttcggtgtcagagaatatagaaatgagattctaattagagatgtttagcagacacttaatccctagaatagcacgaaaggtcctttctgggctagcctttgcccagaacagcctgttctctcataccccatttcccccacctgcctccaccctgaactccatgtatcctgtgccccagtcacactgaacagcttgccattgcaaacacatgcttgccttctccatccctgtgcagtagagcaggatggtccctagagcccttttacctgactaacaccttctcattattcacaatgcaatgcagatattggcttcatggagccacacctggcatcacccctacccagagagagtgaaacattagtaaccttactttacctgtgttcccacagaaccttaggtacatctttgccctgtatttttcaaattgtcagaagtgctgtaattgggtgagttaatgcctgtctctctcccactaacctggaacccgaagttagaaactgtggccttcatgggtaaacccccacacctagtactgtgcctgggccagaaggggagggaggaggcagagggaaaaagggagagcaaatgaatatgaatgagagagtgtgagtctggagctcagatgagacatcagaactgaagatatcatttggggagtcatcagcatagagacgacaattgaaactgaaagcttgtatgagattgccaagaacagtttctttagaaatattcaccatcacgggtgggaggaggtaaaggtgcagagagagaagcatgggagaaggaattctgagtgctgataaaggagacaatttctgaaggtatcagcagtgctggaggatgcaaaggggtcaagaaggaaggaagccaggaaaaggccttggacttggcctcagaaagaacctctaagaaagtaatagtaatttcaccagagtgagtagagaggaagtctagtggcaggggattcaagggagagtgaacacagagtcagtgggtacacactgagcccacactgctcctgcagatgctcaccagaaaaggaagagaacaaactataccgctctttgccttctttcattccatattcacatgggctgataatcctgaaaacatttttatttaattaaaaaatacaatgcctttatatattttggtctgttcaggaataagctctttagggattttgccaaaggggatataaaatgtagtccattctgccagggctggtgtggcagcctggggattggttatgtggtatggattcaggggtgggcttccttgttccaatagaccaggaacaaggaaacctgagtccctggtgctagtctttccttgtaactcactctatgatctttattaagttattcatgtctctgggcctcagtttctcccttcttaacctgctttagttctcaatcccactcaatgataccaggaaataattcgaccagtcaatgaatatttacctattagttcaatgtgcaaagcattaagctaagaggctaatggaagtttccattcttctaatggaaaactctgatccctattatgacataaatctctcctgggaaagtaacaatcttagctgttattagtcattaacactactgcgtaaatgtttcctcgattataataataatggcaaacatttcttaaaagcttattgcatgctggatcctaagcttaaaactttacatgggttttctcttttaatcattacaaaagccataggaagtcaagaacattgttaaccttgtttacagatgtggcaggtggggcttggagaaatcatttgtctaacatagtcacgcagtgatgtcactaggcaagtgccagagcgggatcggaacccaggcagcatggcctcaaagcctgttgctttagtcagggttctccacagaaacacaaccaagaggaattccctcttgctcagggaaggtcaaacttctgttcagtccttcacctgatgggataagaatcacagaaacatccaaaataatatttgtccacataccttgtgcaacttggcccagataagttgacacataaaatcaaccatcacacttgtgcacttaacagaacaaggtactcaataatattttttaaaatattagttcacctcaaagcatttctttttgttttcctcactttcgttgataatataattattcacctaggtgccaaagccaaaactttgagcaccatccctgcctcttccttctccctcactctgtataccccattgcttgcaattgtttgattctacttcttaaaggtcttcctactagtcacctcatctccatccttgcaaccacagctttatttaggaccttgttattcattgcttggactattgcaacaccctactaactcaacctgctgcctacagatggactgaatctctccattcatctttcagcctaccatcagaaggaactccctcaaacacaaatctggtcacgctgctgccctttatataattcttcaaatgccctacctccttagtttggtttaaaaacaaggtccccccatcatccctttcctaagcccccatactccttgcatcctacctaacaacaacaacaacaacaaaatctgcttccttgaaattgccattacccttccttggttctaaacttttgcaaatgctgcccccctctttcacaaaaggaatgctgctcccttttcccccaaaatcggctcaaacaccattattgtctgaaagtgtttcctgatatctctgggcaaaataaagtaccttcatccctgtccttccagagcttcagtacagaatttaccaaccactgtaagtaacaccccctctagactataaatccctaggagacagtgctatgttctgttcatttggggaacctgaacacctgacaacatactacccggaaatatgagaacaagtacttcatacatgtattggagaccttagcagagatacaaacttctagagaatacatttgtggcttatctgctcccttagtgagggaaaaaagtacttagtatctcataatgtaatacggggcttaaaaatcattgaaggtgcctaaaaatagcaagtaggtctacttttccttgggaagagttttgataagatatttttgatcttttaggagttaaaaagatgtttctcaacctctaaacagagttggtgggcaaggcagaatggattggtagaatattaaaaatagagcgaggctaggctgttccttcaagatatttgcaaacactagaatttttaaacacaaaacagaataggagttggaatattttaagaaaataagtaaaaatgtagtcctcttgctatctccaacagctatgcatttgagtacctgaaatgtgggagtagacgaaggggcattagatacactataaaccatgtttgttattataaataacacataaaaccacagagcaccttcattatagattaatgttacagttctctgtggacacaagaccattgacaacatgggggacatgaggttgtaataagccttagattctataagtcaataaaattaagccatggcacaattgtgtcacatctacagaaaggcagagtagatcatcactgagggagacagtgattctaagcctcactcaccttggccaagcctgaagatcttgagaagtgtttctgtcccatcactaacttacccactcatactggtggtgtcagtgcaggagtcactgctactgaaggctggtggaaggaaagaccacaggttgttttttgtttttaaatactttaagttctagggtacatgtgcacaatgtgcaggttcattacttaggtatacatgtgccatgttggtttgctgcactcatcaactggtcatttacattaggtgtttctcctaatgcaaaccctcgcccaaccctccacctactgacagaccctggtatgtgatgttccctgccctgtgtccaagtattctcattgttcaattcccacctatgagtgagaacatgcagtgtttggttttctgtccttgtgatagtttgcttagagtgatggttccagcttcatccacgtccctgcaaaggacatgaactcatccttttttatggctgcatagtattccatggtgtatatgtgccacattttcttaatccagtctgtcactgatggacatttgggttggttccaagtcttcgctattgggaatagtgccgcaataaacatacgtgtgcatgtgtcttcatagtagcatgatttataatcctttgggtatatacccagtaatgggatcgctgggtcaaatagtatttctagttgtagatccttgaggaatcaccacactgtcttccacaatggttgaactaatttacattcccaccaacagtgtaaaggcattcctatttctccacatcctctccagcatttgtttcctgaccttttaatgatcgccattctaactggcgtgagatggtatctcattgtggttttgatttgcatttctctgatgaccagtgatgatgagcattttttcatatgtctgttggctgcataaatgtgttcttttgagaagtgtcagttcgtatcctttacccacgttttgatggggttgttttttcttgtaaacttgtttaagttctttgtagattctggatattagccctttgtcagatgggtagattgcaaaaattttctcctattcgcaggttgcctgttcattctgatgatagtttcttttgctgtgcagaagctctttagtttaattagatcccatttgtctattttcacttttgttgccattgcttttggtgttttagtcatgaagtctttgcccatgcctatgtcctgaatggtattgcctaggttttcttctagggtttttatggtgttaggtcttacatttaagtctttaatctatcttgagtatgcatatcaagaatattggaaacatacctattgtcaatagagcgggccctctggatcataaaatcgaagtgaggaagaaaacaaaggcattcatgccagaggaagcaaagtttttggtttgtttttgattgttttgttttgttttttgagatggagtctcgctctgtcacccaggctggagtgcagtggcatgatctcggctcactgcaacctccaccttctgggttcaagcgattcttctgcctcagcgtcccaagtagctgggactgcaggcacacgccaccacacccatctaattttttgtatttttagtagaggccaggtttcaccatattagccaggatggtctcgatctcctgacctcgtgatctgcctgcctcggcctccaaaagtgctgagattacaggcgtgagccactgcgcctggcccagtatttttttaaacaattcagaaagctatgtatccaaattccgaagcaatcttgagcagtcatcaatgaaagtctttaactcagtgaagcacacattgtcttaaatgcctttatctctttccctggtctctgtctacatgcacctccccttccttcagtacctagcccaagcttcccctccataaagccctcccataatgtccctggttggaaccagtcacctcaacctctgcacctgcatagtttatgtgtgtatatctagcaattattttctcatcttggctctaaactttgaagggcaactgttgtgtccgtctccagtgcctatcacagcattgtgcccatagccagggtgcagtgcatcttatggaatgtgaccaagggacatctcctgttttagcataaataaaagaaaccagagttctgctcttgttccaccttcattaatcaagtcctccctccagcttgttgtttaccagcaagggagagaaaagctgaactcacaagttcatgctgctgagataaagacctgaagcatatgttggcccacagggagggctcgatgccaaaagctggggagaaaactaaagtttctccaaggaaaaaataaataagggtggaaaggagagcacctccagttaaggacaggtactatgacacctgacaccaggaatgcctttgctgctaggtgcttccttaactgtgacaggacattaacacaggacctgcagctggggcaggagaaaaagagaaaaaggagcagcagagaagaaaccagcctcagtcccaggcccttctccactgcagggttccagcttagagcaacaccaagctgtgggaggggagaaactttcagtttggctgaatttcagttttattacacaggactggacattttaataactgaaatgagacttttcatatatttagaagtgaatagagaacgaagagtatgagaccaatataccttccagatgggggtgggagaatcctagacttcacaggtgtaaaatcagtaggaagaggcaaaattaagaagtttccaaaaacaaaactcaaaccttgaggacattacgctaagtgaaatcagcccattacagaaagacaagtactgcaagactccatttatatgaggtatctaaaatagctaagttcatagaatcaaaatctggaatgatggttgccaggaactatgggaagagaaaaatggggagttatttaatcaatgggcaaacagtttcagtcaagcaagatgaataagctctagatatctgctgtacaacgctgcacccacagtaaacactaatgcagcatgctcttaaaaattagttaagaatagagcttatgtttaagactttttaccataataaaatgaaataaaaaaatgaagaatctaaaaatttaaaattttaaaataaagaagtggtactgtggagtctcacctatcacatataccagttacattgacattttaaaagtcagtgctcaataatagggctcccccagagtgccttgcctgcttcacgattcacagtacaaacaaggcttccatgcttcctgacaatcacacatggaattccattttttaaatgaggaaatgaaaaataatttagaaaccataaaaagaaataaaatattttctttaaaaatagaggactcagccatgtttatgacagtcaaacaaaatgtctatttctctcctttttgccagggctcctctgattgccatccaattagctagtggtcagagtgacccattagtgagaagtcctgttagggaagccctttagctggtatgcaatatgtgctattttcactgactggactcaattggtggtggtggtggtgagtgaagtctgcattctgccacagataactaatgtgtaggtagatgtggttcctctcaataaccatgaaggccctgggttaattcctttggttgccaacacactagggttggtgaaggcagcacagaatggagagcctttacaaagctggggagaatgctctaacagaagctttttcttgtccttgaaactgctttgttgtcatttagatgaaagccaaaactatttctgatgaatattatgatgcatggttacatttagatcctatttttcaggggaattttggctactgtaactgaatttaacatatgttgatagagctctttcatgccctgggcactgatgaataagaccaggttgctaattcccctgagaaagttacagtctacgtagaacgcagtggtgtcaatggactgacaccatacagcatgtgcaatggacatctgtgtggttcacctgccaggcagctcttcttcttgttgtaggagagcatcacactttagctttaagaaatgacacctctctgtggctttgaccatatgtttcaagtggagctcaccccagctttctctccccagctccagaaatgggcatatgtcccatgcatggctaaagtgaatagcaccttccccaggccacagtgattgcttgagtgatgaactgtcacttcttgtacagtgggggccaagccttggacttctgcggacacaattggaagcgaagcacatcctttccactaaaggtgctgtattgggttgaactatatcaccccagaagatatgtccacctggagcctcagaatgtgactttatctggaataaggtgtttgcaaacataactgcagtagggaattcgagatgagatcatcttagaatagagtgagccctaaatccaatgacaagtgtccttataagagacagaaaaggagaaaataacaaatacacagagagaaaggtgatgtgacaatgaagccagagactggagttatgcagctacaaggcagggatgccaagaattgttggcagccaccaaaaccgaggagagaagcatggagcagatcctccctcagagcttctgtaaggagccagccctgcctacaccttgattttggacttctggctccacaattgtgggagaacaaatttctgttgttttgagccacccagtgtgtggtgatttgttaaggcagctctgggaaatgaatacagttactaagctggcagtatgcaagcctacagctgctggtggccatcttcccaccacatgggcaaaacctaagcatatagccagcacaccagaaagcagagcccagagctggagcaagacacattcctgtagacttcattttaaaatgtggagctaaccctgcctgagaagtcagatttactcctatactgttttaagtttttgtaccctaaattgcctcataggcttacatttaagtcctgtctgagacagtaaaacaaatgctttctttactaaaggtacacacacagtgttgcaatcacagaatagagctcatctaacactacttaagggaacccaggaagccttcactaaggaagtatcattgatgctgagtcttgagtggaattttgccaggaaataattcatctgatgtcccatctctgcatcattctctgtgggattctttctggggagccacatagtcattctgcacatgcccatcccaatctaagggctccaggacacaaactgcggttggccaagatgtcttaaatgagttttgtttcaatggcatagatccccacagcatcaagtgattcccatcctccatgcctgggaccttgtgaccacttgtgccaataccaacttgcttctggccctcattcccactccagtccaagccaatcccagctcttgcctggagacacacaatagatttctaactaatcttctgcttccatcttgaccctgcaatccagtttctgcacacgtacctcaactgtaccatatctctccaaatcaaatcccttcaaaggcttttaccagatctgtaaattcccagcacctaacaagttcttggaacttcatttgggtaccaattatgtgttaaatgaatggtgaataagcaagttcatcagggcctggagtcatgactcaatagcagaagctttagaccttaggacatcttgcagtcatgactcacatctcatgttacatacctggaacattccaaaccaattgaaagaggaataatatattcatcagatttatctacttctgattttgcatccactctatttgtctgacatagcagatctctggttcttaatctaagaatggtagatctactatctggttctggttttcagattcaagtttagcaacctgggtgtcaatcctgctatcatgtacttaagctactgcttctgtttcccaactgaaacctgtccctaattctgattcccggctctccttccttcccatgtgccctccggttgcggcactggcatgccccagaacccagatcccatgtctctcaactgttgctaaacagaatgagatgctgagccctgaccctagggcagggtcccatcctctgctacagaacaatttttatgtggactgttagccacgccatctgactttctccaagctacctacttcctgatgtcctgtctccagcatgcactcacctgccatgtccatctattccttcattcaacaagcactctcagattatcttctagacagtgcagctacagtgctaatgaaagatgtctgtggtatgctttccacctctgaagaaaaagaagggaataatttaaaaagtggtaagatgtctgcatgggacctcagaaactgaccaagtgttcacagtggttcacctcttaccctcttactttgccttgacagaactttagtcaggattctctccttcctacaggtccctgaattctacttggccccaagcctgagaaagcactaaacactggaatgtggcccccttattagcttgcactgagaatcagctgaccacagcaggacaattcctgtcataccccactgatcatcctccccatcccactggccatcccccagttccactgatcatccccctgtcccactgatcattcccctcaaccatcccactgatcatcctcccatcccactggtcatccccccaccaccatccccgtctcactgatgactggtcatccccccaccaccatcccactggtcatcccccccaccaccatccccgtctcactgatgactagtcatccccccaccaccatcccactggtcatcccccccaccaccatcccactggtcatccccatcccactcatcatccaccccatcccactcgtcatccccccatcccactcgtcatgctcccctgtcccactcatcatcccccgtcccacttatgacccaccccaccatcccactgatcatcctcccatcccactgatcctctgatgacccccctgccatcccactgatcatcccctcctcccactggtcatccctcccgtcccactgatcatccctccgccgtcccactgatgactccccacccccgcggtcccactggtcatcccgccgtctggctggcgaccccccggccgtcccgccaatgacccccccgccggcccactcatcattccccgccggcccactgatgactccccctccaacccactgatcatccccgccatcccactggtcatccccccatcccactgaccatcccccatcccactgatcattccccgtcccactgatgaccccccccaccatcccactagtcatccccccgtcccactggtcatcacctcgccccactggtcatcaccccatcccactggtcattcccccgttccactggtcatccctccattgcttaatcccttttacaattttaattaagcttttgcttatctctccctaccctatataatggaagcctctttctttttgattttgtgacacttgacaatttctgaggttggagcattctctctgtggcaatggtctttcttttgaataaaatccctccttatctaagtctggatttgttttcatttgacagaatacatagaagagaaatctaacttgggtgggaagaggaggggatgaagattagagaaggcttcctggaaataaactgtgaacagaaagaaaataaaacattggctgggcacggtggcccacgcctataatcccagcacttcaggaggccaaggcaggtggatctcttgaggccaggagtttgagatgagcctgggtaacgtggtgaaatcttgtctctactaaaaaatagtaataatacaaaaagctagctgggtgtggtggtgcatgactgtaatcttagctacttgggaggctaaggcatgagaatcacttgaacccaggaagcggatattgcagtgagccaaggttgtgccactgcactacagcctgggtgacagagtgagactctgtctcagggggaaaagaaaaaagaaggaaaagaaaatgttaaccaaactaacacagaggacatgcacggattccaggctgtgaggtggcatgcgtgactctcttgccatgtggcagtatgttcaggtcctcaccaacaccaccatctctgatctgtgctccataagcctgaatggaattcttcatgccacctgcacctggcaatgctcccaaacaactgcacctggcaagctggcctagctccttcctcggtccaggcctagccttctgtgtgtgcccacaaaaacacatgcacacatgttctttcttattcaaatgtgtgacccctaccctcagcatgccacagacacctcaagtgaactctagcatctccagaacacccaaggggtcaagtagttattatgatagatgtaggccatctctaccttttcatggactctctgttcatggcatctcactctgtaggcttaggcaaaattcctgtagcctagagagatctgagactacaaggacatgaaaaatgcaaagagggtaagcttgactggaaactgcacaaggactggaagcaggtctgactcattcagcatcatatccctaccacctagaacaaggccccaacacacagtaggggctcaaatatttgttaaataaaatgtcatatcagctcacgtgaataattccatctatcgcagagtttcctctgacactatcatcaagcaacattttaaaggggaaaacagtggttgtcctccatgatatgaaacacacaaggctagcaatgcattctgaacaaccctatttcccttaatagcccgttatgcacatgccagccatgattcatgatgtaaatgtaactctagagtcgtatgaccataagtaccaatgccttggaagtgtatctgagctgctacaagagagattatttttttcctcactgctacaactgccagaaaatatgtttaaatcattacttgaaattcctttcccaaccaaatctcttcccagagctgttaacaagaaacaaaatatgctgacttgagtttcactttctttccattcctctgccttcctcttgtgggacccccaatgaatcatgaaatggttttggtcaggtaagagtgaaaaaagcacagaacaaagcccagtctgtcaaacatgcagatcctagaggacagagactctgcagcccagttctaccaacggacgtaacccctgaaataatttgcacctatttcaatcaactattcatctgctagccttctgattttattatattatgaagccatttattttcaaggaaactatatttgttgcttagttgatacatgatgaagtaaactgagaaaatacactcctaattctcaggccaactcttttaaggcctataaaaaatgacataaatagattctgatgttgcttcatttctgcagaagggtgtttttatattatgttcttctatcaacacagtaagtacagattgcatcttaaagctctcatctagtgctggagtttccaaacacaatggctttaacaaggaaatgactttggaaaggaaaataaaagaatgtgatttctttggggctgagcatgggagagaagcacacttcctgtcatgacttgggaggcatgcagagaccagctggcaaggctctgatcacagaagctaatccctcaggagaaaatgggtaatcccagggccaaaattcacccaaagaaccagaacaaatatgggcttgggtcagacagaacttcattaatcagggctcaatccggcagccatgactggggagatgccatgtaaagaggaaagcagagattgaagtgatgcttctacttgccaaggaatgccaaatatcaccagcaaaccacaagaagcaaggacagaggctggaagagattcctcctcacagcctcaagaggatccaagcctgctgacaccttgatctcaggtttctggctcccaaactgtggaggccaattctgttattcaagccacccagtttatgggactttgttacagcagccctagcaaactaatacagttggcaataggagttaggtagcaggaaaataataaataactgaaaacagggaccacacagttcatgtgaagctcctggcccttttcaagcatttgtacgggaatctctgggaaagagattcaaactatcacttgaggctaaattcctttatacttgggaattcacatttattcatttgtatgacactaaaagaacatgagaaatataaagacaacaagctagagggggtcagggccccatacaatagccaggattctgctcaatggcttcatgcatagtcaaaccttaccagctgtgtgagaataaaggcagaagaggagacccttcaacccagtcaggtaaagttgacaaggaataggtagtatgtcatggtccaaaaccaggaggccagaatacagggatgggtccatctccaaggatctgaagtgtaagtcaaatgtctggtgggacatcactgtgagtttgcagtgacagagaggggctcagggttcaccccaggacaaccatacacagggtccatcatgacaaaaccattccaaaccctggcaacttgtgggttgatgctgggtggaagctgttggccctggctaagacccaggaactgaacaaaattaaaattgctgccaagggcatgggtgatgctgggtaggggtgatcatggaaagcagggactaatagtgtcaggtaaagccacacactgattgcatgtaagagaatacatgacagtaatcatcaatagaggaagaaataagaaccgtcaaacactagatattttacacatattaaacatttctcatatattacattacaaagttggcataatattctacattcaactttttgcattctttatttccttaggaaactgtgtttctactcaagttgtctgaattaatttaactcatatgccactgtgtacttcctttgagtttggggtccatagctgtcctgctccactgtctcatgccaggtcttttcattacatgaactgcaggatgctctctctcaggcacagtgttttgggggcaatgcctctaaatgatgcctccattgaggcaaagatcacatgaatttgtaattgtttgcatctccacctcctctgaaacacagtgacctgctggaaagcaaagaccatgatttgtctctgtatcctcaaagcccagcacaagtatcacctgacacatgcactataaatgctcactgaattgattcattcttaagaagattcaaaatgaaaaaggaagcaagcagatttggtgagccatttctgactggtatttcatgaattcatgtatttaactatgggccagcactatgtcaggtaatacattagtcatgtgaagaaacaataagattgatcactgctaaggtatagagcaagtttcaggaatgcaagaatgggctgcccttaattgagcacttagcctctctgctgccttttgctcattgagcaaattggatatatattcaggccagtaagaacactcataggctacctgctggtgtagatgggctccttacaagatacaaattgaggctgggtgtggtggttcatgcctgcaatgccagcactttgggaggccaaggcagatgaatcacttgaggtcaggagttcaagaccagtctggccaacatggtgaaaccctatctctactaaaaatacaaaaaccagccaggcatgggagcatgcacctgtaattccagctactcgggagactgaggtaggagaatcgcttgaacccaggaggcagagggtgcaatgagccaagatcatgccactgcacttcagcctgagtgacagagtgagactgggtctaaaaaaaaaaaaaaatacaaattgaccattgttgaacactagccatgagccacacattgttatgtatgatctcacccaattcttatacaattgttatccccactctacacatgaataaattggggcacaacatgattaagtaagttacccagatccctttgctacaatatgacaaatctggaacataaacccagccagtgagaagttcttaaccactccccagtgctgcctaagagattagggttggatgaacctacagattataggttttggtatttgctagcaataaaaacttgaactctaagtgacttaacattacagtaacccccgaaggttcccatgcgttatcaaagataatgcataaggcatggttggaagcagctctgccctttggttcccagaggctgagcaaaccttacccccagactcacattactaacacaactaggaatctggtgacaatggtcattcaacagaaattcatgaagagcctgttacatgccaggtactatactggatattgggggatctttccactaagaaaaaacacatgctgatagaaaagattgacagagaaatcagcactacaatcagagtggcaagtggtaccacagagttaagcgcagggaccctggaagcacattgctaaggatgaggcaagataccccaaacttgtcctcaaatctcaacccttttaaagtggcaactgaatggtcacattcaagtagaagcaactgttaggtgacatggcaaataatattcaataaccaaggatgacaaaaacaggacagggtagaatacttagcccagaagtgggtggatggcattgagaactggaaaagagaggggaggtggtcaggagtcattcgaaagcttcctctctggtcttccatgtagaatcttagccacatatagttaagattgaaggtaattaacaaatcaagcaaaaaccctctgctatttcaaatatcctgcacaccaggcaacatacctaccatctttatgataatatacagctttgttatgccttttgggggaaaatctgtattatccccattcctttcactagtaatacctgatattaagtagcacttttgagtttataaagaacattcacaagaattatatcattgaattattactgagcagacagggcatccattttacagacaaggaaattaattctcagagaagcttgttaacaaaatctcataattgaaaaagagggatttaaagaagtgcttttgactccaaggttggttctactgcatcaaactgccattgtttactaaaaacttaactacagcattagaatcataggttttaaagcacttatttgaatgctgtttgctgtttcatattaacagcagctgttgctacttggcagttactaagccctaaatattaggaatggctggggtgaagaacagctttgaaatgacactatatttgatcagcttctgcaataactgttaaaatcatatgcatgtcctttggatccctataaagcttctacagtatcactgtacctgcagttccaatttgcaatttcctcagccctcctttgaagttattcttgccaattacctggtgttaatattaattaaatatgatttgtaactcaaaatgtggtgttatcaatggaactcagctgtacaaatataaagtaaaattttcaattgaattaaattgtttcctttcattcatagtattttacaacattaatacttttctcaaattgacttttgcctgctggaagtcattttcccaaagcaatgaacatctgaggggaaacactgctgtttatgtattctttcctttctgtcattgaaaatacttcgttttaatcttaaagtgaatccatttcagttaccagaaacttgcttcttgtttataacccaagaggggaaaatgctttattttaaaactgtactaagatacattaaaaatatgatcagtgaacacgtttcaattgtacactagggatgaaactttccttaccttattgcttgaccctcacaaaaaaaaaactatcaaactttttggcaactgtcattttatatacacaaaaaatgaattaattaaattggtttcttacattaacatttcaaacagaatctgccatcccaacaactctctggtcccttccaactctaagatgttaatattcggaacatgtcaaacaatagtcagaagcttccagcatttgcaaatttagggggagaaagacacacatagaatatttgacagaatcaggtctattctgccccctgtaatgtatgcaatgatgacttgaaggcctgtcatcttcaataagccattcataaacatgatgactgattaaagaaggtgtgctgccatactgtgcaaatctacaatgaaaagatatgttctctcatattccttttatcttcaaagataaagctttagcttccttgccccttataatgatagcagtagcattaacatttattatcctgtcttcttttaaaaataatataataatgtaagacaaagaagggaaggaacctgtctaaagactaaaggaagtcatttattgagtcatgagccaccaggcccagagcttatgatggaaaagcatgagtgaatattattaactcctttattataatgtcaatgaaacattatatcaaggaattaaaacaagacagaaatagaggactgtggatctaatagctgagtgttgtgtaacacgtaggtcttaaccagcagcaactaagctattcccttccctcaggccaaaagaccaaaaggggaaataaaaataaattaggccagaaaaaaatctctggatgtctgtcatattccaggtgtcatcaaagagaagcttcttggaattacaaagtggggcaggtgaacagcaggtacacacctatgttggcagtgtctattgtgatcctactgggagctctacctaggaaagccagacagacactgggatcccatcacttaccccagtctggaaccctgaattatccattaggttacctcatttacccaagaatcaggattgggagagtagaattccataacattccaaaaggaatttgtgaactcgctatattacaggcttctccattaaccaaattctgtctgcttaagcccttctcattcttattactaacctgttgtcctcctagcccaaatcccatccctaccactggaagctaaccttctgagtatacccttcttcaccctctgttaagaactgaattatctcccaagaaaaatacattgaaatcctaaacccagtacctcagaatgtgaccttatttggaaagagggtcattgcaaatgtagttagttaagatgaggtcatactggggtagagtgggcctttattccaatatatcttcatttttataagaagagaagacacagagataaacacaagaagatggtcatgtgatggtagaggcagagactggagtgatgcatctacaagccaaggaataccagggattgtcagcaaacaccagaagctaatagaggcaaggagggattctctcctacaaatttcagaagcaaccaccttaattttttatttctagtctccagaactgtgagatgataaatttctattattttaagccactagtatactatattttactataaaatgcctcctttcaaggacctctcttcatgtaggaaccctagccctaaccccaaccctactgtgcacgttcagctatgcattctggcaaaagttcctgttttcttatgaaacactgctcatcatccttaaatttttttctgaggatctccttttatcatctcccataattgaagtcttcttcaaaggagactgagagccctcccatgaccataaacccatgaaaagagaacactctaccatactgttacctcccattgcaatgtctaggccattattcccacactgtattcatctgttctcacaatgctaacaaagatatacccaagactgagtaatttgtaaaggaaacaggtttaactgattcacagttccacatggctgggggtggcctcaaatcatagtggaaggcaaatgagggacaaagtcacgtcttacatggtggcaggcaagaatgcttgtgcaggggaactcccatttattaaaccatcagacctcatgagtcttattcattaccatgagaacagtatgagggaaaccactcccatgattcaatgatctccaccttgccctacacttgacacacggggattattataatttaaggtgaggtttgagtggggacacagaaaaaccatatcacatacctttatatgaaagcttctccccatgagtccatcctcattcccctatacttctcaccttagcaaccacctttccatactcaaccatcaattgtatgagaatgagctttgatctatatctcagttcctgcttggctctagatcaatgttccttgctattcttctccacaaagctatgtactggtacctaaagtttactgtgttcattttactgtctcttttctgtttatggtacctgccttttcctagttgcccaggtatgcaatttcaagttcaactttaatttctttcataccctcaagctctgtgtcccgttactaaattccatagacttcacctcacaaatgacccccaagtctatctcctcttccatttatattatcactgccctatatcaggccaagattgttattgcaatggacgctgaactggtctccttgtcttctacttcttatagtacaaccttaaatatacattctgatagatccccctctcctcagcagtttcctcctgatataatatgagtatttgtccctgccaaaatctcatgtgcaattgtaatccccaatgctgaaggtggggcctggtgagaggtattgggtcatgggggcaaagccctcatggcttggtgctatcttcaggatggtgagttcccacaagatctggttgcttaaatatgtgttgcatctcccccattcccaactctctcttgctcttgctttcactatgtggtgtgcttgctcctgctttaccttctgtgatgattgtaagcctcaaaaggcctccccaggagcagatgttgctatgcttcctgtacagcctgcagaaccataagccaattaaacctcttttctcataaattacccagtcttgggtatttctttatagaaatgcaagaacagcctaacacagaagattggtgctgaggggtggggcattgctataaagatacctgaaaatgtggaagtgactttggaactgggtaacaggcagaggctagaagagtttggagggctcagaagaagacaggaagatgagggaaactttgtaccttcttagagaccagttaaatgcttttcaccaaaatgttaatagtgatatggacagtgaaatcctggctgctgaggtctcagatggaaatgagggacttactggaatctggagcaaaggttacctgtgttatgccttagcaaataacttggatgcactatgtccatgccttaggactctgtggaagtttgaacttgaaagtaatgacctagggtatacagcagaagaaatttctatgcagcaaagcattcaaaatgtggcctggctgcttttaataacctatatcagatgtgggagcaaaggaatgacttaaagctgcaacttatatttaaaagggaagcagggtataaaagtttggaaaatttatatcctagccatggggcagagaaagaaaaagctttttcaggagaagaatttaagcaggctgtggagcaaccacttgctagagatatttgcataactaaaaagagccaagtcctaatatctaagacaatgggggaaagtcctccatggcatttcaaagacctccatagctgtccctcctatcacagccataggagggaagagtcctttcatgggccaggtccagggccccactgccctgtgcagcctcaggacactgttacccacatcccagccactctagctctagccttggctcagagggccccagatattgctcatgccactgctctggagagtatgagctactataagccttgacagcctccatatggcattaagcctgcaagtgcacagagtgaaagagtgatgaggcttggcaccctctccctacatttcagaggatgtatggaaaagcctgggcacccaggaagaagcctgctgatggggcagagccatcacagaaaacctctacaagggcagtgtcagggggaaatgtggggttggagcccccacacagagtccccagtgggggcactgccaaatggagctgttagaaagaggccaccatcctccagactccagaatagtagatccaccagcagcttgaacccaggttgaagtgcattggtggaatctcggctcactgcaacctccacctcccaggttcaagcaattctcctgcctcagcctcccaagtagctgggacagcaggcacatgccaccatgcccagctaatttttgcatttttagtagaaactgggtttcaccatgttggccaggctggtctcaaactccacctcagccccccaaagtgctgggattacaggcatgagccatcacaccaagtctggacttttgagttaatgctacaatgagttaacatttggggagactattgcaatggaaaaggacatgagatttgagaggagccaaggtggaatgatatagtttggatatttatccccacccaaatctcatgtcgaaatgtcatccccagtgatggaggcagggcctggtggaaggtgtttgggtcatgggggcagatctctcattgcttggtgctgtcttcaagatagtgagttctcacaaaatctgttcatttaaaagtgtgttgcacctcctccccttgctcctgcttcaccttctgccatgattgtaggcctcctgaggcctccccagtagtggatgccactttgcttcctgtacagcccatagaaccatgagccaataaataaacctcttttctcataaattactcactttcagggatttctttatagcaaagcaggaatggtctaacacacctccattgtctagaaaactaaggataaaataaacaccctatgatttgaaataatcatgtgtctatgtcaaaccttccaattttgtctcccataattcactaaacaaactatgctccagtcagaaaaactgtgctatttgctgataccaaatatgtttttttccttctccagcaataatcctatagtcaagagatgccttgggatgacactataacagctgggatatcaaggggctatttgtctttaccaagtgtctcctggccctctcccactcagaaagatctcaactagggaagagccatcactgaggtctgatcaatgaccaccatacactcataaacttcattctcccagattcgcaaaggacactttcccaagtctgatttttttaaaatgaaaaacattctaatcaaactgtacaagcaatttatcactaacccaattttcatttcaccatcattccattatgatctgcttgagttaatcagaggtaagacagaggaagcctcaatttacactgaaacttcttagcaatcgatgttgctaaagagaaattcagaacaaagtacagaaaacattatgagttggggaaatatacaattttattaatgggcagacactccaaaaaaattgaatgtatacatctctttctcactcaagctactgaggtttttttttaaaaacacactactaacatggtgacagatgtcatcaatgttgtagtaagagctgcaaatgttacagaactaatgaattttcattagagacatcagataatttcagaatgggttaagttgctaccatttgccattcccattaacatcattgtcatgtaaaaggtttaattttcagctatttttgttctagataaaatctttgtcattaaaatgagggatgattttgatatttaatatattccatggcatactccagtgtggtactaatttggccttttcagtattctgcatattaattaacaatccatccctcctccattccccagataagtgagaactgaaatagaatggacaaccaatcaagtcacagaatactgaaaagatcaacacagaagaaatgtgttgctctaatcaagagcatatacaaggcaccaaaattattttctcccatgctaatgactatgatagaaacaggagtaatgaatggcaccatctaaatccttttatgtgacagtattaccaaagcacagcaatgctccctaaaaaataaaaactaagtatttcttattttagtcaaaagaataaaactgtggtttcacttaacttttagaacaatccattttgttggattctgcaacaaatggcagattatgtcctgttttgaattttttatagtaatctatctcatgcacacaaaatgtgtcctcaagttgcagaatgtccaggatcactgtggaaaacttatttcaatacatactctattagttttctcctcttgctaaattatcactctggtaagaactgacatcagctgcttaaataatacattaaccctgtttccagaagctattgttttcatttgagtgggcatttcctctaaggataaactttagatttttacccaagaagataatataatttgtcataatttaaagaccaattgaatgttttgaatcagttttatagcagtaatgatataaattcccagagagcaaagattatggcataatgcacacttacagcaggtgtgaacagttgtccaattaaatcaattagcccaatctgtccaacaagaccaggcctttcatacattttctgcaatagcacaaatgtagaacaaatgttaaagatactaaatattgtgtattataatttttctatgtcctactatgtacagaaaagcttgcagtcatctgcaagtctctcaagtgaacatcctacttcaataacatcagactttttgtccttggtaattatggttaagcccaaatcattcccatgatctttctctgagtcgaggcctctaagaaaaacaataaatttatcaacataatgtcttccttcaggctcaaaattactgaaaaaaatcaatggacactttaatttttccacaaaatattactcttatagaaaaattcattcattcttaataagaataatagtacttaagtaacaacaacatacttaattcacaaagatatgttgttgacaaatcagcagttaagatttgtgctctaagttgttcctttgttttgctctgtgttttcaaagtagtggaatggatttacaacctcatcgtacacatacaagatggtaaaatgcctagacacttggataagcaccttgaaaaaaatgcccaggacagacatcagcagcaccttgttgtaaacaagtttttacatcttgtccttcatcacaccctaagcttcagagttttaagaataaaaacgcaaaaagtcaaatatgacaataagaatattgcttaagtatagccttgagggctacttcagcattgttttaagatgattactagacttagtccctctagtgttggatgttaaattccactgactttttttaaatttaatgacttgctaatgtaaacttccatctagaacaatcaaatagtatgtcatttattcaaatttacagtggctctaatgtgccagcaaactcccttgtcaaaacagacaactttaaaaaatgttcatttgagtcaggagtcctacttcctaaattagcaccaaagtgtcaccttgatagacctatgaacaacaaaatcatttataataaacccagcttccctctagagtggacagcctagttcatgcatctgtaggagttccaattattccctacagataagagagcacttggagatgctcaggcatcagcaatctgtcacctccaaatacaatcatctgataaatatatgcttaccaatctccctcgagatctgggtgaaggcctccacaccgctctcaccatagttcccctcagaagccagtgtcgaaacataattccatcccagtgctgtcacgatgtccaccatggcttgggcttggtaggagtcaggcggaaccactcgagagaaaaagtcatacctggtgttatcacttagctctggggctgtggatgcatagctgatttgaggtatctgcaaaacaaatgatgggtcatttcaacccatgacgaatcttgaagaatgatggattgtcatatgagctaaacagccaaggctataccagaaacctagacatatcaacctgaagccaaaatacagttttatgactaccaatttaattggaaagtatttttgaatggcccataggcttactttctctcaatgcacaatatttctaaacagtgagaaagaatttcattttgctttagtttccattgtttctggagccaaagcaaaacatttgtgctttttgttgatgttgctttttgttgatgttgcttttttagtctgtacatgataagctctggtgcagaaaggagagaaaaatgaaggcatatacatcagaaaaggtcacctctgaaactggctttggctttataggacataaatgctatacaatgactaacagggaatttaatataagatttttttatacttgataccatttcagtcttaagactatatttttagtaaattattgtaaatatatagttttgcaagtctattgactgtttattgatataatcagagtgccacaaaaagatttgagaattgccagcagccacatatcctctcatagaaacatcattctaacccccttcaaaacatcacagaaaagggaatccagaccataaattctttagaagagactatttttcttttaatggggtgaattgccagaaattctttgaaatgaggaatcctatgtcatttctcaataatgtgggagagtgagctatgtgattgtgtatagtaactcctctgctgccatgctgtggtatgagtgaaagttcagagatcaaagtgactccaagatgccctaattcaggtaacttgaagatgcaggtttgacttgtacatgaaaaaattaactttatgctacatcacatgttgcagctaatgtcagtgctcaaagaggatgtcggagttgcagttccatctttccccacagggctgcacactctgggatccaatagtccccactacagtgtagacagatgattcccaatctatataaacatttcaactccacccttgacatacttgtaaagctctcaacatctaaataaccttcctaagtctagagagtcctgttccctactagtggccagtgaaatgacagtgaagttcctaaaacgtaaaagtcatcccgggagcagcagcagagcaatgtgcttggagctgtccatggtgctgactattcattcagcttccatgtaacttggatccacctgcattggccgtaacagagagtacccagaatagcgtggcccatttaaccccaaattctttctggttctgttctcctagtggggactgtgttaacttatttgttaacactgtgggaccatgaaaaccatctgacccacctcctcctgccctttgccttctctgccagatatactgaccttaccttgacaaatttttcccctggttagattttgtgactgcatagtacatgactactcgcaaggacacccctccaaatctcaaaccacacaccaaatcttgccctttctcaccttttcttgtttgttttcagaggacctgggaaggaaaccatggataacttagtgagatctacctcttactaggtaaaaatttcccaaatatcaaaagtatgtgcattcctatatcctaacgaaaataagtcagccatctgactttcactttagaagaaattatatgtatgtgcgagtaggggttgtgtggggggaagggaataggggagcattctatagcaaaatatatagccctacaccatttctttgtcctatttggataccgatactcccacttcctgagctactaagagtccagcagtaaaatgacttacacaactcccaccctgcctataataatgagccaccctttctaaaaatgagcagaaagtgtgaaaattgagtgtttgaaaccaaaactaattatctcaaattactaccttcagtcagtcacttccaggctgtttaattagcagtcagcctcatgtttaggattaattaaacaggtgtaaagggtatataaaataaaagtgcagatagaagatggttgtttgattaattcagtaatggactttctccccaaagtcttgaagagttttctctttgcagatcaatgtgtgggaaagcaatgcaagagtatgcatttgtatttttattttttcactctacaataatacacatcagggtatatgaatagtatttcaagacaagttttcaagttttcatgaagtcacatctcatttttattttattgtggtagacccctaagcattggttcattaagcattttaatttctgtcccagcatccccagtatttctaccacccgcaaattaaaccctactggcaactgaagtaaaaattttttaaagacctggaatgttccttttattttccctacatcaaattcactgcaactacccacttaaccttggaggtttcatctaccagaaacacagcaatggaaaaaaaggtggtgaatggtgaagagaagcggaggaaaaaaatgaaaggaaaaagaagaaaagcatcccaagaaaagaagttgctaggaaaagcacccattatcagttcccccatcctttaaaaaaaaaagtagtgtcttttataagcctctgttaactcccatggccaatgtaaaggataaaatacaaactcttcggtctggttcacaaagatcatcagattctgtctcatcttcctcccctgacctgtaccttctctccatattctcacagcatctgcacccttctccataccagggagatttaatgctctcctctatctaatgatcctctatacaaattcaatatccagctcaaaagtcacctccatctggggacagttcactaactccatcaggcagagctgtcttttgctattcctgtcttccaaagcctccgccatctaacattagaatcatgactctgctggcttatgatcctctcaagaccaagcagggtctctgtttctttatttggcatccccaacaccaggcagaccaagtgctcaatgaatgtttgagggcaattaattaattaaactgctgcaggaaatttaatacagcttcttccccaccacctcctcccttgcattccaccaaaatattgtgcaggctattctccattcgaccctcctgatccttccctatcctgccaaagaccctaggaggctgctctctatgaccatactgcctgggcttccttgcctctggcttctagttgagtttgtcccggaggcactagcagaacatgggagggcgaggggcgacagaaagaagttagagtatttatcccacagtttctttttccactggctctgtttctccacctaacccctcacccacagctaaagcttttgccagattccagtgaccactctgtaccattgcccctgtaaggtctccccactgctgttggctccgaagcacttcatcatcccttgttttttctaactgtgcccacacttacaaataatctttttgtgaactgccctttcattacccctgggtgtgccagaagcctgatgaacactcccctatgacaagtctctgtagaagacaacactgctgtggctccccaatctcagccctgccctaacttcttagcccttctctagccacctgcccttccagccttctctaccactgtccctaggtgactttctcatttcctttcttcttcatttccctaaggcatcctactgcatatttgaaaacacctgtcattttgctttccttcatttcttattttctttgtgctgagacttcataaaaatatcatatgtgcttaaataaggccatatttctattactcaaatgaagcgtatttgagtcaattaattatacaactcaggacactcatcatcctctttttttaaaaaaaaattgttttggattccacttttctaacaattattttggttaggaaaaacgctttttcttctctcactatattctcacttcagcccacagaagaggagattcctacctcccaactccattctctttgggagctccagaacaaacatttcctctctcactctccgttcctttactgactttccccaacatggagggggaaagaaatcaaagccagagttctacgtttattgggcaaaaggggatagcaggctctctctttattctctgacctgtccacatacatctcaggcttcttttctctataatgtcatgagaccatgctgggcctcaattcttggaaaggaagcccaccctcttctctccatattccactggcaaccagacatttgagaaatacttgaagtccatgctactcactgcaagtgaactttaagtcttccgtgcaggcagaagtgggtcccaaggttgagatatggtgcaagagtaggaggcacaggttcaagctgaattatctcgaacgcagttcttagcagatagtcatgtgcctggggagttatttggtgcttgcccagatgttaataaagctaattacttaatctacatttaactagctattctgtgaatattggacttgcaaactctgagaaattccaaaaatttaacttagagctcaagattaaaattatatttcaaaagaaattcatttacatatattattaataggagttagcagagattattgtcttctagtgtctgttctccttctagatgaaacctccagtttttacctaaccacccagaacgtgactacatttcctggccttccttgaaatggtaagtgaagcttctgaaaaggatccttaaagggagaaggcatgcctttttcatgatcctccctctttcttgctggctagaatttggacataatgcctggaactccattagccatcttaggctatgacctagcaatggtggagcaaaaagccacaccctagtccaagccactgtgatatctggattcctaaagccacttgacttttcttcatgcttccattcatgctcttctcaaatctatgccacaccagcaagaaaactggtattttacaaaaacagatcttaaaggctgggtgcggtgtctcacgcctgtaatcccagcagtttgggaggctgaggtgggcagatcacctgaggtcaggagttcgagaccagcctggtcaacacggtgaagccccatcactactaaaaataccaaaacttagccaggcatagtggtgggcacctgtaatcccagctactcaggaggctgagacaagagaatcacttgaacccgagaggcagaggttgcagggagccgaaatcacaccattgcaatcctgggcaccaagagcaaaactctgtctcaaaaaaaaaaaacacaaaatagatcttagaaaaatcttgtttagagtccttcaatcatttccccattgcccttagaatatagcccagacctcctgtcacaggatcctttgaactggcaactgaccacctatccctctcactcacctgatccaactacactggcttcctttttgtttcacctgcagcactcatacatatcaccacaaacattttcccaagtaagtccttcctggcctttctcatccttcagcctcagctcaacagaccttccctgaccaccccatctagtgttgtctcctcaccttccattatgacctcatcactctacttatttccttcctctttcaccacctgcattaatttgtgtattctgtttcccctactaacatgtagattccacagggttattttctgcattgttcacagatgtaacatgagctcccatgagatagtaggtgttcaataaatattcattgaaagtaaaatgagcccatccatccattaatcaagaaccccttttgttattttcttccatgtatcctaactttgaaatatttttctataaaactatttaagttaaaacaccacccatttccaatattctcttttaatcaaagatctgttcagctgcaaaacttctgatcagcacaaggcatctgtttttaccaagctgaagtgatggaattccagttcaaatcaccgaagtgccgcttcagttgtagcctgtgcagtcttctcgtagggaagcttacaactgccactttgctttttgaaatgccaaaaatggccatgaaaacttcataactaccttggcaaacaccttgacagcccacggacttcaatgtgtcattaaagaataaaaattacatttctaatcaaaggtcaacatcatagattatttaatcatttaccccttctttcttatctttatctgtaagatagatattccagacagggaaaaaagtgcttacatctcccccaaaccaactgtgtctctccatgttgccttcactgagccttcctgtacatgactgagtgatgaaataaagggtctctgaggctccaaggggatcagagacttttagataccagaaatactttttgtggcccaaggaagaacaacttcagctgcctcaaggtttcccactgcttgcacatcaaaacattgcaataagcttgaaacttgccttgtctattcagaatgccataagtttttcatctgttcaccacagttactggtttgctaaatatcccaaggaagccaagacacccctgacaaggctagcaaaaagccacctaaagcacagcttagaggaagctcctccaaattctaggaaatttcaatctttctgcaagaaacttgcatacatctgagtacagatttgcagacagaagacaatttaagacctgaatcacgtatattttcaccatgaaaaagggtttttttttgtttttttcccccctgccaaaaaaggtttttgttctctgcaaacaaccttgtccattgatcatggaacttaattggtgaagtaggttggcggggtgggttctttgtgctactcaataacatcattggttttttccagtgaaagatcagcttgaagccacattcttcccttagggggtagtgcttgaccaagcacttttccagtgatggtggttagcaacagcggccatcaggatgatagcttcctaccacctggccttggggtagatttgtttttgctgcaaaactcaggtcaaaaaaaagcataattattatagccattaactttgtctttttatatacttgactgctctctagtattaaaactactagttgcttgtggcaaaacatcagtatataatcagaaattagatataaatgaggagttagggctagaagtcaatgtccagcactggcccaactctcccgacactgccctgagctttcatgctcctcccaccttcatgaaaacaggctaaggagagggaaaagaagaaaggaaatgtaaagccagagtgtgaaacaaaaaagaagatggatgactaccccaagtttgcatccaaaaacatgaagtagtagtattccttccccaaatcaggactggctcagaataatcctgtcctcatagtcgacagttattaagattcctgtttgtacaagttggtgtcaaataggaaattcagtctctgaccttttcttctcagttgagttcccatagttgattcagagcaggatgtgagcctttgggttttgatgcacaatggagtttaacaaaagcaaaggagaggaagcctattgaaatggggaaatcatggggtcaaggagagccaggagtacactatattgcaccatatttttatctatctccccaacatgagctcagtaagaccaagcaaagctttacatacacacctgcacaaaaggggcctgtggttagttaacacagctgagtgtaacacagttagtaggtttaaggtcatgagttgaattccattatgggccaggatgaagaccacacccctcaccagaatcttcctctcacaaacacagagcacataacaaagtcaaccagagagaggagagacaagatcaatccattctcactgctagatgaataattcaaagatggtttgctactaatggtgaacctaaaattttagcagcaaatcatgagacacactttcttcaaaacatagtgtttttgtatctatatctgcctgaaagtataaatatatattacacttacaaagtcatatgttgatttcagataattcatttgaatagaccattgaattgtaaaagggtacattttctcacctccttttcatgggtattgtatgagtcatagagggaaagaaaacaaatgactcaaggagactaaataaagggactattttcaaggcaggagcagcatatagagaaggcagtggaaagccacaacctagaaggagtcagaggtcgaggttggcagttgttacccatgagccctaagagagagagcagttacagagtcatgaacggaagccaccttgaggggtgcagtaatctctctaaaaggacacagccagcccctggcaacctcaaaaggaaattgcattctgacctctccctcatacacacctcctgctgggtctccctctgaccaaatctattggaagccagagagcaagagaacttgactttgcctgcacaaaggaaccttccacggcagccagcagacagcaaaagaaagtggttgtggcaggccaagcagaagctatctagcccaggcaccattaatcattgctcactggacatgtgaactaaatgtatggagagctgtgcagattttcagttttctacattatattactctttcataatttgatgctttcaaatatttttgacagaaaatctacactaagacattttgatttggctactgaaaatcccaatcctaagattagactaatgaagtctggatttcttatggaaaataaaataactaatatcatgttttagaaagaaatgtaatgattttaatcaaattggtaatggcattttgacttctaacctgtttacttaaaataaaagagaagcaatctatgaacatgaaataatttacatataagcaaccataattttaccccataagattaataaaccttttttttttacatctgctaattacattttacaataagaaagcacaacagctccttaggaaaagaattgttctaatccatcaagtcactagtagtgtggggatttttaagcctaactaccctaaaagttttactagcaagttggatttaaaaccttcactttcaaagaaagggactttaggctgggcccagtggctttcatctgtaatcacagccttttgagaggctgaggctgtaggatcccttaaggccaggagtttgagaccatcctgggcaacacagtgagacctccatctctataaaacattaaaaaatttgccaggcatggtggtgcacctgtagccccagctacttggcaggccgaggctgcaagatcacttgagcccaggaattctaggtgacaatgagctataattgcaccactgtattccagcctgggtgacagagaaagacactgccactcaaaaaattaaaaagaggactttaatattccaactaattttatagtttctctagtttatagcatctccttatcttcaattttgcctttttaaaaaattgaacagttttatttaaatttccatatatttcagtactctgtgattctaaaaaattataatcagtgcatatgcaaaattacacagaaatttagaaggctaaaccaatacatacacttcttctaatagttaaatgttctttaatggttacttttttattaattcattcaacaaattagctcccactacatgccagacacggtgacaggccctggagacaggactgtaaacaacacatggtcctcccagccccatggaacatatgaccaaatggaaaaagcaggcattcaataaataatcaaccaaataaacatttaacggcaattgtaatggttgttgtgaaagctatgaacctgccgctaagagttacagggccactcacctggtccgcaagggacagggcaagcttccctgatgaagtgacattaagttgacacattgaaaaatgaagaagaaaaaggaatgaacactgaacaccagccacagattgcctctcacttgagatctccttcagatgtgtatactacccaatttgcagaaatgaagaggacaggcagtctactgacaggtacttaattttagaaaacttgccacaggctgaaaaatattaaaccatagaccaccgtctcccatgcatattacaaataatgttttcaaatactatatgcaaaactggggttcttatgccaggactatcaagaaaatgctacgtaatttatcagcagggacttgcattacattctcacagatctctgagtcctgaggcttgtaagggtaaggcatgaataaatgaatggatagatgaaaggtaaacagatgaatgaaaactgaagacactaagaagcaactttaagtcaagagtccagaaaaaaaataaatgtatacttatattacttataagctctaatatttgtttccttccttaggaaagtaaaaaataagtgattgaaaagtaggaggaaactctcttctttgtactcaggcagtgaaggctttgggataggacttcaagctatatgagaagcaggttagaactaattctaaaagaacctggctttgctttgctttgctttggtttgtttctttacaaggtaatatatattttctgcacctctcaagaggaggaaagagaaatacatgcatctgtccacccctggaaactctgctcaatgaggcagcatcccagggagacatggagaactgcattccctgatttcattctttctgtttctgccagtttctttgatatcttcttggaaaagttttcaagcagtttgggatttcaagatgaaatctctgattattcttcaaaagaaaaattaggggaagttttgaaatgagctgcttaagacagtgaaagttttctataaagtgattttcttacatgagtacaaaaaataataaattacattgtgttataatagaaaaaccaaaacgatgccatggcactttattagcatcatttgctaagttacttaaaaatttaactctcccacccactcattcccatcactgctgacttcaaactatcacctagcatttaattttcctcttctgctgatttccttactgtgcaatcactgctgtggttcaatttttcccccaagcatgtcagcactagaacattataaaataaaaagtcagtaattataactaacaaattgaagtcaataaactttaagctggcaaatattcgatttagactggcattctgccagccaatagtacatgatttgactcctgcaaataaagaagaatgttgataaggacgtttatgcaagtaagtttcctggctggcaatttcatggatttttagtgattatccgcattcacaaaatcttagtcttcaagtcattatttatctcccagctagcattcaggtactgattctgaacacctaatagcactggaaattctcatttactttctgttacctaagttagtaaacttagtagattagaagaaggtacgcatgaggttaaacgtcttcattcgagctccatttacacagggggaaaacccactccatttgcaaagaccaaaaagctgatttcataaatggacatcattggtaacaggaaaagttgataaaaggatgtaaatgactcagagtcctttattccactacatactacagaatgcaaggatatgttcctctgagaaggcatcatctcagtatccaaagggcaatacattaagtttcccctaaacaaattgattagccctttcatcctatgaacatttttgggaagcctagcttactgctctctataagccttctttatgtgtcgtattccataatgtgtgcgtatgtgtgtgtgcgtacacatgtgtacatgttcattttgccaacatttatttaacatgttatattggccaagaactgtgcttagtgctctagcttcatttcatgaatgactaaaccataatctggagaagtaacttgcccaagaccaagtaatttgtaaatgacagaataagattcaaatccaggtagtctgaccccggattcatttcttaaactcctctactctccgctactttgggtccatttttaaatctgatattaattcttcagtagctttttttcccacaggtgttcagcttcctccccgtttccacctctgttcacatctacaactcctttatggttgtaagtcatggcttggctggagcttggacatcaccagccattgccatatatggtatcacagtgaataggagatactagcatctaagatcagctaaatattatctgcctccattggttttcatcaatcccaattgctactgttccttctggggaggggggcctcctggcccagttgggtaccaacaaaatggtctgagacaagtttggggcaggttggacagcaatcacataggtcaacaggggaaggtaagtgcaaaaagggctagccaagttcccaagttcagagagagcacatctaaatacaacaggcgatggggagcagaggcaagaaccaagaaatggggccaggcgtggtggctcacacctgtaatcccagcactttgggaggccgagttgggattgcttgaggtcaggagttcaagaccaacctggccaacatggtgaaaccccatctctactaaaaatacaaaaattagccaggcatggtggtgtgtgactgtagtcctagctactcaagaggctgaggtatgagaatcacttgaacccgggagacagagtttgcagtgagccaagattgtgccattgcactccagcctgggtgacagagcgagatcctgtctctctctctctctctctcacacacacacacacatgcacacacacacacatacacaagaaagaaagaaaaaagaaaagaaaaggtagaagatgactgaaaggtgttccaggcataggggacagcatctgacagaaacaaacctatgaaaggctatagattgcttaggaaaagctaacaattcagtagtcttggtgaaaggtgttcatgagcccagttcagtctgctttctgtttgtttgttctcgtttttcatttcaacaagtatttgttaagcacttacgatatgtcaacactctcttacttggcctaaatgagaactcactctccaattttcctcttaaatctctatctcctttgttggctattcttcccttgtttcatcctttaagtgttagcattccttaggatgtggcctagactcttttgtgttcacttcatacccactccaaacctataaatgcagtctaaatctctccagtgagttccagacccatgtcttacttatttgacctctctcttaagtgtccaacaggtatctcaaaatgacatgcccaaaacttgtcacgcacaccaatcccagcataaactgaagatcatctggtgcaccaggggtcctcaagtcatagctggccaattggctgggttccagaattatgtgagtgccacacactttccaattatgaagtttccaactatgcagctatcatctatgcatggctttggtctgccttgtttagccctcccttttttatacctctcagtggccagttggccaccagaaatgaagactctttaaaaattaaatttaaggtccaaatttcctctagaggaaaacaaatgcttatatgttttggtataaaagatatgttcatgttgcaaaagataaattcaacagtattgactacagtaactgtggtactaagttttctctacaatcttgctactcagtgctatcagcaaacccacagcatcagcatcacctgggagcttcttagaaatgtagaatttcaggccccaccccagacctactgaatgagactttgaattttaacaagatctccaggtgattcgtgttcacaataaaattggaaaagctctgctatagtatgaaacattgaatgtgtactcaagagccctgtttccttttgaaatttttccatatcatgctcaaagggatttaaacacattcattgcaaagattatttttgtagctctggatgttgtcatcatgaggagatataaaagctccctctaattcactttatgaagaagttgatgccttgaacattatgttcacttatcctaggatgaacatctcctgatcattagaaatttcttttcaaaaatattctgcatccaaatttctgtttttaagagtattatgtttcagttcttgcatcaaatgctagcatggagtttatttttagtgtcatgataaatctatagaccagtgaatatatcatatcaagagttgagtcagtaaaagctttttaaatatatttcttacttatttgaaaataacagatgagtttttgaaaaataaaaatttggcaaagcctgcatgatgaaatgccaaataaaagatgcaatgtaccttgtcatcgatacattttccatagcatttatatgcagcaggataatttagtaagatattcatttctgtctgattgttactgctttaggagacggatgaaaagatttattttcctttgcgccctctacatgagcaatcaagcctgcatgtcttggcgaattagctcattttcaggagacttggcctatagaggttatagagctgaattactagagcaggggcatctcccaaggtttgaggaggaggaatttgaaatggaaatagagggagagaatagtacttcaccagagacttgggaatgagtcttctctggtagtgcctgagaacccaggaaccctcaaagaagctcatttcccatgcttgccatagaaggaatggaatccccctccttttaacagcccacaggggctacagtgagcatctccgtggttatctcctctgtacctatattagtccactctcacactgctctaaagaactatctaagactgagtaatttatgaaaaaaagtcgtttaattgattcacagttctgcaggctgtacaggaaggatggctgggaggcctcaggaaacttataatcatagcagaaggcaaagggaaagcaagcacagcaggggtgagggagagagagtgcacgcaaagggggaagtgccacacacttttaaaccaccacatcttgtgagaattctatcacgagacagcactaggcggatggtcctaaaccattagaaaccacccccatgatccactcacctcctaccagtccccaccttcaacacctggggactacaattccacatgggatttgggtggggacacagagccaaaccatattagtagccttggcaactgaaggctaggtctccaaactgaatatgattgaattgttgacaccctagtgaatgtggctcagtgtcagaattatttgatatcaaagaaaaaaagttcatttcacttcagttttgaagagcaaattcatttcatacacctactttaccttagagagtaggcttatgagctgaggcactgggatacactgctattcttcagcagatcctaggaaagcactttgtacatagcagataacacatggacattgttgattaactgcttactagcgacagtaaaacaactcaggattcctggcttttaatatcaacagtctacctagtaaaactgcttctcaaaagcttcccacattttcggtgcttaaatgaaaatatacttttctttttttatgagtagctgaatccttttgcatagaccgtaacttagatatatgaagacatttattgtctttccaattctaaatttctaaataatctaaatatgtaaatgtctccataatgctttgctagagactgtatgtaaatatcattaggctttctatttaaaaaaaaaaatggaaaaagaaaaaacaggaaaacctcttaggcacgtctgtcttttaaaaaaataccatttcaacctcaaatttgatgagacatacacattgctttttggatgccctttaatttttttttaattctaagaaaaaaaatggaggagatttaaagtagtttgacatttaagaatataatctaacttaaattaggattgaggtactgcaaatgtagacattttcttttgtaaacaaataaatagaaagtaggacaacaagtagaattcaaggtagctcaaaaaatgcaggatgaaaaacacttgaaaagaaaatggaaatactgagataaaaaaaattcaacacgtcaccaaaagactttttgggagagggactgagaagagtagggggtagattaaatatactggttgagaaaccagcattagagaagactagggactaagggtaaggggatgagtggagaaggcagtgtggcttgagtcaacgttgaacttcaggaacaggagaagaagatgggaaagaggaaaagaaagacttttaatcccctgtagcaggagatggaataagcaaagaagtcactgttttccctccagccttccatccctgctaagtggctactattgaattaatcatctgtaaatcatcattctggactggcatagccttggtttagggtgtctcatttcatccatataatagtcgccagggctactgagtcccttcaaaactagtaatcagccagatgtcacaatcaaacatgtctgtgcctatacaactgctacggtttgaatgtttgtcccctccaaacctcacgttgaaatttcatccccagtgttggaggtggggcataatgggcggtgtttgggtcctggggggaatccttcctgaatacgctaatgcccttacaaggttgggggagtgagttctcactctgttagttccctcaatagctagttatttaaaagagcctggcaccttccctctgtctcacatttcctctctgtgtgtgacctctgcacactctagctccctttctgccttcagccatgagtggaggcagcctcaggccctcatcagatgcagatgcccaatcttaaactttccagccatcagaactgagccaaataaaccttttttcttcataaattattcttagcctcaggtattcctttatagccatacaaaatgaactaagacaactttattattctgcccatggtttctaataaaacattaccaaattttcttcaaaaattcctcagatctgtttcaatatgggtcaaatatttttcaaatattttgtagaatgtatctttttcttccccataagaaatagaagccatcagttaaagatacctcttaatttcacatcatcacatgacaaaccttcccttccttcttcctttccctttccctttcctttcgttacaagaaaaaatgtcacctttgctatctaaagtgaagcctcaactctgctctgaattgcacatgcagcagcctttttgagcttgacactgtagattattgcctctctctttcaagtcattaaccacatactttcaactgggtcctttctactggcatttgtgtatactcaagcctctccaattcaaaaagaaaacattttcaaaaaagaaaataaaccattactcaactcctcatccaactccagctctcaagctaatatttgtctaccttttacaaccaaactttaaaatttcaactaagtaccctctccattgtcttacctcccactcacttttcagcattgagaccggcttttgtcccagggctgtattcaaactgctctaagcaagatcataaaacttttcatgtcacaaaatccaatgctcaatttgctgtcctcatttcacttgaatcagcaactttaaaatctggacaatattttccttggcttctacaacacgctctcttggttttctcctacccctctagatattccttctttgtcatctcctctagttcatctttatttgcttacaatttaaaagtgaggttccctgaggcctgacctgagccccaatatttttgcaccctttcattctcacaagatgacaatgtccaacaagtttatgactttgatcactgtcagtataactacaatgcccaaatttatctctgaaatagtcaactcagacttctctaaaatgcaaacctactaccaattggataatgaacctccatttagaaattttaaatttaccttaaattcaacatgatcagaactgattgcacagacttgcgcttctggccaaaacgaaataactggaaccagatgtagcccctaccctttaacaaaatattgggaaatcaaccttaggagtatataaaaaattaaataaacaatgacaaggaatgtaatcaattcaccatattaacggtataaatacaaaaccataattggtgtagaaaaagcatttgaaaaaatttaacatccattcacaaaatagataaataaacaaataagtaaagtctcagcttattaagactatacagaaataccctcaacgtgataatggacatctgttgaaaaaatacatctaaaatcatacctagtggtgaaaggctcaatgcttttcccctaagagtctgcaagacacaagactgtccatttcactggaaattagcaagctgattctaaaatttgtatggaaatgcaaagaatttacaatagctacaataattttaaagaataagagcaaatttgaagaattcattaaatgttttctaaacaaactataaaactacagtaatcaacaaagcaaagattggcataaagctagatatagagattaatggaaaaaagtgaagagtttagaaatggctataaagatgccaagaaaattcaaaggggaaaggataacttctcaacaaatggtgctagaactgaataaccatatgaagaaaaaagacacttgattctcataccatgcataaaaattagtcaaagtggacaactgacccaaacacaaataataaaactatacagcagtacacgcaaggatacaaaaatactagaagaaaatctagggaaatctcttcaggacaaaactcttctagacaatgaattcatgactaagacctcagaagcacaagaaaccaaaacaaaactagataaatgagtacttaattaaactaaaaaaccttaacacagcaaaagaaataacagagtgaacagataacctgcataattagagaaaatattggaaaactatgcatccatcaggggaccaatatccagaatttataaggaactcaaacaactaaacacacacacacacacacacacacacacacacacaaataactattaaaaagtgagcaaaagacggttttcaaaagaagatatacaaagggccaacagacatttgaaaaaatactttacatcactaatcatcagagaaatgcacattaaaacctcaataagatatcatcttacactagtcagaaccattactattaaaaagtcaaaaaacaacagatgttggtgaggatgcggagaaaagggaatgctttatactgttggtagaaatgtaaatttttacaatctctatggaaaacagtaaagagatttctcaaagaattaaaagtagaactatcatttgatccaacaatcccactaccgggtatctacccaaaggaaaagaaataactatatcaaaaagatacctgtactcatatgtttatcatagcactattcataatctttgctaaagatatggattcaacttaagtgtccatcagtggatgactggataaaagaaatggggtatatatggacaacagaataccattcagccgtaaaaataatgaagcatgtcttttgcagcaacatgaatggagctgcaggccattgtcttaagtgaaattactcagaaacagaaagtcaagtatccgacgctcccacttataagtgggagttaaataatgtgtacacacagagtatagaatggtaggtctagtaccctcagaagggttgggaagagaaatggggtgggtgatgaaaaattagttaatgggtacaatgaacattattcaggtgatggatacactaaaagccaagacttcaccactatataatatgtccatgtaacaaaattgcacttgtactccttaaatgtatttaaataatactactaataaaactattagaaaaacttaagtgaaaattttcacaaaattgaggtaaagatgtttagaaaagacacaaaaagcacagttcataaagtaaattaacaaattggaattcaccaaaataagaaacctcttcacatatcattattaataaaatataagtcaaatcacagattgaggagaaaatacttgggggctatatctgattaaagacttttaccaagaatttttaaagaactcttacaactcataacaatacaaacagtccaaattttaaaatgggtaaaaaacttgaacagaaattcagaagagaagatatacaaatggataaataaaaagatgctaaatcatattactcttcagggaaattaaaattaaaatcaatgagatataactacatacttactagaattcctaaaggtagaaactgacaataccaagtagggcaatgatgtgaagcaacttaaactctcctacattgcagttgagaatgcaaattgctacaaccacttttgaaataatttggcagatatatatatcccttatgtgtgtggggggtatacacacactcacatatgtacatatgtatgtacacttataaaatataaatatatgcatctaccacataatccagcaattctactactaggtatacttacccaagagatataaaaacatatgttcatacaaagacttgtactcaaatgttcactacaattttattcacagtagcccaaaattgaaaacaacctaaatatccatcaataggtgactgaataaacaaactgtggtgtagcaataaaataaaatacaacttggcaatcaaaataaattactgatgaacacagtaatatgaatgaatctcaaaactattatactgagcaataaaagccaatcccaaaagattacatacaatgtgattctatttattgaaattccagaaaacacaaatctaacctacagtgagaaaatagatcagtgatttcctggggccagagcagggtaagaggactgtaaatggcacaaggaaagtttttaggtgacggaaaaatgctatatcttgattgtgactgtgatatacaggtttatatatttgtcaaaactcatcaaatactcatttacactaggtgcatattattatatgtaagttattatttaataaagatttttttaaataatcaatgcctggtctctccttccaccccagcacacacccttcaaaaacaagtcctccttaagttatttgaaatcttggtataatgttttcttacttccatatccttcaacactcatgttcatgcaatcactatattctgtttaccttcaaaatatctcggcgtcttgacatatcttatctccactggcacctttaggcctatgccccattagctcttactcacatctcttgtgacatctcagcaggcactctcatggccttccaatctattttccattctatttgcatttctcaaaaatataaaagataaagggtcttaaaaataatgtgtagctactcacccaatgatgctcaaagttggtttgaaaaatctgggtttgaatcttaagaagtggtttccaaagctgagtatcagaattacctgggtggctttttaaaaatcagatttattaacctcatatggagattctaattcagtttgaggatgacaccaagcactttctccaactatcctgataatcatctagttttgaggatcatactactctgatgtcagtggagttactggaaggttaagtctcatgccaagaccatcaagctgagtcattttatttataccactgtttccatacagcctggcagctatccactaggaaacctgcccaccaagtaccaggtttaccactcactcttaccaaagtcatctgtctttatctgaaagatcccttcaatggtagtaattattgtaatactaattattgtaaactttccaagcacttttatgtatactataacttttgcaactatcttataaagcagatatcattatctctactttataggtaagaaaactgagacttgaaagttagggtcctttgcttacaaacagctaatgaataacggtaaggtttaagccagaatctgtcagattccaaagaccacattctttctgtgatactatatagtttccctaggaataagcagggaaaaaaatgttccctgtcatattcactgcttcctttatatctaccttctgaatttgttcttctccagtcagcttttggatggcagctgccacagcagaaggcccagcaaacaactgaacaatagctaatatctgattacaacagggaagaaaactgacaggacaaaaaacaaaaccacatgaattaaggtcctatggcaactgcattatcaatattaatcatatgacttcataatgactccttattcaccatatccaacctgataaattggaattatttcttcctacgaataaatgatatgtaggaatgtctataagtatgtcaaaatttcatgcatcgtgaatttcatagcaggaacccggctaaagtcaacattcatatcctaacatttttaataaatctatagaatcaaaggtataaaccagaaaattattagcctttcagttgaggtataaacaagactgaacacttttatttaccattccttgctgaagctattagctaatagccttaatttatgaaaagatatttatttcctttgaactgctttccccaaatcaaggcaaaagtactcagcatctttgagaaactaaactgttggacataaaaccaaacttcttgttagtataattttaatcatcactttattatatactgaaaatatacatgtactcatgtaagttaaatattcaaaatagccaaaatcaaattcccaaacacttgtgcaaaactgctaaaaatttcatttttcatcctcatctagacatgacacagaacagcttgccatgatacgcccttctcaataagtgtaaattacacacagtaggggatttaattcccagaccatggaaagctaaaccaatgagaaaaatcaatccaaaagactgaccttggcagcccaatcgtgaatgtagttattttcccttcagccaaagtcacagtagagattctttactctttctagtttgtcctagaaaactaatacatgggtcaaacaataattttctgaatttggaccgctgttgcagccaatcaagataattttgaagctattcaatctctgagtcatttctcagtaatagaatttgtggcaggtcaggaagaacgatatggtttggctctatgtccccacccaaatctcatctgagattgtaattcccatgtgtgagggaggaacctggtgggaggtgattgaatcatggggtcagtttcccacatgctgttctcatgatagagagttctcatgagatctaatggtttaaaagtggcaggttcccctgctctgtctcctgctgccatgtatgacatgccttccttcccctcccaatcatagaagcatcatgactgtaagtttcctgaggtctcagccatgtggaactgtgagtcaattaaaccttttctttataaattacccagtctcaggtagtatttttatagcagcatgagaacagactaatacggataattggtacagggagtggggtactgctataaaaataacctgaaaatgtggaagtgactttggatctgggtaacaggcagaggttggaacagtttggagggctcaggagacagaagaatgtttagaacttcctatagatttgtttaatggttttgacaaaaatgctgatagtgatatggacaatgaagtccaggctgaggtggtctcagatggaaataaggaacttattgagaactggagtacaggtcactcatgttatgcttttgaaaagagactggcggcattttgcccccgccctagagatatgtggaactttgaacttgagaaacatgatttagtgtatctggcagaagaaatttctgggatgattggttttgaaatgtgaaaaaggcatgagatttgggaggagccaggggtggaattatatggtttagctctgtgtgcccacccaaatttcatctggcattataatccccaagagtgagggagggacctggtggaaggtgatgggatcatgggggcagtttcccacatgctgtttttatgatagtgagagagttctcatgagatctgatggctttctcctgctgccatgtaagacactccttgctttcccttcaccttctgccatgattgtaagtttcctgaggcctttacagccatgcagaactgtgagtcaattaaacctttctttatagattacccagtctcaggtaataattttgtagcagtgtgataacagactaatacaaaaaggtttttgtttgggagcagaattacaagagttcttaattgtctgagcatgtgttgcccaagaaaccttagtgcaggagttgcatggagaagcaagttgtcataaatgaaaatattcactaagccactgacctctgaaacaggctccctcccaaccttcacttttgttccaggcaaaattttttaatcaacttcttgttgattgcttacaatagccaaaagtaaaatgcaaaacaactacaaaatgaaattggagatcttataaaagatccagagttatagaaagtcactggaagcagcattgaaaacttgccagaatcatgtgcaaaatcatggacatatgacctttgggatgattagaccaagggacagacaacaaagttttcagaggaaagtggtttcataattttgttttgatttttgatataaagcctcaatcaattttttaaactatttatctggaaaagtttattcccattctaagtagaatcacatgtaagtgccatattccagggccagggactgtcagataacgagggcttccttgtaccaccttctcaattcttctctgcctgtggggacactggtttaaggtatctcacagtcccaagttcctaattttcttattttattaaaatgataatatgacttacatatttttaggaaatcaattttccataattttcatttctgtgttttttttcaaccaggctttaaagacagaattgactgaacccatctaccataattttgtggtgggagacttgctgcatgtctattatttcttgctatattactcttataatttaacatttcctcttttatcctttgtttcctggaatctgttatttatgcttaattatgttttcttccctaaacctatacagctctgaactcttaaatgcaagagtaatctgaacagcatgaacttaatttataactctaataacatttttcaaaataaagagtagccatttaaaacatgtcatttattttgaattcggcagtcttaaggaaaaaaataataaatagggacaaactataatccattatgcaccacagaccagtcttcattatctatggcaagctacaatcagccttctctgggatacagcaaatctgaggcctggatttggaatcagggtcttgctttgttagaaaaaataaagttaacagggacacagctgtttctcagaagatgaagttgggacacccttgttcactttcaaagttgtcggacaaatttgagattcacacgctaacagaaaatgctttcccctctcgcttgctgctactcatcccaattcctttgcttaggctataatgagaaagttacttttattgcattttgttccttttaattatttcttctccttttccaagctttccaagtcatccggtctttcattcattcatttctcaaatatttactgagtatctgtcacatgccattctgctcagtgctagagacacaataaaacagacatagttcaagaagcttaggatctagtaggtgatacagacaacaaattgacaggagctaatgaaagcggtacactggaaatagtgtgtgggagagatgaaagtgaggaggaatctcactttatttgaagggtcagataggcactttctgagaacatggcatttaagctgagatttgaaggacaggagggagccttgccttcctggcctcgcaagtacctgaggaagaggtttccaagcaggggaagagctgatgtaattatgccaagaaatgaaagggtctgggcactctaggacatgcttctgtggctagagtggatgaacggacaagaggagtcctagatgttcactggcaaaagcagggcacatagcatgatcagtccccagacccacattccccaagtaaagcccttggtagagtaatagctgggatgtttcaagaatttaattagtcccataaatctctaccaacgttttaaaaagcagataacaagctgggcacagtggcacatgcctatagtcccagctactcaggaagcagaaggattgcttgtatccaaaagttcaaagccagtagtgcaaactataattgtgcctgttcagaggcactgcagaccagcctgggcagcataagaccctgtctcgggccaagcgcggtggctcacgcctgtaatcccagcactttggaaggccaaggtgggcagatcatgaggtcaggagtttgagaccagtctgaccaacatggtgaaaccccatctctactaaaaatacaaaaattagccgggcatggtggcgggtgcctgtaatcccagctactcaggaggctgaggcaggagaatcgcttgaacctgggaggcagaggttgcagtgagctgaggtcacgccattgcacaccagcctgggcaacacagtgagagtctgtctcaaaaaaaaccacaaccctgtctctaaaaaagcaaacaaaatcccagcactttgggatgccgaggcaggcgaatcacgaggagatcgagaccatcctggctaacgcagtgaaaccccgtctctactaaacatacaaaaaattagtcaggcatggtggcaggcgcctgtaatctcagctactcgggaggctgaggcaggagaatggcacgaacccgggaggcggagcttgcagtgagccgagatcgcgccactgcactccagcctgggcgacagagcaagactccctctccaaaaaaaaaaaaaaaaaaaaaaattaataaatacaaacaagataaactggcattttttcacccttcttgggtttttttctttcttaattctctataatgtgtatgctactgaatgacaaagtagtcaaaaagtgttatcttcctaaaagttctagctgactaaaggaaaagtgtatttcttggcagttctagctgccaagaaaagtatatttattgagacagatgcactcattaagcacatgaactttggcatccaggcaaattctgggtgtgtacactacttccaccgcattttatctctgtgagttcggtattatctccattcatcctcataggtttatcccttagcttcctctttccaaaaagtaggcctaactatgagactaaataatacatgtaaagcatttgatacagagcctagtacataaaagtactgactaggcattagctgctatgattataatttcatgttattatcatatactctatcaggcactctattaagatttaacttccgggcaaatcaagaacttgttgctaagtacatttgtgctcagaaagtttccttcgttaagaaaaaatggcaaaaattactaaagaaaaggtgagaaaatatctactatgctgcagtaaagttgttcaacacttcaaagatcaatttaaacagtcacatcttgttacagatctcacctccatgaaatatcaccttgacttgttaaatcactgttacatgaattccaatgggcctgatttaccttaaaatctgcaatgattcaacaaagaaagtgtgagaaccaaatgggattatttgaagcatgaactaaaacattttgatatcaattgtaaagatggtcaaaatattaatagaatttgaattgtaggaaaggcaaaacaaattttaaagagaaaaaattaaaattaaaatgcaacattgttcatcttgctaccataatattttaaaacattataaatatcagagcagtgctcacatatttcctggtctgttaactgataggcattttcttatatacaaaaaaagttaagatcttaacataaaatgtaggcaagacatacatcttctggacataaaaaacattttagctaagtgaaaagtctatcaaaatttcacctagcttcctcctgagctctgaacataagtctgcaactttcacaaagacctttaaaacagctaacatttctgcaaacttcataaacaatttttaaaaatgtattaaacacatgaataacagaaatttaacatgatgaaaatataataggcaaaaagatttttatgtttaacacatcattgctaaaaaatgatgtgttaaataattctaatcataaaaatatgactacctgtcttttttttagatcaatgatttagactttactaatttggaattagagaagatttgggctgagtcagggtttatgtttctatcatccattcaaaaaggaagtttactcagtaaattcatatgatgaaaacattttcaggaaaaaaaatatttaacccattcaaaagaaactattttgtgaaatctaagaatgcccatttccatataaataaatctgagctttgtgtaaaactaattataaatctttttttcactattcactaaagcaggtgtacagaaatctaaccaaaaatgttcaaaattttaggtggtgtttgagctattatagatatttgaaaataatagaactacaatttaaaatatttataataaagacattttactaattccaactgatctttccccaccttccctccagatttaacattgttctgtagttaaggatgggaataggtgagaagaggctagttagaaagtcagagttgacagcttaagaattaatgagatcgcgccactgcactccagcctgggcgacagagcgagactccgtctcaaaaaaaaaaaaaaaaaaaaaaaaaaaaaaagaattaatgagtaatttttttcataaaccgggcatgaaactgttacatgcaattgggcagagagattatatttacattcgcctacaatcgtttttcttattcctaagaaaaatttaaatatgataagataggtcattttctccatttggtttgctccaaggaggttgttgatttctggcaaatagatcttaactattattatttcattagatagtaatttctaaaaattgagaattatttttcctcttcaaaccaactacatcttgcacaatgctctggatattgtaggagtcccacagaagttcatcaaattcaattgaaagactgaaattattcagtaatcttagattcttcaataccaaagcattaagataaaatcagacaagagcactgaattctgaactaattcaataaaagtcatcaattatgaagcactttcactaacacatggctacatatgggcacctaatttaaaaatggcttagttattaaaggacaaaaataacatgaatgtcacagaattttcaaaggagctttataatatgtgtaacttgctagaattggggttatcaaatttaatatgaacagctctcatcaaatttgaacttaatgaatgcagttgtgaaacaggcaaatccaatacactgcgaatagtctaactcttaattcattccacagatatgatttacccctaatagccagaagcatcacttctaatagctcacgttatggcagaatggattatgttgtattcattctacctcctggaaggaagctagtatccataatagtaccattcaactgtgtgttataaagcacaagccagcagaacttttataacataaaatgtgaagatatttaaaacataaatttagtaggttgtgacagatcagagacttctctctttccactgaagggatatatttttttattcagatctttcaaatcctggtaccgaagctcagctacaaacttacccagcactggaaaaacatgtcagcatctgtgctgtactttgagactcaactcactatttctataaacatgtatgtacacaggcaatagacgtctctacaaagagtaaatttattgttcacttaacaaggaggatgtgtcagcatttgaggatgttttggacacttacacttctttttctgagaggaatgtgtaccaagcagaagggctccagattgctaagagctcaagctctctttttaaatattccactcctgagaaaattccccatcagatataggcaatttctaaaagactttcaatctaaggatatttacatatatttctgaaaaaaaagaataattgcatattagcttgaaagaatgtatataagaattaaatcacaggataaaagtcacattgtcctgcaaagggcataggttttacggtcattcagacctccaagttcaaatctgaattctgttaaaaaccagctatgtgatcttggatgacttaatctatgtaagccttgattatctcatctataaaatgaagataaaagcaggactgttctaggagttggagtttatacacatacacatgcataaacatacacatacacacacacacacacacattccatatagtcaggtcattagcacaatgccagagagtaggcactttgcaaactggagcaataaatgcctagtaatgtggatacctctaagttgtataggcactatctgctcatgttctcaccacctcactacattatgggccattacagacaggaactatgtcatatccaattctgtaatcccaagatctaacacaacacatagcatataatagaaactaataaactgctacttatatttggtaattgcagttggctcctcctgtatgtgaatagattttatcaagtaaatcaaacataaaatgaagagtgttcattcttaacctattaaattttctccttctttaaacttacgtaggttacttggctatgataatgagctgttgtttttctacttaaaatttaaaattcttccattgttttgccatctttgggtttgtctgggtccctttccaaaatttaatttgctttgctattaaaaaaaaataaaaacagaactatgaatcctgaatactaggtgaatttcttgtttgattcaaaatgcaataatatttctgggtaaaaagttaaataacagttttgcctagaggcaatcttcttcatttactgtcctttgtgaaaaagtaaagaaattaaaatattttttacctgactctaaacccataggaaagtttcaatttagagtttgtactaattgcttaagctcctttccttttaaaaatgagattctaattttttaacaacttgtcaagattacagcagcctgtttgccacaaatcagatatttactttctccctctctcttctctaaactggttctccaatcccaatcaaaagtatacaagcagcacctgcaattccctcttcacaaagaatgttgaaaacagatagcacaagagaggttccacagcccttaacggttcagtgcagagctgcaaagcccttgcttcaatctacctcttccaaacaagaaaatcatgtaatcgaatcctcctccccacccattgcattcttttaaaatttttttttgttaatttcatataattgggccagtatacccagaggctcgaatattccctatacacatcatctcttagataatcaaatcagttagaatctgcagaacctttccattccccacacagggtccagaaacctgtattttcataagcactccaaatgatcctcatacaagaaatactgctccagcccttcacttggagaatatgcagcctaggcaggcagattttcttcatggcttctcatttgggtaaacaagctgagggttcctgtcatctgagtgatcccagggccaggatctgaatgacttgaggtttaatgggatcacaacatttccatttcattataactagtatttgggttaataaagcatttgtctcctggaatttgacctgcatcactataaattttaaaaattgtaacacacacatacacacatatgccaaggcaacttaaggaaaaacccaaagaaaagagataaaacaactctctttagtgacgaaaagcactgaagagtacccaaaagcacaacctacctgaaatccaactttcagctcaccctctctatcttaaacaagacgaaaatcagaacaaagaaaacagagtccaatgcaattaacaacaacagtgataataacaaaaacattttttctgtccttactaacactggcactctgtcaaatgagccacatatattatttaatcctcacaacaatattcctcatttcacagataagaaaccataagcagacagatatatgcgacatgcccaaggtcttctataataataagtggcagaggtggaactccaacttaagtgtgtctgacctctgagcccacaaattctaactactttgtcgtgctgacttccagcccatcagcttagattgggtggacagtggaaagaacaatgtgttctcatagtttcatgactgtaagttatccagaaacttctcccatgaaccaagacactgcactttgtacattaagtgtgacagtatctggaacacctcacatacctattgagggcctcatgttcttcttaccacagaaaagagataacaaaatgtaacctgagcacatccaaccttgaggcaaactatgacagtcacagtacctcatagtagtcacattagtgtggtaccatcttgaaaaatggagccatgaaagcaaaaatctcagaaagaaaagagcagtgagcaaactgcctcataatcaagtctaagtagatctattatttaaaaagtaactggcatatattcttcaagcaatattcacttaccccagagcaaagactttaagtttcagctttggaatcagttgctttttttaaagtcatcaaacctcctcaagataatcatcaatctctcatcagcaccctccactgcaagtacatcattacgattgttttcctttatctgcactaaatctctgtagctcatggaaagcctgtgttagagtagaccaagactgggcagtaggcagaaattcatggaaaaaaagaaatacacaagtccttaactttaagctctttctatcggaagttatacagagtgaaaaagagtagctggaaaggccatgtgatccctagtaaacatagtaaacattacacagaatcccatggaagctaggtcacaactggcgacaatgtgccactcatgctagaagcacaggttccctcacaggcccatggatcaatgttttccagggcagccccactatgcttgctggctgggttgctctgcatctccagggcagcatatgcctaggctatttactctctagtcaagtcatgttttgccaacaacaaagtcaaaactaatttatgtgcacccagaaatatattgcattgctcatataaattcaatattcaatcaagactatggagtggtaatcttaatctatttcagcttttctcaatctcagcactattgacatcttagactggttaattctttgatgtgaagggccatcctgtgcattttaagaggtttagtggcatccctggtctctattcattagacagtagcaaaccctgtccccaatcccacacttgtgacaaccaaaaaatgtctccagacattgccaaatgtccctgagacagcaaatctcttccagttgagaaacactgttctattttctcaattgtcccctatcaatggtcttgaaaggcaaatataatatttctacactacaatgtaactatttaaaagatatttcacaccccaggttactatcagcctcagtgattctgacttattctgtctaacttcaagtgctctgcccttctcattctggtgctgttacctgtacttcaaatgcccttgggtggagtatgaggggcccacttccagggccctgactgatttccatctctccatttccttttctgaacacctggggcccttgaacgccacccagctttagggtcacctccaattttgtctctcaagaactgatcttgatttggcaaggaggaatacgatcctcatattctggtagtcagtgtcaagttactcctgctgtttgtcattaaacccatccttgtgactcacttttgaaagccaggcatgtgccttgagctgcagacaaagtctccatttatcactccatgttgataatgtaagttgtgtttttttccctacactttcatcattggtctcatgctgtatgatcctctaggattaggaccctgaattattcttaccagtcccaactcagaatttgtgactgtctgcatgctgacagcaatgttaactcaatgttattttgtctggcccttggaattccaaatattaccttctttggaggtgaccatcactgagcttccacaatctgtcaacccttgctcattagaccttgctgcacctatatggtgccaatggccatattaggccactaccagctgccttctcaccaaccctgcggctctcatccttagcctgctggtctctttctttaaacctaacccctccctagtgcccatcccacccacacaactgaggggtttccaggtccagatcttggctcatgacattctagataccctggcgaagctatggcactcagacctgagtagatgctagaattcatgttcaattaattcttctagatagtttaccttaattttactcaagacttaagccagaatattgctttatctagtcagataatccaaaaaattgttgaggattagaaaatgtacagaaacaggatccccagtcctacttcacaatgaacctaacatttgaatacattatcctttttactctcacatattttctcaggaaatgaaagactttcacagttgtcacacctatcaaaacacttaattgcatcaatttctctacctcatctccttccttcttcatagctacagtgagcataaaatttaggtacagatacctcaaaaataaaaataaaaagaatgtaaaagtgttaaaatccattaataatttaatttcagcatctgtatggagaagaaatatgctcattgtggagagaactttataacaggttactgtttgcaatcctctgcctttatggagatctacatccaaaccagctcaggcacagaccaagactagactatggcaatacccaataattaaccattagcctggggcttcacaaaaataggacccactggagtgcagcaaatgctttcagagcttcccagaagctggtcaagaactcttaatactagttgacttgtctgtttttgtttttgtttttttttaagagaccgggtcttggtctgtcactcagcctggagtacagtggtgtgatcatagctcactacaacctggacttcccaggctcaagcaatcctcctgcctcagcctcccaagttataggtatgcaccaccatgcacacctaatatttttttaaaaattttgtagagatggggtctcactttgtcatccagcctggtctcaaactcctggcttcaagtgatcctctcacctcagcctcccaaagtcctgggattacaagcgtaagccaccatacccagcttatactaattgacttattttactagcatgcagttggttatggtaatatgagtgcacaagctagtgcatggactggggaaatacacaagctaaatgaggcactgtgacagcaagaaagagaagtcccaacgacacaagccagtttacacacaaagccaatttctcccagtgacaagtagtgcttttcaaattgcagatcataaccctgagtattgcaaagaatgacctattaaggttctctccctcaataaatgtactcaaattaattcagaaatttttttctttttatgaatatttgagaatgcactgtaagcaaatagtaagcataagaatgtttgatgaaatatttttccagataaattgatagatatatgatagatgattaataggcttgatagatgcatggatagatggatggatggattggatggatggatgggatggatggacggacagatggacggatggacagcgagacagattgattcaacaactatttattgagcatttaccatgtgccaagtacttctctagacacttggatacattagcgacaacagataaaaatccctgcatttatgatgtttagtagaacagacagcagagaaaaatatatttattagtgtaagtcatgatttaaaaaaaataaataaccatttgaaagccactgttgagagtaaggagatgccccatgcatctttccaccactccaaggagagaaccaaccaataatcatccttccacagtggaaaaccctagaggggtgaagtgaaagggacagtccaagtcattccccttctccctttcaagctggtctttaagattaagcatggcttcctgaagccaagctctctttgctctgttttgcatcttcccctttaattttgcctttttcctacagttctaataggtaagcctgttggaagggaaggaaaacagcaaacgaatgagctcttggtggatatttcctagtagtgtaacagatggagaggattcattttatccttaataaatagtcacttccaataatgggcaaaccattgaaattgtgatagcctattgtcttaagccagttaaactacacatctacctctgttgttactaaatctcttcagagatatcctaataagtattaactaatatccagtgtgatacctctcaaaataacttgcttatttaatttgtagcagctgtagctcacatttaggggtgtctagtataagcataagcccatcattgcaggctatgtgctttacctttaatcttcatgacgaccctgtgagggagaaatcattatctgcattttgtaaaagaagatactaaagcttacagaggttaaaaaatttgcccatgatcatttggctaagtggcagagctaaaattttaacaaaggccatgtagctccacaaaattactgatggtatccacattaagggcaaaggcttattatatatggaaaaaaattaaaaattattctcagaaaacttattttacaggcctatgcttccccttgtttgcttttaatcattctttaatatttaatggtcattaaaacactataaaccattaagtttagaactgaagagttaacacaagcactttttcttctctttgctgcaataggtataaatgtgtgagtgctaaaaatattttgatatctcttgcacaaaaccttttcaatacccataagtagagtaggagaataagaggacagattctgtccagaatatttcgcctcaactcccagcctcactgcttatttgctatgtggccttgagaagtctgtgcctcatttcctcatctgcaaaatgggaataatgatagcagatacaggattgttttgaggattaaaaggcatatacttggaacagtgtgggcactaaataaaactacatatttgttatgcttattattacttcttaagcagcactggctcatctcattccactagacattaaagtcataaagtttatcaagaagaaaaagaaaagaataagttctttaaacttgaagctcagtaggagcaaagagctatgtctattccatcatctgtcttttcaatcccccacgacttgtgttgctggtagggcacactggatgctattgctaaccagtgctgttttgggaaagcactacccttcataaattatttgaaaaggaaccattttgcttttatactgatctatgagatatcattgcttttcaaaacacaatcagcatatgtttatttactaaaaagaggtcaatgccacaggtttgcatgaaaaagaaaaatcatgaccattgttaaaagaaaatccaaaccaatttttcagcatagttctatatgttgttttaaacaactatttcaaatgttgctcaaatgaaaaggtcaagtatacatcaatataaaagaatataaaggttttcattatcttttagtctgttctcactgtcagtgaggcaagaacatgtttaaagtgcatctccccataatcaatttctttacttagaaatgtcattctgggtggacattttacagctgattaatttctgtccttctttctcatatgcaaatacaagactaaaatgcactctctggtagatttcctttctgcggttaaagtgctaatttcctacagatcggttatctacacagttctagcagaaaaaaatgatctttcaaactatgctcttatgtttctttaatatatgcatcttttccccaaaatatttgcattaagtcgacaaacatttgaacataaaaggtagaagacattgtcatggcttttgtcaaaaagtcaacatattaagtattgtgcacacacaaatgtactcaattaacattttaattaaggataacaaatagtaattaaacagatgacattttaattaatttctcaactgtaaacagcctgatgaaaattgttaaatctgattctagttaaatatctcttcttgcaaacatggtaagcccaaactaatcacgatcagaaacatttcccttttatgtacttacatagtcataatgtcattcgcaaataagtttttcaagttcctcagagttatgaaccacattctctttattatgtaggaagcaagtgatagcataattgtataataattgtttcaaggaacttctatatgtcttgtgaaaaagcacagtatactaaagtatttaatgtctttctacaattaaagattcatgcttcgctgttaaatccaaattaacaattttgtcaagcttagcaacccaattccataacatcaacttttcatattactgaacatctgtaatacctgtctctgattttgtaatacactaggggtagctaattgtgtcaaatggcattattaatttctcaaagcaaaattagatataattcatttatttttgaaaataaatatgggccattcaacactttgaagcagagtggcataataatgctgaaaatgatgcccaggatatttagtcagtgaattaacaagaaaacggaacaaaccctgctctgaggattactggatttagcaaaacagaacaaaaacgcaaataagtttgtcttttgttttctatattgcatgcaacatacttacaataaaagattattcactgtttatctgaaattcaagtttaattggcatcattttatctggcaaccctacttttaaaaaagcagtatctgtaagataaattcaccttgagaaacactttttttggtctctggtgcaaagtgggctatggcaaaatgggagcaatctggtggtagaggatgctctgggcctctctggggccctgagaggatactaagatgagccacagccagtattgagacagcatgtccaggagacaaatactctgtgtatttagtaagtcagatttgaagtttaaaaagttactgatctattttttaatctactctgctttgttttttaagtgtaatatagataggtctcatagggtagccagcctctctgttatattttccccttcagaatcattcagaaaaggcatgcagaccctaaggaaatacagcctacatcaggggcactctgtcgctgaagagagtgtaggagatacttgtggcattctatggtcccttgcatggcaatttctgaaaactgtggttcccagagctatggcttgaagagactcacaactgctctccacggcaaaagtgagcctcagaaaaaacagtgtgggggtctcatggctccaggagatagaggaacagggaaacaagggaaacccagggacaaacccaggaaaactcagagacaacaaattccaagttttggacatgtaagtgttttttcccaactgagaattctgaagaatatgagaaccaggacatatggtcttgaaattcctgttttaatctgcaagatcaaaacagaatattttagttcagttatccagatatttcacaaaagatgagtatcagctctagtaggacacagctaaggctactaatcccctccccttcacaaacatccctctgtttacctccacttactcaaaaatctcattaaaatttggtagtcattcatcttacagtaactctgtacaccacctcacctctgcagtcccatacctcttgagaggatcttccatgacctaaaagatgacccctgtcacctcttcaactcaaagaaaggatctccaacttaaaaagggggttgcttagggaaataaaaggggaacagaaactaatcacctaaaaccactgtctactcacagcgtaggaagctctttggtaggcattaggaaagcatctctccgtaagttagatggtatatttgtgtgtgctattattgctattgctatttaactgcaaatatgcaattatcacacctttagcatgaggttcagtagacatagaggcactagattcaacaatattgaatttacaaaagaatggtccaatgaatgaaagttgggcagccacagaaagcctcagagagctaatcaatgtttcccaagaagtctgaaccccaccaccaaaccaagcaaagctgaaagtaaacatgttccggccaaagtacagaaagtaaaaatgcttcctactgctgtggatgagggtcctctgacaggccccactgatagagagtgggaagctcaagtttaccttaaaggaccttgtttcctaatacatattgttaaaccctttcgtaatgctctctgcaagcttggctgggtacttctctgctaactactaataagctgcagttttctcttggtctctgctttgggcaaattccctcctatccccccactcaccttgcttcagctgtccctaaggcttaattccaccttctgccctgtacaagtatactaacttagtatatttctaatatcctctaatccacatttgccatatctttcaagctgggttcaaaacacctctttttagaagcttttcagaattaaccaatgtaactaatgcaacccaattttgctgttttctcctttcatctataatgcctgaatccttttacacttatatgtcaagactttaccatgtttttatgttgtttacccagagaaagaatattagagctttgtaaaattattgatgcctcaaatgcagctttaaaatgagttaaataaataaaaattagtatagaagagcacggtaagctttgttgtttgaaaagataacctatctactattgcccatcttcgaactcaactcttcaacacattaatgtggcccatccccttgccattgaaccagcatcatctggaaacttgttgaagatacagagtctcaggtcccaccttagacccactgaatcagattctgtattttaacaagatgcctccagtgatttgtagacatgataaagtttgagaagccttgaccttccccatactaggcatgaaatattctacaaggaatatctcttaaatgggtgcaacagagtcgattcaggtatctctacttctgcccaatccaatccaccaattagaaagcaacttttccactaaagaagtttaagggatcaattcatcaagaggacatggctattgtaaatatatatgcaccccacaccagagcacctaaatacataaagcaaataatggacacggggaaatagatagcaatacaatgatcataggggacttcaataccccactttcaacaatagatagatgaagcaaaaaaaaaaaataataaggaaatactggacttgaatagcacttttgaccaaatgggcctaggagacatagacaaaaatttctgtccaacagcagtataatacatgcacatttttcttcaacacacatagaacattctccaggatagaccatatgttaggccacgaaacaatcttaacaaatttaagaatactgtactcatatacagtattgtttcaggccacagtggtatgaaactagaaatcagtaacaggaagaatcttggaaaattcactaatatgtggaaattaaataacatgctcctaaacaaccaatgggtcaaagaagaaagcaaaaggaaaacttaaaaataacttaggacaaatgacaatgcaaacacagcatagtaatttttgtcaagggcaccaagggaaaacaatggagaaaggtgagtcttcaacaaatggtgcagggaaaactggatttccacatggaaaagaatgaaatcagacctttatcttacaccacacacaaaaatcaactctaaataaaagacctaaacataagaccagaaactataaaacttctagaagagaaggagcaacagctcatggacattggccttgatgactttttggatatcacatgaaaaggtcaggccacaaaaacaaaaataaatgagactacatcaaactaaaaagcttctgtacagcaaagaaaacaatcaacaaaatgaaatgacagcctatagattgggaaaaaaaatactgcaaactatatatctgataaggagttaatatctaaaatgtataaagaattcatatattaatagtagaaaacaaataactcaattttaaaaagacctcaatagacattctccaaagaagacataaaaatggccaatagatagatgaaaagatactcaataccattagtcataagagaaatgaaaatcaaaaccaccatgatataccacttcacacccattagaatggttattatcaaaaagtcagaagacaaccaatgtgggcaaaggtatggaaaaagggaactcatacactattgatgggaatgcagactggtatagccattatggaaaagaatatggaggtttctaaagaaatcaaaaatagagctaccatatgacctaacaatccctcttctgggcatatacccaagggaaataaaatcaccactttgtaaagacatctgcactcccatgttcattgcagcattattcccaacagccaagacagggaaacaacctaagtgtcagctaatggacagatggcttaagaaaccgtggtacaaatatacaatggaatattgttcagtcttaaaaagaacaagattctacttgccacgacatggatgggactagagggctaagtgaaataaggcagacacgggggaaaaaaatcacatgacctcacatgtggaatctaaaaaatcagagatagagaacaaaacagtggttatggggtcagggtgggggaatgaagaaatgtatgtcagaggatacaaaatagcaggtatgtagaatgaagaagtctagagatctaatgtacaacatgaaggtcataggtaataaaattgtactctatatgagattcatgctaaatgagtgctctcaccacaaaaacaaagggtaactatgtgagataatggatacattaatttgcttcactatagtaacctttttactatccacatgtatcccttaacatgttttataccttgaatatatacaatacaatttattttataaataaataaaattctatttcccttgcctcaatgaaacaggaaagaagacaggcatagaatggagggctcatatgaaagaaaaattctgcctcctggaaaacaattgctaatgaattggtatttgacagcagaggcattgcaatggcagggacttcaaaaggaggctggtcactgaaaccagtggctgttctcaagacagtggaacaggagcacatggacatgcaggagggctctgtagaagccaggagccaccagaacctgaccagaaaagaagacaaaggcatcaggctgtccaaagtcttaatggggaaaaactggaaatttaaatcaaagccctactggctctcttttgcactcagtgttggtggtgcccagtgctacactaagcactctacctacctcattgacaacgactataatagaccataagtgttattattcccattttgcagacgggacaactgaaaaaaacagaaagactgtaaaagtcacatcccaaacacaccacttaaagtgatggcatgggattcaaaatgaatcccactcccagttctgtcctcaacctctatgctctactgcctccttctgttcaaggagagtagagtctgtatgggtcttattacacagtgtgggcccaccattctcagctgacccttgggttggcttcataaagcccagaattagagaaaccctccagatgttagtacacacctgtatctgaagtaggtaagccctgcctcaaaaacaagattgctatcatggtgagtctatgaaatgctgtcttaagaaggttgttgtttttttgttttttgcagtttgtacccatcaggttttagcagaacaacaggttttagctatacacattgggttttagcagaaatgaagcactttccttccttggggaacaacatatgctggcatcgctaagtgtgtggctgcctggctccttggtacacaaggactctgtaggaggtcaggcctccttaggacagcactggagactctatactccaaaagtctctccacctggcctagagggtatgtttttagtcctcacaggttatgctattccagatccttctccagccttgacctccatagagaaaatcacatgacacacttcaataaactcaaccacctaagggttcttgtggttcttgaccatacagaccaaccacctccagcaaatctcccactagcaaaaagcaacttatctcttccatggatcttcctcggatttctaccatttcttatctaaggacctcttatttcttccaaagatctgtttgtgtcataaaagaaaaaacaccccaaaacccaattatggatggttgtgaaaagccatgtcaaattaaggggatcatcaacaacgttttctacagttcacataggaggcgatcgggatgctgttcagtcacgctgcaacatctgcctttcattatcattatcgtcctcacagagttcttgagcccctgagtttacggctttctactgggattttaagaaatacacagagatgtatcaaaagttgaacctgtgtatttacagagaatctcagagaaaaatctcttccgtatgataaaaggcctagggacttgtactttacagaatacaaatctaaagaagagatattatgtgccttgagagcttgttagaaagctagatgttacacttttcttctcttggaactactgaatgtagattatagtctatattctgaggttttgtaggtttctcttttgcattccaaagcctttaattctgtagattaaaaaaagaagttaatattagatgttcctagtcccctttaaagttacttacgatttctcacttgccaattgttgaattttcatgtttatttttagtgttgaaaatagggaaactgctatctgtccttcacttcctgccaccttagggaaaagtgaacaaagagtagagaaactacagagacagggaagacagcaagacagacagagtgggaaggggccagagcatatgttttaagtcattcaggcctagttcccatgtgagttttatcacttagtgagtaaacttgagcaagttcattaacctctttgaaactcattttcctcatttcaatcaccttgcaggagctggtctaagggtatatagcaatgcaggtaaagcacttggcacaatacagaaatccaaactatgacatacaggatgatggtggtggtggttaacaggcaaaagtggcaagacagggcagagaaggtgaaggtagcaaagtgagaaagaaatactagatatggttttccctaaaatccaaatataagcatgattgagagtatctatggcaaaggaaatattctaccaacctgattaacaacttcattctgctttgaaagacactcaacctggattgcaaattccatgagaatcagcagactagctaatctcatttcagtttatctccacagtaatcaataattgatcccaggggaaggtcagcctagtgtccttaggtgactcttcctttgccaatttgttttgagctctctttatacaagagtgtaggtattatgatacagagattatttctttaaattggagatgcatctgatgacacttggagaaaaccatctaaagatcaccaaaggaatttaccaaaaggtaaaaccatgaataaaaataattttcagacatgtttcataggactacagttcaactgttatatattacttatgttcttaatagtttggaaccacttgtcagtcaaaattaaatcataggcattccatttgtagaacaaattagtcaatcttatttgcatgaatcacaaaattcttacagctcttcattttcttaaagtatttaacaccctccccattttctcaacgtgaatatcagggtacattagtcacaagaccataacccaattacttaaagggcatattacataaatgattacacaacctgctgtgaaatactgtatctttagcatttggaccacttgggacattgagaggaaggattcattaatgaagtgtgaagctcatttttatttatagtccacaggaaaggcatatttcacagccatcagaagcacttctgcaggcaagaagttacagctaatccaagtgctataccaagctagtacaagtccaatcctggtgtccctggcagtcagaaatgttgtaaaggggaaaggaattttataaaaaaattgatagcacaaggagtatgagaatgtagaagatcaaatccagaccacagccgaaaccttgataggagggacacatgatgaattagcctataggctgaaaggtctggaggaagttgtgatggtatgggtcagatatcttccacttcctctgtgaagtagtagaaagtcattttttgagaaagcggaagtggggagagtggtgacttgaaagagtcactttgggatatggtagagcaagttaattgggaaatagcggataattaggcaatttgaagttggtgactatgaactttgagaagcatcaaatctctcaatccatttctgtcaatttaccctactactgaatgatttaattcattttgtgtcaccagcacctagcacagctcctggcacaaggtagatgctcatatttgactcaattagaaatggcaaatatctgaattgtctgaacacaaacagtaaatggtaaataaatactggccttcttttaggtttgcaaaacacaattgatttgatagtgaaggccaacatatacataaagaaaaaccagaggcctcgattttacattcaaggtaggtcactggtacacaggaagccagctgaggagaggtacaagtgaggggacgtgaggagcacgggtggtgagtatgagatggctgcccagtcacctctgctgaaaaccacctttgagagtagcaggattctagaaacaggatcaaaagaatcagtgtagcaccatatatcactgcctctgtaagaaaactgtgcttgtcaacctggagtttggggaaaagctttaaaggaaacctgtcattctgtactccagcttccaactttgcaaaaggcacttttccttggaactcaggcagaaaaataataaatcacgcctagctctcttgctcaggatccagtcccggttccccacctgtagttccctccagctgcttcctgctacttccattcctgcaccttatgctccagctattccaaagtacttcctggcttaaaacaccaagtgatgttgtaagtcccaagctttgtaagtgatgttctctctcactggagtcctttctctccccagccccttccattataaattcccactcctcctcctcagatgtctcttcttctacaaagcctgtcccgcccctttcacagagtaaagaagcccacccctactgtgtccctgaacgtggctttaggcatggaagaaactacatttaacctttgttccccataacttgaaaagcaactggcacatcatagattctcaatgcatgtctgttgaattgagttttactgttcatctaccttgcagacaaatggcatttcttagatatcaattctttttgatttcctttttccaacccatggactataactttttttttttaactaatttcaggaacacatacgatgtatgcactactggagtctgaataaaatttctaaaaagtagaaataatttaaatgaaaactgatttctttattctatcagtttttgaactcaaactgtctagaaacaagaaggttcatattgatttaaagatgtataaaatataacaaaagacatgcgggttatggaaataagactgttcattctccaaattcacaaatattagaattaaaggcacccctgaaagcctgaagaaggtggctgtagaataaataaaaggagtgccactttacacagcaggtggcaaacatgaaacgttttattgtaagaattggtacagacttgaaagtataagtacgttccaaggaggacttagctataatctaggatgatggttccagcatgtcactgggtggaaattagagctatttactttgtcagcagggcatgcccaccccacacttactcacgaagtgccacctgtatctttgccactgtagctggagcaccgagcaagatacatccagttggtctgatctaactcagcacagcatttctggtgcttttatactctctagaatcatagctatgttgtttggagaaatttattttcttgaaataggatgcagttctttctttgattcatccaacgtaactctcatcgatcttttaaaataaaatatcttccaaaatatttacttcattgaacaaatacatgagggaggtcaaagagatatattgcataccccacccatctgcatgctgaatgtctttctaaaccatcaacccttgagaagggaaaggctgagttaccaagtggactgaggtggatatgtggcaattggaaccatattgaaccatgcaggaaacaaaaagaaaagcacagaaagaacttatctggaactaaatagcaagttcggttcacaaaagttttattcacaagtttttccatgtgaagaccttaaaattccactcaataaacatgtttataaaataagcacacaaacagcctggaaacacatgttagcattatataagaagtagagaaagacaatgaaatcagtcctgtcctccttatgctaattttgatttaatgtctctagggacctgtgctcatggaagaaaatcaaggaacatcttaacatggaaaacaacagaaggctaaacttgtggctcagcacaggagagggtagtagaaaacctggaattgacgccctcttgaaggctgccaatgtttaataacccccagagcccattgttgtaagatgtggctaattctagcagtagttactcataaaagacaagggtataaatctggaaacctaagataaagactatgaagaaactctgaggagaaagagattggtcgtaagcaagcgtggaagaaaagtggcagccagtgtggaggaaggaggggcagtatgtgagtggataggctggggctatgcatatgagttgtgttctctttgctctgtacaacttcacttgccctcttaccactggggtggaagaatagcagcaccagcccaccttcgtagcagttatggggtatatttggggcagagctggaatctgggctgcattgggagaagattagcctacccctaaacggttcctccacctcactgtccctctccacagcccaaagcttaggacttgacaaccaagtagcaaactaagttgtaaaaagagagcaggctcagagcagaggcatagacagttttacctaagagcagagtttcttataaagaggcagcaaatgctaacctcaagtacaggctttggtgatatgaactctgtgtcctggggcactccatcaccctcctcttcttaaactcaccaggaatgacaaagactaggatctggctctggctcttcctctatatgactgatacctgaagcagacaaagtgggatagggttcaaggcagcagtcatgatgagaggcaatacactgaacaacttacacccaataaatcagaactaatgaaaacgagaaatcgagaagttaaaataagcaaaataaatgtcatcaaagagggaagagagattattgataacatgaagcaggaacaagaagttataaaaatctgaaaagaaaaacaatatatgaagaatataaagttgaaacaacttcctagatggaataaatagcagaatggatacaaccaaacaatgattgagagcagatgcagaaattatctcataaggtattggaaaagaaaaaagatataaagtgtaatagttaagatctgtggaatatacaagtgtccacatctttttaacaacagtctcagaggagaggataataaagcagttgaggaaataactcctgaaaatttctatgaattaaagaaaggggaaaaactatagattaaaggtctaacaaggaaaagaaggaagagaggaagggagagagggagggaaggaggggaaagaacaaggaaatgagaacaaataagaaagaggagaaagaaaaagaaagaaaagaggatggggagaagaaaggaggagagaagaggacaaaagaggacaggagagaagagagggaaaaaagaagtcaaatgtatagaaaagaatcaaggactaacagactacactgaaggttcttaacttgttttggtgccatgaatcactttggcaatctggtgaattctatggactcattctaaaatgaaaaaattttaaaaattgttattaattgcataacacaaaatacataagattataaataaaaccatttatgttgaaaaatagttaccaaaatattttttaaaaaacaaatttatgatatagtaataggtgttctcccttattaatgagaacacaacaagacttagtggatggtctaatactgtaattttgaagaaccacagccaacccattttatcatggatgaaaaaaatatacattgttgctgacacaaaaatgtaagttggttgtaactgcagcctaaccaagtattaatgataaacatagctacatggataaaagtagaaaacaaagcaagatttatagtacgataccactgataaaaattaaaaacacattcacacgcaaaacaataccacagacttaacaaggttacacacattatgtaaaacaattacatcaaagacaccaaagtgaatgctaagggagaaaagggaattggagcagtgatcagagaagatgaaagagaaagaaaataagacaagaagaaggctttgcaccaatcagtgatggcaatgtgctctaaactaaggataatgattaacataactctcagtacctaagatctaattaaaacaaacaaccccatcaaagatgggtggaggctgaaagtcagacattattggcatttgagagaatagaaaaaaaattacaagatagcaactaaagattttatacaagtaaacccagactttgtcagctctaatagtcctaaaattgctgttttcagagatgtccttaccccacctcaagagagtacaccattgagaccaggtcaggcataaaagcctgtcagcctagagaggacatggaatagctctcagaactgtcctaatctgaaaggccagccacaaattgtcttttccagttcagacaaaggacatcctcaccgtccactctcttgtcagtggagacagaaaaaaactcaggaatccaatggttgtccagacatttgggtgaagacatgacattccatttgtcttcaatcattactgccgctataataaaaataccttagtctgggtaatttataaacaacagaaagttatttctcacagtttcaaaggcagggacgtccaagatcaaggcaccagtacattcagtgtctcgtgagggcttgattgtgcttcaaagatggcaccttgctaatgtgtcaccacatggtggaaaaggagcaagggagcctcttttataagggcactaatcttatccatgacagtggagccctcatgacttaatcacttcccaaaggccccgcctcttaatactatttcatcaggtattaggttctaacatgtgaattcgtagggggacacaaacattcagaccatcacaccatctataccaaaaaaaaaaaaggctgaatatgctctcctggtctttttactgccccctagctgtaggtggtagcaataaacaactggttgttttcattctgtttctctatctgcctcaccacctctagaagggccctaacttaagttggagtgacagcatacaaaactctccaagcaagtcctcttggtcccccaatatgccatgaagcatgctccccaggagaaagcctgtatggaaattacgctgatgcattcctccttgcattcaggtttggtaagagcaggctgtgtgcaagtggttacagctgctcagtggaccaggctgtggaaaacaaaaacgaaggctttgatttcatctctcccgggtattctccacatcacttttgttgtgtgcgaactaataataacagatctgatctacatacagttcttcttgtctaaaattactcatttaaattaagcattttagtcactgtttgataataagatgcaaggtaaagtacttgtgagcacagaaaattaatagaaaggaaacactgagcgtatgttgagtttagccaccagcatctatttttaaagatgacctaattaattgttacatagaatgtcaggagaaaagaaacactggcaaagcttttagacaaggcaactactaactttaaaagtatggcactgctgaaacagctgtataaaagcttgcagcatgatttcaacacagttgtcaagcatgctggaataaatacatggcaataaaaagccatgtaaatttctgggagaaaaaaaaaatgacaggactgaaagttgaactttaaaaaaattgtaatttttaaattgtgtgtatctccttaagataatcctcatttagtaaatcatatttacagtcattttgccacaggcttttcttccctagctatacatgtatacagcaccatgaagctttacactgtttttcataagagttacggttatttaaatggcaaataaaccaaagacaaagacttggtttttattaaattacagcatcctaaaatttaaacaaaataatccaaatgctgaattcctccctgaaaaactgacataaattgcaataaaacatgctcgcaaaactgaagcatcctactttattttcacaaataaaaggtgattctgaaaattgacttcacttctaaagtaggaaagcaaaactaaagaataaatactgtaatggaatgtaaaagaatatgtttaatagagaggttttataaaagcattgcctaagcataagaaaactagaaaatggtattttaaagactattaacatacatctctttcaagaaaacactaatctaataccacataaaaggagaggtagcatatatacacctacttagattaaaccccagccaccaatatacactctgaggtctttataacccctccttgcaaaaaaggagggtgtttgattagtgagtttaccaaattcacattaactgggagtggaaacctgccaacgggacttgcagggttgaaggatagaagaaactcactcatgtcatgtccctctatccaaatttaataagataaacaaaaactagcaaataaaaattaaaacaaaaactcaccaacaaatagcaaacaaagaaaaagccacaagccaaggccattacctcagaaaataatgggtgaggaaaaacaaagaagattccagagcagagcagggcggcctgtgtaagggtgtaaggaggctccatcacgcgcgcgcacacacacacacacacacccctcacaagttacacagcagagctgcaaaatcctgcaccctcacatcaataatggatctggaaagaggcgaacttagtagggtgggcctttttcccttttctggggagctgtggaagggatgctagggagaaaaaagcagttttctggcaaaagagaagcctctaggctacaggatgaattgagggaggatcagaagcaagtggggacgcctccagggatagaggtcacccccctccccccgcccttaggtgaacatttagcattacctctctcagaggtgagaatccagactaactcctgcacccacctcgactgagctctctggctcccagcctattcccaggaaacagaaaagtggatcaaacaccaaaaagcagagcctgagtggtcttttcttagtagaaacaagagttctcagattagaagagaaagacagtcaaggacgatggttatttctggatgatgggattagaggtcattctttttactttcttctctgtactgttccgagttgcttaaacattctttatcatacacttaaaatttttacttacaacaaaaacaattttaattgaaagaagaaacgcgactatacaaatttttaagaaccatgaacctgaggtaggaaaacaacaaactacataatgttcctgtcttcacaagataaatcccacctgtgtggccctttgatctttgagagaagagcaaagaaggaaaagaggagggaaacatcaagatttagaaaaaacaagatgcacaaaagaggaagctgatctgtgagatagggaggtccaggctctactggaacagctggagagatagaatctttcttccagtcctagattttccctcccatttccagcctatactcctacaaattgattcttccatcatccaatcaccaccaaaccctgacactcagtctcagtcagctctagctagggaagcaattgcagggggctgatgtgagaattgcattactttagtgcatgtgtgtccatgcatacacttatgtgtgcgcatgcatgtgtacagtagagctgctgaagcaaaagacttattccaaacatgaacgatgatatctgaaagaaaatataccttctttacttgaatgcactttttctaccaaaaaaactattaaataactaatttctataagacatgaataaagacaactataatgacaaacaagattcaaagggtaccctagaacttaaagtataataaaaatatatgtataaaaaaagatttaaagggtgcatcagcagaaacacacactattctgtcactgtttaccctatttcagtggatttaaggatcactgattatacgatgtacccttattttatgtgctactatgagagaaaaaaaattatcaggtaaattataactcagtacttcctcatcacatcaactgcaagacacatgctgatcacagggatgttagagtgaacacaatggaatattactcattgctcacacacctgtcaagatgtgtgatccttgatgggtcctttaactcttctggttatacaatgttgaactatatagcatttgtaagatcctcttatgttctgaaaattctgtgcttccaggtctgtggttttctcccagaactaagatattttggagccctggggccttccaggccacaaagaacaggagctacaggtgggatctgtggtttggaaagactaagaggctccaagcctttggggcagccccttcctcagctctaacaagaaggcaccagtgaaaagacagctttcctccctcagccaccgcctctctctcacccatacctccgttcagggctttttcccacttattcctatttcttggttcctcttttcccaggccagaagagaaagcagcagaaaggaagatcccaggcctttttcttccatctaatcaagacttcaggatggctttcttgcagtcagggaatggttgcctgggtaaccaagtattaactataaggatctccccttctctctttttgctagactaaccattctggtttctccctcctgtctgagtagggagttaatagtaaaaggatttatttaactaggctctggattttataacccttgctggcttccaacagcgaactccaaactgccttttactggaggcttgtcttaaatgaaccagaactactttttctcatctattattttaaacctaattggaacacagcaaagcgaaacaagtttgaaaggcagtcagagtagcttccctatgccatgatttatcaatgtctgaggctagcatattaaaatatagctcttgttttgtaccatcaagattggatgaaaataagaatgcctttagaagggaaagggctttcttaaccaaaatatctaactctactccttatcactgttcacagagtagattattgtatttagttatgtggatgatgggtggggcccaaagaaatagatccggggtctggggtacagtgtggtaaatgcaagcctgaaaagatatcttcagaagaaggtgtgtaacagagggataggggttgtagtaggctgttcttgtattgctataaagagatatctgagactgggtaatttacaaagaaaagaggtttaattggctctcagttctgcaggctgtacagggagcatagacctggcatctgtttctggtgaggcctcaggaagcttatcaggcaggggccataacagcctgcccttctctctggcttcttgttgagtttaatcagtgcaaaggacttgccagggatgagaaagtaggaaagacaaattgagttacgtataacaccctctttccctgctgggttggcagtgactgtttctctgctgaaggccacagctcctgcctggcagaactctcctacaaatacaacctccatgggtttcagcagcttcttcaagcctaggtggtagggggttccccctgtaactagggcatgggtgcttcaccatcccatgttgaattcccttaattccttttataaataaatccttccataaccactttcttcagaattatttatccatgtataagaatgatactgtgattattttttcaagtgggctttaccttttagagatacatcctgaagtatttagggacaaagtgatatttaaatgaagcgtgtttggtcatgatttgataaccgtcaaagctaagagatcatgatttggtaatcatcaaagtaaaagcgttcagggtctttataattttccctctacttttgcacatgtttaaaatttttccatcataaagaaattttttaatgataaaaaaaatgtttaagcacccctttgggagatgctgtttcccatagggacctggactgacacaggagcagaggaggaatgagcagagaatatcagcaagatgaatgatatagtttggataattgtccctacccaaacctcatgttgaattgtaatccccaatgttggaagtgaggcctggcaggaggtgattagatctggaactgaatttctcatgaacggtttagcaccatccccttggcactgtcctcaggatagtgagtgagttcttgtgagatccgatcatttaaaggggtatagtaactcccccctcactctcttgctcctgctctggccatgcgatgtgcctgctccccctttgccttccacaatgtttgtaagtttcctgaagcctccccagaagctgagcagatgccagcatcatgcttcttgtacagcctgcagaaccatgagccaattaaacctcttttctttataaattacccagagtcaggtatctctttatagcagtgcaagaacgactaatacaataacaatggcctacttcataattttgcctggagttagccctaaaagtaaaggctgcaagtgatgtgtttgtggtcctttctgaactgggactagacagtaaaatctcaataattcactgtaattaggaaaacaattcaatctgactcagcaaagatctgtattataaactatttcttaaattcttttgaaacttgaacaatgtattcattcagtttggactggccttcacacacacagactttggagagttccaatcttatttctcagcacaccttgttggaaatctttataaaaacctctttcatagccatcgtaggcagcttttcctcacactatcatagagtacctggccctctctccacttcaaaacactcatctcaaaatttagcttgtttcacctctcctttaaagtctgtcttaaccatattggcccaaaaggaactcttcttagaaattattatctcacctccaccaatccctaggtgaccttgggcaagttacttaacctctcagacctcagttttatcatctgcaaaatgggactaataacagtacttatttattagaatttatatcagtattgaatgagtctgagattggctaatactaggcattcagtcaacgttaggtactatattaccatttattcagcaaatattccactatatacctggttttttctaagtcctgaggatgtaacggtgaaaaacataaagcccctgccctcatggagcttcctttctagcaggagaggcagataataaacatgtaaacagatatatatatatatatatatatatatatatatatatatatatatatatatattcaggtttcaactagtgctaaatgctatggcaaaactaaaatgagtaaaaatgatggaaaatatgatttttggtacagtggactgggatgccctttctaaaagggtgacattttgatgataaaacacatattgaaattagtttttaagctcattttactgcctaaaaagccctcttaaatatatatcaaaagctttcaaatatttgggaatgatatattttccaactcagtagccatgataatccagaatcccaacctgggttggcagactcatcggtggacaagttcacatcgtaaaccttcagcatgcattccaaacctgccttttcctttcattttaaatgttatcttcctcatgttgtcttcctaatactgacctaatttttcaaacatggtgctttgtcaccgcaacttcttcacactgttgacagagtcttctcttgctgccttttcacaaaggtggccttttactttcttcacctttgtttcctaagaaattgcccacagcctgccttacacctttaaactggtttcatgccactgttcagctgttttccttttatatcagagtcactgtcactgaattattccacctctttactccctcttctttattctctttgctgccatatatagccaaagtgaaaggagatcccaaaagaagctgctaactttggggaggtgtgtttttggtactggtaggagtgggggaatcagagaaatctgggcatgggagagttgaagcaacatgatccaagagctctgacatcagttttctgacaatttcaaaatctgtgaataaaataaggatgtgtgttataaagtatcaggagaatcaggaagataaataggatgctttttcgcaagggaaaagaatttctactaatgaaaatcatcaccaatgactcctttgtaattgggttaatggaatgattttaaaacacacacccacctctagctatataaaataatacaggatactttaatcctgagatcctggacttttcccactgtgaagcaataaatataaataaatatcttggcttaacattcctctttacctcctgcttcttctctctggtgattttttttccttcttctttatgcacaaggccccagatcactcaagattagaaaacataaaaggctcagaaattaaattcttaagattaaggaattcacttaagccacataaatttagagcctttctttgccagccaggaactcagcaactcagattaataaacctcgtttctgaagttgtgataaatgaaggccatacaaaatcagccaggttttcagcttgttgcagggtccacatgagtgctgggatggagccatcaaccaaagattggctcatgcacaaaacattccaggagccaggaaaggcggcgatgggactgaacacaaagctctttagtatgtgcaacaattaatgttttaaatattaaaacaaattaatatgagagagaatgttgctttcttataacaaaaactcaatctcatctcacaagttaaaatattacagagaagaaaagatacctgaaaatgctagctttttgcactctcacatccttatggagtcctcttatgaaaatatcctggattgttctagtttaaatttttttaaaggatctgaatatttgttcttaaataacttgtttaaactagtattggtcaccttcaagtgccctctggtgtaacttattttaatcttccagacaatactttaccctgatcaaaggaaaggattctttttttgctccttttgtgtttggattaaaaattatgatctgcaagcatgagttgaattaaattgaaagtttcttcactaagagtaggaaatcactaactctaaaacatccttttaaaatctgggcatagaaggtttagagtctggcttcccagtgtggctgaaggtggaaagtgggggcaatctgcaggcaaaaaggaggcaccctgtctgtagagaatttacaaacataacaaacactttatacaagtaataaagttttaataatgaaactgaccaaaaaccagtctgctccttatcatcatgtacatgccaacaattctaactaatataagtgataaaatgctgttccctccccaccaaaattttgttgtataagttctaacaattgttgtggttactgttgggttttaataatatatatgcaaactttaaattagcacgtttttactgctcatccttttatacaggcatacgttttattgcactttacagatattccatttttcacaaatttaaggtctgtggcaacctttcatcaaacaagtctatcgctgtcatttttccagcagcatgtactcacttgtgtctctgtgtcgcattttgatcatccttgcaatgtttcaaactttttcattattattatatcctttatcgggatctgtgatcagtgacttttgatggaattattataattgttttggggtaccacgaactgtgcccatataaaatggcaaatttaatcaataagttttgtgtgtgtcatcactgctccactgatcagccattcctccatctccctccttcttctcagacctttccttcctattccctcagacacaagattaaaattaggccaattagtaaccatacaatggcttctaagtgttcaagtgaaaggaagcctctcactataaatcaaaacctagacttcatgaaagacctaaaaccatgaaaaccctagaagaaaacctaggcaacaccatttaggacataggcatgggcaaagacttcatgactaaaacacaaaagcaatggcaacaaaagccaaaattgacaaatgggatctaatgaaactaaagagcttctgcacagcaaaagaaactatcatcagagtgaaaaggcaacctacagaatggcagaaaatttttgcaatctatccatctgacaaatggctaatatccagaatctacaaagaacttaaataaatttacaagaaaaaaacagccccatcaaaaagtgggcaaaggatatgaacagacacttctcaaaagaagacatttatgcagaaaacaaacatattttaaaaagctcttcatcactggtcattagagaaatgcaaatcaaaaccacaatgagataccatctcacgctaggtagaatggtgatcactaaaaagtcaggaaacacatcctagagaggatgtggagaaatacgaatgcttttacactgttggtgggagtgtaaattagttcaacattgtggaagtcagtgtggtcattccttaaggatctagaagtagaaataccatttgacccagcaatcccattactgggtatatactcaaaggattataaatctttctactataaagacacattcacatgcacacatatgtttattgcagcactgttcacaatagcaaagacttggaaccaacccaaatgcccatcaatgatagactggataaagaaaatgtgacacatatacaccatggaatactatagagccataaaaaagtgtgagatcatgtcttttgcagggacatggatgaagctggagaccatcattctcagcaaactaacacaacagaaaaccaaacactgcatgttctcacacataagtgggagttgaaccatgagaacacatggacacaggaaggggaacatcacacacgggggcctgtcgggtgggggctgaggggccaggggagggatagcattaggagaaatacctaatgtagatgacgggttgatgggcgcagcaaaccaccatggcacatgtatacctatgtaacaaacctgcacgttctgcacatgtactgcagaaactataaaaaaaaaaaaaacctctaacttttaataaaatgttttatttatttctatgtggaataaaaatcaaaaataagccaggaaaaaaaaaagctagaaatgaggaagcttaatgaggaaggcaaataaaaagctgagactggccgaaagctaggcctcttgcactaaacagccaagtcgtgaatatgaagaaaaaattcttaaggaaataaaagtgctacccagtgaatatatgaatgataagaaagtgaaacagcattattgctgatatggagaaggttagagtggactggacagaagatcaaaccagccaacacattcccttaagccaaagcctaatctacagcaagatcttaactctcttcaattctatgatggctgagaaaggtgaggagccagcagaactaaagtttgaagcagaggctggttgatgaggtttaaggaaagaaactatctccaaaacataaaagtgcaaggggaagcagcaagggctgatgtagaagctgcagcaagttatccagaagatccaactaagatcattgatgaaggcagctacactaaacagattttcagtgtagctgaaacagccttctattggaagaagattccatccaggattaactagagaggaaagctcaatgcttggcttcaaagtttcaaaaggcaagctgattctcttattaagggctaatgtggctggtaactttaagttgaagccaatgctcattgactgttttgaaaatcctagggcccttaagaatgatgttaaatctacattgcctgtgctttataaatgcaataacaaagtctgaacaacagaacatctgtttacagcatgatttactgaaaattttaagcccactgttgagacctactgctcaggaaaacagattcctttcaaaatattattgttcgtagacaatgtaactggtcacccaggagctctgaaggagatatacaaggagataactgtgattttcatgcctgctaacacaatatccattctgtagcccatggatcaaggaataatttcaattttcaagtcttattgttaagaaatatattttgtaaggctatacctaccatagatagtgacttctctaatgaatctgggcaaaatatgtagaaaaccttctggaaaagatttaccattctagatgacattaaaaacatttgtgattcatggaacagacagttctcaaaagaagatatacaaacggccaacaaacatgaaaaaatgccccacccacatcactaatgatcagggaaatgcaaatcaaaaccataatgtgacaccaacttactcctgcaagaatcgccatactcaaaaaatgaaaaaataatagatgttggcatggatgtggtgaaaagggaacacttttacactgctggtggaaatgtaaactactaaaaccactatggaaaataatgtggaaattccttaaagaactaaatgtagagctaccatttgatccagcaatcccactactgagtacctacccacaggaaaagaagtcattacataaaaaagatgctttcacatgcatgtatacagcagcacaatttgcagttgcaaaaacatggaaccagcccaaatccccatcaatcaatgagtgcataaattgtgatacacacacacataccatggaataccactcagccataaacatgaagaaaataatggcatttggaccaacctgaatgggactggagaccagtagtctaagtgaagttaagtcaggaatggaaaaccaaacattgtatgttctcacttataagtgggagctaagctatgagaacgcaaaggcataagaatgatacaacggactttggggactcaggggaaagggtgggagaagggtgagggataaaaaccacccactgggtacagtgtacactgctcgggtgatgggtgcaccaaaatttcagaaatcaccactaaagaacttattcatgtaaccaaacaccatctattcccccaaaaacatattgaaataaaaaaaatgaattaaaaaaaccattcgtgactcaggagatcaaaatatcaacattaacaggagtttggaagaagttgattccaaccttcatggacaacttggagaggttcaaaactttggtggagtactgcagatgtgatgcaaatagcaagagaactagaattagaggtagagccttaagtatgactgaattgctgcaatctcatgataaaacttgaacagatgagaagtcgcttcttatggatgagcaaagaaagtggtttcttgagatagaatctattcctggtgaaaatactgtgatcattattgaaatgacaacaaaggatttagaaaatgacataaacttaatttataaagcagcagcagggtttgagaggatggactctaatttttgaaggaagttctaacgtggataaaatgttgtcaaacagcaaagcatgctacagagaaatattttatgaaagagttaattgatggggcaaacgtcattgttgccttattttaagaaattgccacagccatcccaaccttaagcaaccacgaccctgattagtcagtagccatcaacatcaagtcaagactcactgaagccttagatgatcattagcattttttagcaataaatttttaattaaggtatgtacattactttttagacataatgccattgcacatttaatagactataatatagtgtaaacataacttttatataaactggaaacaaaaaattttgtgtaattcactttattgcaatattcactgcattgtgatcatctggaaccaaacccacaacatccccaaggtatgcctgtatatattataatctacaagtaagctaattcagagaaatcccagttatacagctgactccagacacatgcagtcttggacacacacatatgtgttccataagcaagtttgtgaaggtttgggaatcattccagctcacttcgaaaaaacttatgatactccatattctgacatttaaacagaagattcaaaataaataattataggatattacttgcaaaaaaaaaagaaacaagtaaattcatcattccacatgattaatggaatttttgtttttaaaaatgtaaagtgacgaaatgaagtacagaatgtgagatgtagtatttttattggtaagtgtaaactttatacatgattttgctaaactttaataatatctttaaaattgatatttcttttgttattcttgtgattatttaataaactttaatattatttattactgtcataaaccaataattggttctttccctttgtgcaaaaatttatactaatgtaattaaaattaccaatccattacttttttccttttatgtacataacattttttatgtttctttactttttaaaagcataattatatatatgaagtccagtaaaaaatttccacaatttggctgggtgtggtggctcacacttgtaatcccaggcctttgggaggccgaggcaggtggatcatttgaggtcaggagttcaagaccagcctgaccaacatgatgaaaccccatctgtactaaaaatacaaaaaaaattagccaggtgtggtggcacatggctgtagtcccagctactcaggaggctgaggcaggagaatcacctgagcccaggaggtggaggttgcagtgagccgagatcatgccattagcactccaggctgggtgacagtgcgagactccgtctcaaaaaaaaaaaaaaatccacaatttgtatttcctttatggccattattatgcatattatatattattcatataaaataatttttaagataattttgtcacctaaaggaaggaggattaaaacgttatgtgctctgagtgcaaacatgctttgtaccaacatgctttctggagttttctcagattctttgactttcttactttttgtctcatacaagcttgcatcaaaattgtgagctggcttaagatggtggattataggaaaactagaagaaaacacttcctagaaaggaatagaagacaagtaactaacatgcatttattcgcccctttattcattcaacaaataactattaaccatctaccaccataccaagcactggtctaggcaccaggaatattatttcatgccgtctggaaggttgccttttaatagaaaaacacagacaaataacaaacataatgaacaagtaaattatgtaatatgttagaatgcagtaagagctatagaaaaaaataatgaattcagcatgataaacgagtgccaggacattggagttttaatagggtagctattggttattgggaaggtatcttttgatcaaagacttgaataagttgagaattagccatgtggacatctagggaaagtgtattctgggcagagaaaaccaaccagagcaaaggtcatggggaaggggcatgcctggatcgttccaggaaaagcaagaaggacacgaagcagagagtgaaagggaaagaaaggagtagtagatgaaattagagaggtcaggaggatcagattgtacagagctttcttaaacctttaaaacgactttgtcttttactctgggtgaaacagggaaccactgcagggctttaagcagaggaatgacatgatacaactcatgatgtttaaaacagtggccttagtataagtgggttgactaccttaaaagccctccaatcttcctggagcgatatggggtggcccacctaagacatctgtccccattcatcaccaagattgatccgtctgatctgactgactaggagtaccattcttccctgccttcttgccttgcatcgtcctaaaggcgcacacctggtcaaccctttcagatttaggagaggcattcttcaggtaagggtctagaggtgctacctgatgctaaaactttgaccatttgagattatttttcacctactatcttcaagactcttctgtaaaactataaattgctcttgaattcttaacctatgaaaactgactttttgatataaattaaattagcccttaaccgacaattaagcagataactgacaggtgggaatgaacaccagaaacattcacagcaacacacacacgcacccctagacctcaatatttagatattcatcatacatacattttctatccacaattgactacaatgctaatagttctcaaacgtacacaagatgtacgtaatgtcctgtccatttgtttccctctttcactgtcataactgaacagggattattggaggatatagtgaaaagaagggcaaactcagatgttgtgcatggcagccatgctaggaagtaggaaaagtagaggcaagaagacccctggagaaagatttgtctgcctaaagtttgaaccaaagccagcttctacctcaggccaacccattctctgaacagaaggaaaggatgcttcctgaggtactgacctggcctatgaactttaccctcaggagagctgaccaaaggatgtctcctggtagcctaattggtcctcttggtcctcaaattctcttttttaaaaactattacattcattctacctatgcgttttttcaataaattgtattaatatttcttagtcacaatagaaggcttttaacttctcaattatttttcagtctcttccaagggtagtactatcagaagcaagatgaaaagcatcaaggtgggtaccaatttttacccacacttagcaccaaaagttgaatttgaagctaggattgggcaaatacaagaatgactatttcctaaccatgtataaaaagctgtttcaaagttttctctgatgttcataaacatcaagtatcttaccagtaatcacagttctaagctggtaattttccagtacgtaggcttccatacttctgaagcctacatgtgaatgcttatattacaggtgcttctttcccttaaggtagtcacttatgggaacagcttatggacaaacagggagcttttgtgttgagtgtaatagatcagcctctctttcataaatgacagcttctacccagattagttttataaggagatggcaactccctatttgatataattttacatgcactagaaagttttccttgactccatcactcatgaagcttacccacctaatgaaaaaaatgtctaatgataaaattagacagcatgcaagaacagatgactaatgtaaccaaaactatgaaaagtcttagaatctaaaggagatgctagagatcaaacactaacagaactgaatatgccttttatggactcctcagtagactgaacatggctataaaaagaatcagtgagcttgaagatatgtcaatataaacttcaagaactaaaatgcaaaaagaaaaaactatagtggaaaaaacagaagaatatattaaagaactgtgggacaatttcaaaaagtgtaacatacataatttgaataccagaaaaagaagaaaaagtggagcagaagaaatacttgaaagtaatgacaaacacaaaaccacagatccatgaggttcagagaaaagcaggataaacacttaaactacttgtaggcatagcatatgcaaactgcagaaaaccaactacaaagagaaaaccttagaagaagccagaaggaacaaacactttacctatagaaaaacaagtttaagaattacagcagacttctcatcagtaccatgcaagcaagaagagaatgaaatgaaatatttaaagtgttgaaagtcaaaaatcaccaacctggaaattctatatctagcaaaattgttcttcaaaagtaaaagagaaggacttccttcatgcaaaaaataataataactaccctgagggaattcattaccagaagacctgtaatgcagaaattttttaaaaaacattatttaaggggaatgaaaatgatataggtcagaaactcaaatctatgtaaaggaaaatcaatacagaaggaataaatggagatacaatcatctgataactgtttacttaaaataataatagtaacaatgtattggttgattatagaatatgaataagtgaaatgaatgacagcaatgtcataacagataggagggagaaatgagggatactgttatgagtaagaacctgaagtgcagatgcaatggtagagtgttattagaagctggatatagacaagttaaaaatttatattgcaaactctagaccactattaaaaaaatttttaagaaatgtaattgctaggaaaggagataaaataaaatcacatgaagtgctcaattaaaaacagacaaggcaggaaaatactggaacaaaaaaagaaacaaatgcaattattataaaacagatatgaacatggtagatatttatacaactataccaataatcactttaaatgttaattgtttaaaaacacaaggtaaacaaaaaggttgtcagagtagattgaaaaaacaaggtccaaatatatgttgcctaccagaaactaaatattaaaaactcaagtgggatcatcatggcagacaggaggcaggactagattacagctccagagacagcaacgtacagaagctcacactgtgaattttagctccagaacgactgcaattacaaaccaaaaatcccaagaggacccacagaccctctgaaggaagtggactgctcctgcaggacctgggagacaccccaaatactgtgagtgccctaactgcagaaatgggaaaaggagactctcctctcacagggctccatgcagacaacccccagtaccagtccagaccctcaatggagaagctgaaggtctgtttgtgggagaagtttccaactttacctggagctgagtcaatttagagaaccaagtgaaatacaggggagaggaagcagcagaaaggccttgggagcttgctgtgtaccctagcagcccattcctgcctggcaccacagggatccattgggagggtgaccagaggagcaggggataaactccacaggaggaagaaaatctctagctgaactttgtaacaatttgaagggtgggaagcctcctgctcagaagtcacgggagggtgcaaatctggtgtgcagactccacaggcaggggaaaaaccaagcccttttctttcgcagctgggaggtgggtagcccagtgcaagttttctagcctgtcacaccctccgccaggaaacagactcggggctactgggggtgggggcacagtgggagtgagaccttcagtttatgtgggatctggatgaggtctgtgactgctggctttcccccatttccctgacaacctgcatgactcaggagaggcagccataatcctcctaggtacacaactccagtgacctggaaatctcaaccccatcctccacatcagctgcagcaagacctgcccaaagtgagtctgagctcagacatgtctagccctgcctgcacttgatggtccttccctatccaccctggaaacagaagacaaagggcatataatcttgggagttctagggcactgcccactgccaggccctctccatactactacagctgatgctttctggaaagtgtcacctcctggcaggaggccaaccagcacaaaaatagagcattaaaccaccaaagctaagaaccctcacagaatccattgaacacccctgccacctccacctgaacaagcactggtatccatggctgagagacccatagatggttcacatcacagggctctgtgcagacaacccccagtaccagtccagagctgggcagtctcacggggtggctagactcagaagagagacaacaatcactgcagtttggctctcaggaagccacatccacaggaaaatagggagggtactacaccaagggaacacctgtgggacaaaagaatctgaacaacagcattcagccctagatcttccctctgacagaggccacccaaatgagaaggaaccagaaaaccaaccctggtaatatgacaatacaacgctcttcaacacccacaaaaaaatcacactagttcaccagcaatggatccaaaccaagaataaatccctgatttacctgaaaaagaactcaggagtttagttattaatctaatcagggaaggaccagagaaaggtgaagcccaatgccaggaaatccaaaaaataatgcaagaactgaagggaaaattattcaaggaagtagatagcttaaagaaaaagcaatcaaaaattcaggaaactttagacacacttttagaaatgtggaatgctctggaaagtctcagcaatataattgagcaagtagaagaaagaaactcagagctcaaagacaaggtcttcaaattaacccaatccaaaaaagacaaagaaaaagaataagaaaatatgaataaagcctccaagaagtctgggattatgttaaacaaccaaacctaagaataattggtgttcctgaggaagaatagaattctaaaaccttggaaaacatatttgggggaataatcgaggaaaatttccttggccttgctagagacctacacatccacacacaagaagtacatagaacacctggaaaattcatcacaaaaagatctttgcctaggcacattgtcatgaggttatccaaagttaagaggaaggaaagaaacttaagagctgtgagacagaagcaccaggtaacctgtaaagaaaaacctatcagattaacagcagatttctctggagaaaccctacaagctagaagggattcagtctcctcaaacaaaacaattatcagccaagaattttgtatccagcaaaactaagcatcatatacgaaggaaagatactgttgttttcagacaaacaaatgctgagagaattcacctattaccaagccaccactacaagaactgctaaagggagctctaaatcttgaaacaaatcctggaaacacatcaaaacagaaactctttaaagcataaatcacacaggacctataaaacaaaaatacatgttaagaagcaaaacaaaaagcaaaaaaatcaaagcatacaggcaataaagagcaagatgaatgcaacagtacctcacatatcaatactacattgaatgtaaatggcctaaatgttccacttaaaagatacagaaccacggaatggataagaactcaccaatcatctgctgccttcaggagactcacctaccacatacagactcacataaacttaaaagggtagaaaaaggcatttcatgcaaatggacaccaaaagcgagcaggatagctactcttatatcagacaaaacaaactttaaagcaacagcagctaaaagagacaaagagggacatcacataatggtaaaaggccttgtcccacagaaaaatatcacaatcctaaacatatatgcacctaacactggagctcccaaatatataaaacaattactaatagacctaagaaatgagatagcaacacaataatagtggagacttcaatactccactgacagcactagacaggttatcaagacagaaagacaacaaagaaacaatggatttaaactataccttggaacaaatagacctaacagatatatagagaacgtttcatccaacaaccgcaaaatacacgttctatttaatagcacatggaactttctccaagatagaccatatgacaggccataaaatgagcctcaataagtttaagaaagttgaaattatatcaagcactctctcagaacacagtggaataaaactggaaatcaactccaaaaggaaccttcagaaccatgcaaatgcatggaaattaaataacctgttcctgaatgagcattgggtcaaaaacaaaatcaagatggaaattaaaaaattattcaaactgaatgacaataatgatacaacctatcaaaacctctgggataaagcaaaggcggtgctaagaggaaagttcataaccctaagcacctatatcaaaaagattgaaagagcacaaactgatattctaaggtcacacctcaaggagcaagagaaacaagcgcaaaccaaacccaaacccagcagaagaaaggaagttatcatgaaagatcagagcagaactaaatgaaattgaaacaaacaaacaaaaaagataaatgaaacaaaaagctggttatttaaaaagataaataaaattgatagaccatcagcaagattaaccaagaaaagaagagagaaaatccaaataacctcactaagaaacaagacaggagatattacaactgacaccactgaaatacaaaagatcattcaaggctactatgacgcatttacgcacatagctagaaaacctagaagagatggataaattattgtaaagatacaacccttctagcttaaatcagtaagaattagataccctgaacagaccaataacaagcagtgagattgaaatggtaatttttaaattaccaacacaaaaagtccgggaccagacggattcacagcagaattctaccagacatccaaaaaagaattgttaccaatccttttgacactattccacaagacagagaaagaaggactcctccttaattcatcttctgaagccagcatcaccctaataccaaaatcagaaaaggacctaaccaaaaaagaaaactacagaccgatatccttgaagaacattgatgctaaaatccttaacaaaatactagctaaccgaatccaacaacataccaaaaagataacccaccatgatcaagtgagtttcataccagggatgcagggatggtttaacatatgcaagtcaataaacacaccacataaacagaattaaaaacaaaaatcacatgttcatctcaatagatgcagaaaaagcattcgacaaaatccagcattgctttatgattaaaactctcagcaaaattagcatacaagggacataccttaatgtaataaaagccatctatgacaaaaccatagccaacataatactaaatggggaaaagttgaaagcattcactctaagaactggaacaagacaaggatgcccactcttaccactcctcttcaacatagtactggaagtcctagtcagagcaattagacaagaaaaagaaataaatggcatccaaatcagtaaagagaaagtcaaactgtcactgtttgctgatgatatgatcatttaccttgaaaaccctaagaactccttcagaaatctcctagaactgataaaagaattcagcaaagtttccacatacaagattaatgtatgaaaatcagtagctcttctatacaccaacagcaagcaagcagagaatcaaatcaagaacccaaccccttttacaatagctgcaaaaaagaaataaaatacttaggaatacacctaaccaaggggtcaaaagacctctacaaggaaaactacaaaacactgttgaaagaaatcatagatgacacaaacaaatggaaacacatccatgctcatgggatgggtagaatcaataatgtgaaaatgaccatactgccaaaagcaatctatacattcaacacattccccatcaaaataccaccatcattcttcacagaattagaaaaacattctaaaattcatatggaaccaaaaaaagagcccaaatagccaaagcaagactaagcaaaaagaatacatctggaggcatcacactacctgatttcaaactatactataaggccatagtcacccaaacagcatggtactggtataaaaataggcacatagaccagtgaaacaggatagagaacccagaaagaaacccaaatacttacagccaactgatcttcaacaaagtaaacaaaaacatcaagtgggaaaggacacccttttcaacaaatgatgctggataattggctagccacatggaggagaatgaaactggatcctcatctctcacgttatacaaaaatcaactcaagacggattaaggactgaaacctaaaacctgaaactataaaaattctagatgataacattggaaaaacccttctagacattggcttaggcaaggatttcatgaccaagaacccaaaagcaaatgcaataaaaacaaagataaatagctaggacctaattaaactaaagagcttttgcatggcaaaagaaactgtcagcagagtaaacagacaacccacaaagggggagaaaatcttcacaatctatacatctgacaaaggactaatatccaaaatctacaatgaactcaaacaaatcaataagaaaaaaacaaacaatcccatcaaaaagtgggctaaggacataaatagacaattctcaaaaaaagatatacaaatggccaacaaacacattaaaaaatgctcaacatcactaatgatcaggaaaatgcaaaccaaaaccacaatgtgatatcatcttacttctgcaggaatggccataatcaaaaaatcaaaaacagtagatgtcagcatggatgcagtgaacagggaacacttctacactgctagtgggaatataaattagtatagccgccatggaaaatagtgtggagattccttaaagaatttaaagtagaactactatttgacccagcaatcccactactgggtatctagccagaagaaaggaagccattattcgaaaaagatacttgcacatgcatgtttataatggcacaatccacaatagcgaaattgtggaaccaacccaaatacccacaaatcaatgagtagataaagaaagtgtggtgtgtgtgtgtgtgtgtgtgtgtgtgtgtgtgtgtgtgtgtgtgtgtgtatagacagatatatgatggaatactatgcagccataaaaatggataaattaacagcacttgcagtcacttagatgagattggagacgattattctaaatgaagtaactcaagaatggaaaaccaaacaccatatgttctaactaatatgtcagagctaagctatgaggacaaaaaggcataagaatgatacaatggactttggggacttggggggaagagtgggagggggactagggataaaagtctacaaatatagtgcagtgtatactgctcgggtgatggatgaaccaaaatctcacaaatcaccactaaagaacttactcatgtaaccaaataccacctgtactccaataacttatggaaaaattaaaataaataaataaaagctcaaatatgttaaaagtaaagggatagagcacatatcattctaatgctgaccaaaaggaagctggaataactatattaattttagacaaattaaacttcaggaaaaatacttaaataaaggcattgcagaaggtagacaagtatccacaaagacataataatccttaacatgtatgcacatcttctaaagctcacatggaatactaaccaagatagaacattatggatcaaaaaacacattaacaaatttaaaagaatagaaatcatactaagtatgttttcagatcacaacagaactaaactatagatcaaaatcagaaagacaactggaaaatagaaaaaaatgaagattaaacaacacacttctaaataacacatggaatcaaagcggaagtctcaagagaaactgaaaatattctgaacaaaaatgaaaacatagcaccaaaatttgtggtattcagtaaagtagatctaaaggaaaattatggcactaaatgcatatgttagaaaagaagaaagacataaaatcaatagtctaaactttctctaaaaaaaaactagagaaaaagaacaatttggaagcctgtaacaaaaagaaacacaataaaagtcagaatataaatcaataaaattttaaacagcaaacaatagacaaaaatcaatgaaatcaaaagcagctctttgaaaagctcaataaaatttataaacctctagttaggctaaccaagaaaaagagaagacacaaattactaatatcagaaatgaaagaaagatcatcactactgatcacatggacattaaaaggataataaagaaatagtacaaacaactctctgcccacaaattagataaagtgaaccaattcttcaaagacacaactaccaaaagtcacaaaaggaaaagtagataatctgaagaggaccatatctaccaatgaaattgaatcaataattaacaaccatcaaaacaaaagcaccaggctcaaatggcttcactggtgaattctaccaaaaatttaaggaaaaaatgatacaatttccactatctcttacaggaaatagaaataattcctaactcattctatgagtccagaattaccctaacaccaggagcaaataagaatattacaagaaaggaaaactatagatcaatatctatcatgaagataaatgtaaaaatcctcaacatattagcaaatcaaatacaacaatatataaaaataattatacatcatgaccaagtgagatttattctagctaggcaaggctgttttaatatttaaaaaccaatgaatgtaattcaccacattaacaggctaagggaaaaaaaagcaatattacattacttggtacagaaaaggcatttgacaaaatcctatatccgtgtataataaaaattatcagcaaactaggaatgcagggaaagttcttcaacttgataaagaacagctacaaaacacttccttacttaatagtgagaaaccagtaactctctaagatcatgaacaaggcaaggatgtcccctctcaacagtcctagttaacatcatactggaagtcctaattaaatacataagacaagaaaaggaaataaaaggtatacagattggggaggacaaaattaaattgtctttattcacaattttctctgtgcaaaatcccaaaggataggggaaaagttcctggaattaatgagtgagtatagcaaggtcactatagaagaatagaaggttaatatacaaaagtcaattgctcttctatataccaaaaatgaccaatttgtatttgaaatgagagaaaatacatttgcaatggcaccccaaaaatgaaatacttaggtataaagtctcagaaaatatgtataagatctataagaggaaaactacaaaactgataaacaaaatctaaataaatggagggatattccattttcaaggataggaagactcaatattgttaagatgtcagttcttcccaacttggtctataaattcaaagcaatccaaatcaaaatcccagcaagctattttataaattacctgattctaaagtttatccatttaagttttaaacctagaataatcaacagaatacagtaaagtaagcttgaacgacacataataggcaatttcaaaacttactataaaggcacaataatcaaggcaatgtcgtattagcaaaagaatagacatatattactagataaatggaacagaatactgagctcagaaatagacccaaacaaatataatcaactgctctttgacacagaagcaatggcaattcaatggaaaaagagagtattttcaacaaatgccatgggaatatttggatgtttatatgcaaaaataagaaaaataacttagacataggccttatacctttaacaaaaattaactccaaacagaccataaactaaaatataaaatgcaaaagtataaaatttctagaagaaaacataggagaaaatttaggtcaccttgagtttgacaacgaatttttagatacaacaccaaagcataatctacgaaaaaaaattggtaagttggattttatgaaaaagttcattccttacccaaatgaccacccatgtactgggctcagccaagttcatcagctcaggtgtcaatattgtttaagagaacttgttgcatttgggagattaagaaggaagagatccaggatccctggcaatgtagtatccaagaaataggtgatcccagcaagaatctatgtatacaatttggtgtgagtaatctttcacttggccacaaaaaattttacccacttaatcatctgaataaatttctatctctcatcctctttctcattaagtatgcattactatctatttcactagggtattttgtgacttaatagtgtgcactgatttgagccttaacaggggaaagagctaaacaaaattctttatgtatgtatttgtactatggagaatacagaatcatgataaatatgcaataacagtataaaacaaaaagagctttaggacagacagatgaaggaggtgatgtggagaacagagacacagacattgtataaaccacggctaaagagataactagggcagatatccaggcaagaaaaaccagttagatcagttgtaaatcaaatatatttaactattaatgtcttggtggggtgaggggaaaatgaccttatattttgattagacatggatacatatgaatgttcaaaccaagacttgtagcaggtattgctagatattatccattgcctcttcagataacactttctaccttgtgtccaatctgccccagcagtctggcctttatggtctacattaagggatcccttcactctggcgtcccaggaaggccaagtggcaggagagcagaaggcaggaagagagtgaagcaagagtatttatcttttgaactccctcccttctgtgctgtggtggatgatggctgggttccttccccaagttcctagcagatagcctctcccagctgccttctgctcttgcaccacccctcattagcttttcttgaccttgcccacatctttgaaactgttccttagtttatttctcttcatctgttacctacctaaactcttactgataaaagcataaaacgtgtacaaagagaatatgaaatgtattaatttgctgatgagagcttttcagttgtaatgcaagagatcttatgggaaaaatagtgtaaataggatgcacctgctctgtggagcctactctgaaccccagaagttggttatgccttctttgttctccttgccctttacacatagcacatcattattgtgggactgtggtggacatgaaagaacttagtcaaagggacctcatgtgggaagtgtttcatgaggtgagggatctgagaaataaaggaatccctaaagttctggcagttggagttatatgaactcagtcacctgaggttggcttccacagttgtgaacaaccaagagacagcaagtgctgcacaattcagtgaggcccctcttaccttcaatgcatccatctcctcagacagtgagagcaagatacacatctgtagatctcctactctagttgagaatacacaataagaacatagtgtttattaatgagcccagaactgccttcttcctagtggtattccctgacaaagacaagtacaagctgtttaaaagaacatcgtttaatatcaaaacatctaggttatgataaccccaacactacacaccctgagacattatatgtatatgtatatgctttttatccccagtgccaaaacaaaactattttgagagaggatttacttttttaaagaattctcatgtcaaagcaagcaggagtggttttttaacatctaaattgaaataagaactgcatgtctgtctgcatagtttaagtgagtctccaatccctgaagtcagaacattaaattcagggtttttcatacaaatagcaaacaggagttcacccagataatctccgaagctaccagctaagaggccataactggcactaactcctttgtcacatacgcgcatttggtgttctcagctctcctcttaatcactaactcctggctctttctctgcatgatttttgggcatgtccctccatcacggcctctgctgtgtcaggtctaccattatagaccttggagcccatggttcctgttctcacttccttgactcctttcatctttccacccaagaataatttttctccaatacaatatctttatatcatcttcctgttcaccaggttcaaatgactgaatgtactcagacctgttttctcatctgtaaaaatgatactacaatggggctgaaagaatcaaaggtctcttttatctctgatctcattattcctccaccgaactcatttgatctcatgtaacaatcttttttgtggttggccccttgctgtcagccactcttcacacattcatctaacaaaatttactgagtgcctgcaatggaagaacacaagtgctaggttctagaaataaaattaaaaattcctttctttgacatgcaatagcagttatcatttctgagcacttctacatggagtatttcaggagggctcattgtatcctcacaataaacttatgacagaagcattattgataactccactttatagatgagaaaactgaaacacaggttaatacatggcccaagtcatataactagtaagtgactgagccaaatgtcattggttctaaatgattatgcctctgaaataattacagtgaaaagttcttaaagacattaataaaatactgaacaggaagatcttagctttgctgcagtttctaggatgaagggctacttgagctccaagaagctttccacccctaccccatgccgatgccatgccccatctggagcactcatcacatagtctcagccaagtcatttccatctcaagcattgtgcaaaagacaaacactcaccttgaaaaaaaccatcttcaatgaatggactgccatctgtgctttattattttgtacataagattgttactttgtacatatactacatttgacataattttttttaacttgttctcatgccatgcttaatctccccaaccaatctatcaagaacacctccagccaagcctggtatagtgcttatcaaatagcaagcaaagcttgttaataaatcaagcaattcactttgtccagggagtcaaatccaaaccctccagacaagtttgatgacattcactaaccttgacctggcagagcctcccccatcaatccaccagggctgagttgacaacaattctcctccaatcagttctccacactcctatccctgtgacttttatcttgtattaaacgatcacataaacactgagcctccaaagcagtgaaaggaacttttattttctcatggtttccatctcccagcttcttctattgtatcgtaaatccaaaactgccataaaagttagaagcttcagaagtgtcttttataggaatttggattgtagtcaaacatctaccctcagtgttctctttccagtgtggcatttcctccctaccacctaatacaagtatacacagtatggtaggaagacctgcagacctaagcaggtttgagctatttttccatcactcatcattacaaatgtgtttgtgttttcactgtggggtattcttaaaccctgctgctggtgatgctttctgtaaacagtaattctcaagtgccttattgtgaatacaatgagtcatctccagtgcagagaagtggctttatttaggactggccagagggggatgggcatcattatattcagtttgatagaggatctgcagaattctctcattgccctgtacagcaggtccagtttctttttcgttctcctgatagaaggactgtacgcctaaatattcagcacatatccccaaattgatgttttacctaaattgtttcttaattggctcaaattaagtgcattttgcaaatcctccctcagtctagtctgtggcctaatgactgtctgacataggaagcactaaatgtttagttaatatttgctgaacaattaaaaaaaggaaaaaatagaaacaaaggaaaggaggtaaaactgataactgtgggtgaaaagaagtcaaggtcaaagcctgcatctctgtctggttcatgaacaactgagccttacagggttaaaactattctgtgacccccaggagccaatcagtcccctcaaatttatactgttaggagaaccttttgaaagaaagcaaccagcttacagcaactcatccccactgctggaaaaatacaagtcaacatattttgacctctgatggtagagccgcaaaactaatgtatcagatatctacttccataatagtactgcataacaaagagccacaaaaacctcagtagcattcagcaataagcatgtattgtttatgcctgggccagctgagggctggctagatggctctgctaatcttggccagacttgttcacgtctgcagtcagctggcagttagctgatatcagctggccttggctggggaaacagggattcctctgccctgttccacgtatctctcatcctctagagcaggctatgcagacatgttgtcatggtgatggaagagaagcttgccactagaaatacacaagggctcttgaggtctaagctcagagctggtataccctcatctctacctcattctagtagccaaagcaagccacacagcagagcccaggaacagagaattgttaatatgtcctgcctttggagttcgagaccagcctgaccaacatggtgaaaccccatctctactaaaaatacaaaagttagccaggtgtggtggcacacacctgtagtcccagctactcaggatgctgagacaggagaattgcttgaaccctggaggcagaggttgcagtgagccgggatcgtgccattgcactccagcctgggcgacagagcgagactcggtcttaaaaaaaaaaaaaaatgtcctgccctcagtggaaatgaactgtaaagttaaatggcaaaggaagtggtacagggagagatggagaattaagaccagtgatgcagtctaccccaggtatatttacataaaaataaaaagcagagtattatgaatttatgaattgcaaagatggaacccatgcatatttatagattctgaagtaaccaaactaaaagacagtgcttattttttctaataaatatctagctcagacattatttttttaactcattcttattgtcattataattagttaaatattagcttgaggtaaaaaaaatcatgctgtgaatgaattgatttctttcttctatgggtattctttagtcaaatggtctggtaaaacacttttatgagctactaaaagctttgaacgtttatgtaagtctatgacaacagtacatttttccaatttttacagaggagaattaaaatatcctatctgatataacaaggattatgaatagattaaaaaattatttcagtattttaaatttaatactctcatttaacaggtttgacaaaatgaaaagtattagattctgattcctagatttgtatttctcatctgattcaattatgtaagcttatattttagaaatgccaactcctttacatcagggccaagactaaataactctgcaatatcagaagaagcgtcacattgaaagaatgctgaaatgaaattacatttcatctctacaaaagtcagagtctctatttctgggttcaatgcatttgacagtttaactacctacattgtttttatcatataaaaaaggagagtgttttaatttcaatcccttaaccttctagcaatgaaatagttccagagaatataatgaatataaaaggggtcagtgttcaaattatattcatttatagctaattggaaagtttcttttgttgctgaagaccaggacctttttcctgtctatctgctagtgactatcactctgatgccttaatcttcaagtggacattctcttcattcagtgcaattatagtaacctgaaaggtaatgtagtctcataagagatatgccatcatcacacagatttatgggcagaaccacatccataaaatttagaaaattgcttgtgtactaccagcctattttgcctgttaatataaataatattttcaacattagctaccaagaggacaaatttctcataactgactttctgcttaattctgtcagataatctctgctgtaatatgatgaagaatatactgtgaagaatttctgacaagcttcgtttttctagggtgttttgctgaagaggcccaatctgttgtttatttggggctggtaccgcattaaattgatttagggacaccattttccatttttctatcttccatgctctgttaacttatgtcatatttattacaactcttggttttgcatgtatgtttcaatttgtggtagcaaactgatgaaacacgtttctccccttttttgtaaaatggtgtttaacaactgctactcctattaatgtattgccaccttataagtaaactcaacatgaagagatctacacaatattctgattaagaaattctacctggggcacagaatatatgtgaaataccttttcaaataaaaacttggaggaagtaaacagagcaaatgcataaaagaagaacatatgttttatgctaccaaattatgcatcattattttgaatagctaaccaaagtttgttacagatactaaagcttcgtttaaattttagtccatttgcagtttgtcattgttgtttaaaattcctcaggcaggggtgtgagtggaggaagttacttctctagggagatgaactctaaaatcttgtttctgggagatactgcaatttgtggtctcagattctagactattccaaagaaagctctctgagctcctgtgtgttaatttatgacatatctgctctcacccgataggtttgtgctttatcacgagtctcagggagcccatcagggctcacaaaggaaagaagtctgagacacataaaaaatatatgactccaagccagggagcactttacgttgtacacagcaaaggaacccctggtaccactgaacatgaaggtcatgttctacgcaagtacaaggactgggctgccatccttacattcttcatgttattaaaacaaaatgtctaatcatgcctgaagctgcccaaagccttgttggcgaagagatatcaagctggaacacagcaagtccacaccttctgctttcacccactcccactttctgtatgcacactctgaccctgctctggccagactgacctatttatccccttcccctaaaggtatctcatgtttcccaccttcaagcctctccacacctatattttactcatcttttaaggtccaatttcttagagtactccaaatccaaagtcagtgcgatctccagagagaaacaatacttttaatttctctactgtccatatagctaccataagacttatgtaagtattcactgtttccctaatagattacacattttctaaggataaaaccatatttgaatgtccagttatgctcctaagtggctaacattgagccttactcaaagtaaatgcataacacaaatttgtttttatgcttttaatacatgttggtatttttaatatttttcttctcgacaaaagaacacaacatcatcatacatacaaccttcaaacataaatgagaatgtaaaagccataacctccatcaatgtccaatcaaagtgctggtcaatggaagagagagtttacaccattgacccaagcatatgtttcaggctgtggtgaagcttgaaattttcatatcatttatttgctggatgacccaattaggtcaaaacctacttttctttattggaatgaatcccctagcaggtaggtcaactccgcaggacaaagcttctaagcaaatgtgaggtcggttaattctcatatcaactctaatttgcagcaagactcccatggcatttcaagaggctttgagtctttctgaggcttaaagagtgaggtagtagcttcttttgagcaattggtaatactttgggtcaagaacggtagctatggaacatatcctaataatcaccttctcaaatgttacagagtcttgcaagtgacagaaaaagatggaaaaaaatactctcacagtttaggaaactgctttcataagctttggcatctctaaaacttagattccagcccatccaaagagctctttctgcagtatctgttttcaggaaacattttcatcattgatccaagcatcagaaaacaaaaacaaacataaaaatacaacataagatcccaaaagcatcagcattcaatcactgtcattacatgaattatacttgaagcatgagcaagacacatgaggccctatctcaaagatgagccacccctactggtgatagagggcacccagagagaagcaagaccctcatttaccaccagctgacccacaggctctgagctcctccaatgactgagtccaaagatgtagcttcccctcactctttcaaaactagtcctatgttttcaataactagcttttctctgcctcagcatcctcgagtatacaacaaaacagtagaggatgatagaaaaatgtgggctttagagttggagtccaacaaaccaaggttatgatcttggataacttcatcaatctctcttagctttagtttcttcatctgtaaaataagaacaatgtttgcaggactgcggcgtaaataagctaatacacaggtgagagtaaatgttagctattatcattatgagtactgttattatcagggtgtcagattaggttatcttctaaatatccattctacttccaaggcttataaaatagagtttgaataaagcccccattcaacctttaataaccctaaagattaatttgctccttctgcataataatgaaaggacaaggtaccttgcggatcctagggcatatctgttcaagcaccaaatactttttaaaattaagaaaataaataatacttggaaaatggccccattccaacaaaacccttaatgtttaatccgtaagaagtcatctgaactctcatttaactagctttcctgatggactgattgtatgggggacatggaaaatgtgaataccaagtaatgagactgattttggcaagacatcagagaaatcagcctaaattactccttagtcacacttacataggaaaatcattttaagagactttatatcaaaaggattaataaataccagtcaagtcatgttttccagggacttccaggtcacatggtgatttacaaacaggtgtctaaatcccccttcccccaccccagattccaggtgaaatatcaagtagaatattaaaacgtgaaaataaagtttcatgttgacttctctagttttgtcgggctatttatagggatcaaatagtgatcttattatagatcactcccacagcaacttggtccttgcccatttctctttgccatccttcccacaatgggtgcttcaactttcattccactcattgtatctgatacatatgtacaaattctgtcagttaaaaataaatttttaaaaattttaaatgtactatctattctttaaaattagtttatcctctattactattttaatgtagatatagagagaaaaacatacctacacatgcttacaccatttaattttatatgtagttttctttatggaacatgggatcagtcattcaaaacaaataattttgtcatcttcaaaaattccagagtctagatattgttatgactacctggacgggggaaaatcttaactaatcattaagttaaaaattagctaataattattagagctcagaatgaacaaaactagttaagccgcataccttacagaattctaccttgtcaagtcaggccttttagattcagcaaccctaattatccatttcagacctgttgaattacttaaagtactcaatgtggccagttctatcccctccggacctatgcactttcacctccctctcctgtcaacttagaagggccttccccaccattttcccaggaacacttcctactcttccttccagacttaactcaggtgattcctctgggcctcctttatgagcctatccagaaaaatgaggtgctcttccctctgctcccaccaaaccctgagcatctctcttcacagcattcctgccactgttttggggctacttgtgtacttgcctatccacccccttccgcaaaatgcctggtttttatctttaaaggtaggtatttgtttttccttatacatctttgtcttccccgacacccaaatacagcctggtgtaaactaccagcatttaataaatattgaataaataaatgaatggatggaaaataaacaaaaagcttaagtctctctctacattattataacctcttagtgaaggatatatgaaatgacatcacctacaagtattaatggcaaaataaaaacatagataatgagcactttaatgtgctttcattaatttatttatgaagaaataatgtgacattcaagtttggggggattcctataccctaatatctaccattattaaataatagttttcagtctctgtctacatagtcattatataacaagaacacatgcccagctgggcacagtggctcatgcctataatcccagtacttggggaggttgaggcagggcagattacttgaggtcaggagttcaagaccagtctggccaacatggtgaaacttcatctctactaaaaatataaaaattagccaggtgtggtttgcatgcctgtagtcccagctacttggaggctaaggtgggagaatcacttgaacccaggaggcagaggttgcagtgagccaagatcacaccactgcactccagcctgggcaacagagcaagactccatctcaaaaacaaacaaacaaacaaaaaaaaaaacaagcaaaaaaccacacatgcccctaccagccaagtatcctttagataacatattattctgcacatgcttccacattgttacacttccctcataattatctctagtcttgccaaataacctgttaatttattcataatttaaaggcaataaagcagagccttgagcaaggctgcctgagtttaaatctggactctctcactttgcaagtgtttgatcttggataagtcacttaacttctctgtgcctcagtttcctcatcctgtaacatagagatgataataagagtgctatcatatggttttggtgaagactaaatgagctaatacatttaaagtgatgataagaggtggttttgttttgagactgggtctcactatgttgcccaggctggtctcaaacctgttggtctcaaacttcgggctcaagcaatcatcccatctcagcctctcaagcagctgggattacagggaggccatcttgaagagttcttgatacatggtacaaacgctctaactattagctatatatttttattgtaattctgaattcactaatattggtctaggttgtttctatattatttgcatcacactagcacatttaagcatatggatttgaggatggtttcttgggtagttggttttgtttcaaattctcaagatttctaactaatttccaaaagggcttctaatctactttttaaatgctcatgtaaaaattacttaattttatatgtgtaaactactttttaagaagatacttcacaaaatctcgacaacctacacagatagacaattgtcaaagaagttggaaggggccaacattttagtttgtacttgaagcttttcatctcagaggagttgctaagttactatctctatgcacatcctagcaagagggagagggttgtgaccaaagaaacaatacttttttcctactgtgcttcacaactcaaaattcattgattcgtatgtatattttgttttgttttgttgtgactaaacaatcctagtttctttcatctctttcaatgaaaggaaacatgtctgtcaaaaaaaaaaagggggaacagcaaagggaaaacatccctcagagaaaggagtgaacaatataaaggtaaacaaaccagggatttctttgatattgcccatttgtttgtgagaacaaagtaacaaacactgaaggagaaccaagtatagattaggcataaggtaaaagggagaacattattcttcattgttcttatctcagaggcatctactactaaatgatgtggggcacagaaagtgggcaaaggaaacactcatactctataaacttacctcctctgggtgataatacatgtacacccagtgccgtttctttagcaaaacgtatttgaaatgcaaaccccaaatcatgttcatactctatgtcttttgctttctagatgtggaatcaaaaaaaaaaggaccttttggtttatctaggcctaatgaggttgtctttgattcttgattatcaaatagttcatttgtttaaccaatattcatacttttgtatttttgatataattgtacaaatttggggaatacatgtgatattttgatacatgtatataatgtataatgatcaaatcatggtaattgggatatccatcacctcatttatctgtgttgggaacattataaattttctcttttagctatttttaaattacattattgtaaactaatttccttactgtgctattgaatactaggcacagatcacaataagatgcacataaactggacaaaagtctttgtcaccacgaacacagatatgtactgaatttgattcccaaatctgctctgtggccttagtcaagttactgaactcacctgagcgagtttcctatgaaatgaaaatgacagtaattgtggtgcatctccttgtacagctgctgggaaggccaaatgggctaattcttataaagcaccctgtgcatagtaagccctcaataaatgctagctactgttgctattgttcctttcattgagagatgttttgtggtgggtttttgttgttttgtttgtccattagccaagtcagaatatgacctctggcttgtattgtccagtgctatttttcatagaaatgaattttttttttttttaaagagacagggttttgctctgtcacccaggatagagtctggagtgcagtgatatgatcatagctcactgtaacctcaaactccagggctcagtgaccctcctgcctcagcttcccaagtagctgagattacaggcaagcaccaccgtgcctaattttttttttttttttttttgagacagagttttgcccttgttgcccaggctggagtgcaatggcgcaatctcggctcactgcaaccttcgcctcccaagttcaagcaattctcctgcctcagccttcctgagtagctgggattacatgcatatgccaccatgcctggctaattttgtatttttagtagagatggggtttctccatattggtcaggctggtcttgaactactgacctcaggtgatccatctgcctcagcctcccaaagtgctgggattacaggcgtgagccaccgcacccggcttttttttttctttaagagagaggggtctcactatgttgcccccaggctgacctcaagtgatcctcctgcctcagcctcccaaagtgcaggtgttacaggcatgggccactggcacctttcctagaatggattttcaactctgtttaaagacgattgctaatgcacagccaattgaatgcttattaagtagaaattaaacttgctttcaaataatgagaacatatgtcacagatgaagagttggtcctagtgcaagtttacaaataaaagacaaagaacctttcagctattgtgactagttagtcccttcttttacagatgtgcccatctgtgtgacaaaagaagcaaggccttttcaaatctttgcagagatggcacatgataaaagtcaggttccactggcttggatgctgattgccccttcaggattacaaccaccccagttccctgcattgtttgtgctatatcatgagagaacaggggcacatgaggacaagatttcttttcatttcacctttcagcagccttgtctgaaaccacactgactgttgttaaaaatgatgcaaattgtgcctcctttcagaaaagcacaaaccattctcccgttttcccccagtccaagaactgtacaggaccttcattagctagaggaacacgatgatggcagtgcctattttaagcagaaagatgctctaaagggaaaaacctaaaaggcttcagacaaaatactattcagtttattatactattgatttttagaatactcttcagctttgctttttttgcggatatatgtcaaataaccagcagtgctttaagttacttgtagaagtatttatcatatatattttttcttagagaagagaaataaagctttggtatggactaacccaaaattgtttgggaggtaaaacaaaactttcagatcagttatgtggcaataatcaagacacccaacatgattttaattttaaaagggagaattccattataaaaatctaccaagtttcctcaggctcatccccacacataccttttctggtctatgtaagttcacctgtttagcaaagggatgggattgactaattggacactcaaagctttcccccagctctgagttcatcccagcttctttagattttttttaagaacaaagaaaaaccaatattttgggaactcttacatgtagataatgtcagaattaatttccacttgtggcaggatttcagtaaagttataagacctcatatactttttgtctaagttaaagcaacatctttacatcactttaaattatacaaacttctaaccaataaaaacaggagaagtatggtgtgtatttgtttccatgggcttccataatgaaggaccttcttgggtggcctaaagcaacagcaatttgttatctcacagtcctggaggctggaagtctgccatcaaggcatcagcaggcccatgttctctgcaggctctagagaggacccttccttgcctcctccagtgtctggtggtcactggcaatccttgcctcctggatgtatcactccaatctctgcttccatcttcacatggctttcgcccctgtgtgtgtgttttctcttcttataaagacatgagtcattggattagggcccatcttaatgtggtatgatctcaccttaacttatttaattaaatatgtaaagaccctatttcaaaataaagtcacattctcagattccaggtggacacaaattttggggaacattatttaaccctgtacatatggagtgcaaaactactcacctttcctttaccaaggaatttctaagggagtcaaattaatttaaaatcttcaccaacttctcaacaagtgcacagctttattatatccaagatcataaaatctgtcatttttcttgcttatgttgatattgtgctttatatttacaaagttttttcatattgcttcatttgatactcacaagcacaaatactcattctcacacaagtaggcagggtgactggtctctttttacagataaagtgagggagaagggaaggaagcttaccttttatcaaataactactctgtgctagatactgttactagtgcttcatgagttgtcttatttgatctatataaaaaactcaaaggttactgtaagtagtattattcccattctgaagtagagtatagcataaaatagcactaaataacttacccaaggtcacacacagctagtaagtaacagatctggggctgccgctcaaatgcacctgtgttctaagtccatcatgtttccattcttccttctcaattaagccttcttcctaacaagtctttaactttgttcatggttagaatttgctaaaatatgtttggtggttgaaagtcatgacaaactcagtgatctcattaaaggatcaaccggagagatctaggccacttaacatgacacatacaggggactatgctttttgtagttatccttcatgttgcaataaaatgcaaaattttcctaactttgaaaatagaggaagaattgtggtggtaagaatcgtcaaaaatttacccacttttggaatagcctcaactagagtaaccctctaggactttcatttattcttctctgtgagtaccaatagggtgaagtcaaaaaatgactccaccattctgtggatggcccaaatcatgagaatgaaggaaaagaagttatcataaccttaagaaagaataagtgggaaaaaccattgttccaaatgtgggcttgaatatgctgtaatgtttcaaagcagcaagtaaagtatacttgttaaggatactctacccacctatgaaccattggagaaaatgaactattttgatgctgcctttaaagagttgtatcttcagagaagccaaaattcactgctgaaagattccttcttgaatctgtctcagaaacaatcttggatttagaatgtacatgtatatacttgtgtatgtgattatacttaacaccatcagttctaccttatattataaatataccatgataacagaactttcttttcagattgtgtcaaaaaagaaaaaaaaaaagggtctcactctgtcacccaggctgcagtatagtgatgccatctctgctcactatgatctgcctctcaggctcaagcaattctcatgcctcaacctcccaagtagctgggattacctgcgtgtgccaccacacctggctaatttctgtatttttagtagaaacagggttttgccatgttggccagggtggtctcgaactcctggactcaagtgatctgcctgcctcggcctcccaaaatgctgggattacaggcatgagccacctcacccagactcttttcagattcttaatgcattctacgtatttacaaataaatattgctaatagctaccatctattgaatacctactgggtgccaggcagctaagcacttactgtacatattcctagttgtcacaataatcctacatggtactttttactgatcctcattttactggtaaaggctctgagactgagaagtttaatgtcattcaaaacctactagatgggtgagccagaatttggactcaagttcacataattccaaagcctgccaccacacaaggaaaatatccatttattcacttatataagattgttgacctctttaaatatgccggtttcatcctaatcctctaaaaaaattagtcattctcatcttttgaagtccctctgacctaagggtgattcacagaggatcaagtaggtaggatcaagaatcctcatcttccgaatacattcatctttttagcttgataaagccagaatgttggggcctaactacgtagacaatttcctcacatttaattagaagacagacctaagacttgtctttgaggccaaatgctacataccaagttttcaccatgaattatgtttcatgagaacatggttgaatccatattaatactggatatctaatagagatcatgttataaatgaaacaaccatttatggataggtaaatattatcaagtacatgtttacattttcatattacatagcaaatcgttaggaaaccaagtgattaaatttggggttttgatggggtacacatggatgtaaaaatggaaacagagactgggggttataaggggtgcaggcatagggctgaaaaactacctattggctgctatgctcactacctggataacagattcaatcacactcaaaactcagcatcacacaatatactcttgtaacaagcttgcacatacaccccctgaatctaaaagttgaggccaggcgtagtggctcaggcctgtaatcccagcaccttgggaggccaaggcgggtgaatcacctgaggtgaagagtttgagactcacctggccaacatggtgaaaccctgtctacactaaaaatacaaaaattagccagggatggtggtacgaccctgtaatcccagctacttgggaggctgagccaggagaatcgcttgaaccagggaagtggaggttgcagtgatccaagattgtgccactgtactccagtctgggcgacacagcaagactccatctcaaaataaaataaaataaaataaaataaattgaaaaaaataagaaccaactgttgaaacctcaaaaaaaaggggggtgaggcggtgggggtgagttttgaaaggtttaactttgcatgcattggtttaccaaaggaagaaaaagggagtgggagagacagaagaaagagaaaaaaaaactccataactagaaaataaatgcctgcattgtagaacttcttaaatgttattttcataaagttatataaacgtatgtcatgcaaataaggacaggtcaaattgaaatgtttataaaatatgctaaatttaagagttgtagtcaaaatgtattatagaatctaactgtggagtttattaatttacattttcatggcataaaaatagcaggactcaagccatgcagttaatgtacacaacattcactgaattgtagacacaaagaggctaaacactagaaagcagcttttaatattctgtaatgttctttatcaagctgtttgtacaagactttatgaaacacagcacacggcttaacaatctccagtgcattattatacatatctaacttttgccttcggatactcccagcaaaggacaacagattctcaactttactgtaccaaagcaatgtggtcaggaaagcagcttccccgttctgcagcagctaaatgtcagagagccaagggttccaccaagatttcccaaagcacagcagttgccattagaaacttcctaaccctccaatgttcactttacagagtgttcagagggtgataaacagatcttttacttgatttgccatctgtgaattttaaagctgttaaggcacttttctgtctttatttccatgatgctcctgatcccatttgctagttagatgcactcactaatatattattcagttctattgagaaaaccatactgaggcatctccgatttgacattactgtccaaatttttttttttttataacatatcaagtaaaataaaccagcttgaaaccctggccttttttagtgcttcaaataattcttttcatttctttgttactgagagctcacattagaaagctattaatacatttgagtacaatttatgttttcaatgcaacccagacaagaaatgaaaaggcatggagaagaaacatggccttcctggacagcctgaatcagtaagtcgttactcttcaccaaatgtagcttatgtacaaatggcttcatttccattccccttcgctgtgggagcctcaagaaccacagttacaggagctagaggatgacgctgacagcggtcacacaggcagtacccactcgtttcaatagccttcgccttttccatttgttggtttgcggaaagacaaaactgtgctgatcctgattgtatgagacaagaaaatccagccaattctattttacgtggtactcttgccttagtttctttttcagtgagaacagacgcgccactgctacagctggccctgtatgttatttttttccagcattagtaatggagtcattgattcaatctatatgaatggagtccctactaagtgccaagcatataacagtgaacaaaacaacctctggcctcatagaactttcattcaaggcggtgagatgggaggagccaccaacatacgaaaacaaatgtagtcacatttacattaatgcctgaattaccaagactcgggctttctttgaagccttccccagccaatttgagggcactatcagatgtcctgtaatatgcacaaaaccaaccactcattttcctccactttggccttcttgctagttgtctccttgtggggcaggtaagagacctgacacactgccacatctacagggctaccaccaggtcactgacataagagtcagcatctccaccactgttcgccactctctaccgctctgcagaggccactggaagggtccagggtaagaaacctcacctggggtctatggcagggtagagagagaaagctggaggctcccccacctgctaatattacagttggttacctcggccctatggttctgtttgtgcccaaactttcacatggtctttcacaaacacgactttttccccttctgaccttcacctttctcttcacccaggctccatgtattcccttgtattctcatctctttccctcatctctctccaggcacctatccacaaaataggttcctcttttttcaccagaagcagaaatgtatatgaccattatctcttacaaccacatccccatagggatgactaacctgatgctcaaagagccacagtccaccttggactccgttaggaagccctgccaggtatagatgggagaactgagctaccagcatcaaggacaccagcaccagaaccagtctttgaactattcaattttatttcctaatgaatgtatttctccacccaaatgctgtgcatcccaggctcttcctcaacctctacctacagagaggatgatcagctcttgtgggtgaggtacagtcacaccagtccagcaatgtgctttgcgattccttgccaggctggattccctaaccattctggtaagcctatcaataagcttgcccaaatgcggtgaagacctctctcagaacagccggagtatattaatccatttaacctgggttttcctaatcaatatggaaatgtttagcctctgaattctgaaggattgattccatactcctgtatggcattccctggctatcaactgccctgagtaggttagcctcaagatatgtgtgggctttgctaaataaactttgataaaataagtaacatttttctgatatatatgaaaatggttttctcatctgtgttggacttttccacagctacatctcctgttctcatgagaagttttacttcctcagaattagtgtgcctccgtaacacaaaacttcagaaaactcccaggcacatgcatgtcaaatgcatgtccaataggcttccacagcaatcttctcatctgtaattcacccagggaagaagcaagcacctccagtgttctgcagactcacagtaatccaagctgcttaaatccttcataaatcctctgtgcaaaaacactaaagagattgtcagcaggaaattcaaccactggttacctcggacattcctagaagacttttccttaattatcagccagagcactatgtcattaatgcagacaagagttgacagcagctggtctaaggcagtaatagcagagacagacacacaaggcaggttcagaagctaaccaggagatgaaatgggacatggcttgtgtgaccacaaacatgaatgcgtgtgaggaatgaaggaaaaataagacccagcaatgattccccaggtttctggcttagatatttgagaggatgcagccactttttattaaacacaggaggaagagcagacttggggagatatatggttaactgcacactaatttatatttgcaaaatgatgaagcacatggagagcaattttttatttttattaaattgctgattatgttcttaagagaaaatatttgtatttactatctatgcatttgaaccatcagaacccttattttcaggacccttattcccaagttttctatgtgtctcggtaattcatcaaataatattaaccagcaagggagggaagtaattaagtgaagatgaaatttttattaaaacactaatcataaatgctcatttacttattcgacaaatgcttactgaatgttggcaatgagccaagtaccaatgtgaacgacagaaacatagataacaatgatactgaacacataaggagtaccagccaccacaataagcacgtcatctgccattgacaatccccatcataatcctgctaggaaggtgttattacaatgactattccatagatgatgagaactaaaactaaaatcctaaacccccaactggctgaacaaatcccctcttggttaaggggaccccagagaaaccttagaaactgagttcctggccacggtgcgatgggaagccagacccgtctcattacatcccctcctttttgtggtttagacgcaacaactgaccagcatcaatgttaacatagagatcctaagactaacaaaatggactctgtggcaataagataccaaattataaagattgcctaaggccatgccaggcaagggttaagtcatgcaccctccacacttaaagagtaaattctgttccaactgccacaagtttttctttttctctagcagttaaaccagcaccggcctcaagataagcactattgaaacaactgcagcactctcaccaccagatgctgacccccggccgattccacaagccatacccacattttttgattggaaaagagacagctgtggttcagtaactttctcctaataagagaccatggaccatggactgatctggctggtttacagaggctgtaaacttgagggccttcgtgtccctgccttacgttttgccatataaggcctaattgtaagacacttaaatgttaagtctccaccccaaagtgaacatgggatgcaggtaatacgcatgtttgcttatcacacgtgtacctctcccacttcatgattattcatagctcctcctgtaacctattgaatatgtatacttggccaacctcagcataaatccctgttccaccccttcctccctcaaagtgtctgttaatagcctctgcaagaggctacacttcccagccttcaaaaatggccagaccacaggctataaccctttataagaaataaagtctccttcacagatttaaagatcttgtgatttttccatgatgaaactgacatagcaacgtgttgagtaacttggctaatgagtaggaaaccaaagtttataccaaaccctgggactctagagccggtctctgccatgcctcttccctcaaggaagtcaggatcctcttgggaggcagaccatacatgtcattagaaagcttttacaatgatcaccttgcttgttcatctcaactctcgcagatctgccactttcttcagtcctctaaccacttgattcggtacacttgatgtgatctagcattaccagtctctcctccaccacatgctgcctgtaattgtagcagtcacttgttttcagtcatatcattacagagcagcattgagttttccagtttataagcagcccaaatttgttttcctgttgagcttttgccttgaatgtctggcttttccttggggatacatagttcccagttccatttcccacaggagctttactctggaatgtctaatagtgtgtgtttgtttcaacatcggggatataaataggtaaaatgaagttctgcttggtgctgctgcacggctgcaagaaccaagggccagccaatcatgagctgagggacttactgtgtttgtttaaatatagttcaggtttctcccttctctctacctcaacaagatttagcacctagaacaagacactacacctttagtttgcactccgaaattgctaggaagtaaatccatctggaaactgcactggataaggagcagggatacacagcagtggctggaaagaaattactcaagtacgaaatcaggaaggaacctcattaacaccccaccaccttttgtaaagtcaataatacactgtccagtatgaaacccagccaagatctcagctgttgactgttcagtgaaagaggaacatgaaagtgacagaaggacattcattccagaaaccctgagaatccagcagcccctacctggtctccagctccatgacttgccaccgccctcactgctccagtctaaattccacaccttcagagctagagtcagagtttccagggtggcaggagtggagtgaaccagggggatcccagcatcctcctcaaatgtagggactaagactggcggggaaaaggggcagggtcctttggggattgtaatgcacccaaggggaaatcccagagatccaggttcagtcctctggccctccccagctagcctgatgtagctccatcttcactgaagttcctctggtgataacacatcatgttgaagaggatatttagggcttcctgagacaaagctgtgctaaacacatgaactctcagcaaatactagcaagtgaattaaaaatgaatgaatatcctataaaacaaagcaacaaatcagacaacccctacccccgaccccatggctcaatgagagcttctggacctgcagcatccccacaacatataattcacccactaccccatactagagaaacctaggaggctctcgtgtcctggggagcaagctgttaagtagaagtgggagaattcctaaccctgttaagagttggaatgttaaactctaaagataagcctgaaaaccagctttaaaaaatgtgagcattcctagttaacctagataggcagaattcttttccctcctatcaagacaaacccacagtagctcaatgcctggattatgaggccacatcacaaagatgttagttttttcagtttgggttgttgctgaaaagaaagtaagaatttaggcattacaattcagactagatccattcattaggtccacaccacaccagtaaacagtgatacagatttgcatagtgtttttttaaattaacatttaataatgttttacttcccaagccccttatgagctgggcattggctaaaaaggttttggctcagtacaaagaagaatgttccacgcctgtgaaacaccaaacaatggagcagtggtgttgtaagggagtagcctctggcccattcaagtcaaaactggataattatttgttgcagatgctttaaagagttctaataatttaggtgttaggtgagaataaataatctctaagatgtcttccaatcctagcatacatgataaattttttctgtggaaaaagcacccaaacagaaagtgaccagtgactttccctagtcacacaaccagaccctccagcttctagcctaacactctttccactggatggtcttcaccaccaccagtactcagccccaagacaccaggggaacactggcactgtccctttggtttcatagaaaataagcacaaataaaagattcaacatctgaccgacatgctttcccatattttataagaagatcaatttagtaccatataggtaccaaggtactataggtaccacataggtaccaagttactataggtaccacataggtacattagacagactgttttgtaaacttctgaaagccaatacaaagaacatctcagagttagtatggtagaaccttctagaacacttgtcatggcctgaatcttcatgtccctccagaatgcatatattggaacttgtattagggttctctggagggacaggactaataggatagatgtatatatgaagggaggtttattaaggagtattgactcattcaaccacaaggcgaggtcctacaacaggccatttgcaagttgaggagcaaggaagcgagtctgagtcccaaaacctcaaaagtagggaagctgacagtgcagccttcagtatgtggtcaaaagcctgagagcccctggcaaaccactagggtaagtccaagagtccaaaagctgaagaagttggagtctgatgtttgagggcaggaagcatccagcatgggagaaagatgaaggcgggaacactcagccagtctagtcattccgcattcttctgcctgctttattctagctgtgctggcagctgattagattatgcccacacagatggagggtgggtctgcctctcccagtccactgactcaaatgttaatctcctttggcaacaccctcacagatacaccaaggaacaatactttacatccttcaatcaagttgacactcagtattaaccatcacagaacttaacccccagggtgatgttattaagaggtgaggactctgggaggccccaccttcatggctgggattactgcccttttaaatgggttgagggaacaagtttacccccgctttggctccttccaccctgtgaagatgcagcaaccagacaccatctgtggagcagagggcaagtctttaccacacaccaaatctgttggcaccttgatcctggacttaccaatctcaaaaactgagaaataattttctatcatttacaaattactcggtctaaggtgttttgttatagcaacgggaacagactaacacaaccctatacttcagtatttgggataattggattaaactaataatttcactattaccccataatcaaacataatggcagcatttatttggctgagtttcatgcttagagtatgggaataagaattgttccattataaaggtcacaaccttacataatgatctcccttacataatagtcacacccctatttttggaccggcagagccagcataaaaagtgttatcattacacaaatacagcactttagaggtgtttttaaggacagaaatatattttcaattctattactatttttcaaacagctgaggctagacagagattccaagtgccctgcttcgctgtttttgagctgtcaaagaaaatgaatcaactgactacagtcacgtatctaagacagacatagaatttcgcaggaagtctgaggttatttgggtcaagttcatacggtatttgatctacagcctgataatacagcttttgtgctatatgagcacactaggacatggtgttatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacatggtgttattttttaactgagacataaaaaccaaagtaacaatctacttgtattcattgttaagttttcatatccttatagccaaagaaaggaaaaccacttccaaccagcctgcttctattaatacacacagtgatctttgacgtaaatgtcacacatgttcactttaggcttctggtcaaatttgcatgaggccaattaaattctgaggtcctgaatctcctctgtaaattcaacagatagatttctcttcttgtactaagctattgtttggtattgttctgaactactcaacagctgtaattctgcaactcactggatgttgaagggtataataattgtaccgagggatatgaatgtgtgtaaacccaaagcccagtgctgtctctacggtgatacacttatccacattcctcccactgtcatgacacagtcctcttacttcaactggctcacttctccgaatgcctggaacttcactcaatttaccttcccttatacaccttagatgtcaccttagatagtgcaccttaaatgtgcactattatggtagccactagccatatgtggcttctgagcacttgacatgtggctagcctaaactactgagatgtgctgtaagtacaaaattatatactagattttgaagacttagtatgacatatgtaaaatacctcaataattttcataccagcctgctgaaatattttgcatatatcaggttaaataaaaacatacatattatacactagaaaattttaaattatgtgtgtagctcacattattggataatattgagttggctaattttaggctctctttccctgactccattctactgagctctcttcaattacacataaattgggtcttctaattttatcctttatctcttaatctccttttctatccttttgtttttcctgtgctgcattctgggtaatatctcatatttatcttccaaatcactgattctttcttcactaggtctaatctgttgttaatccatccatccattacattaggttttatgtttactttgttttgatgttttgaatatggttttgtttactgaacttccagacaagatttcatctggtttagaaaaatattggaaaccattaggcaatttctactaatgctgaatacatgcatactctgtcaccagcaattctactcctaggaataaacccaacaggaaaaaacgatagcccaaaactgaaaattacccaaatgcccaacagctgtagaatgtggcatattcacacaatagaatactaaattaaataagaaaagtataactatatggaaaaatatgaagttcttttatcctttttcatatgttgagagacaaaggtcatatacaaaagattatatagtatataaatccatgaataaaatctttttaataggcaaaattaaaatggtataagaattcaggatacttgcataatagtcacacccctatttttggatactggttgaccttggagtaatactagttgaccttggagtaaaagattacatgaagggaacagaaagggggtttatgagatgctggtaatgttctgttccttgatctgaatactggttacatagtacattaatttatggaaattcatcatggtatatccttatgatttttaaactttgtatataatttaacagtataacaaactcaaactctaatcagtgattttcagaaaaatatttggatgttgtattagtctgttttcacactgctataaagaacgacctgagagagggtaatttataaagaaaagaggtttaattgactcacagttccaagtggctggggaggcctgaggaaacttacaatcatggcagaaggcgaaagagaagcaagtcacgtcttacatggcggcaggagaaggagcgtgttgaaggaagtgccgcacttttaaacatcagatctcatgagatctcactatcacagaacagcatggggaaaatctgcccccatgatccaattacctcctaccaggtccctcccctgacaggtggggaattacaattcgagatgagatttgggcagggacacagagtcaaaccatatcagatgttaaaaccttttttttcctttttgagttgtcagttttgaatataattatttcaaaaatttcattttgtttccttttcaaattctgcctagacatttttaatagcattttgctcatgttttcaaatccatcttttatttctagaaacattttaggacatttcatttatattctgactgataattcttaaattcaagttcttgggaagtctaattctactgtttgttgtttccactgatggcttgtttactctgtgtaactggaaacttttcattgtgaagtcatatgtggttgattttaatctgtgagaattctaaagagccccagctgtgggaacattcctacaaagctgattctcttccgattctgctggaatcctgagtctctctcaaactggaattatcttaacaattcttttgcttgaggtttcctggacggcatatgtggataatgtgagtttaagccctaaaccttcatgagttcagaattctcagcagagacatttccccacccccagccaaggccagaacaatttctcatagcagtttttctttgccaaatggatttttctagtccatcttttcactgagggtgtagatcttcaagattcctggcttttgcagactcttaatcagttccgttgaccttgtaacagcgcccaagtcctcatctcccattccacaatgcacccctccctactcatccctgttgtatggcaattaaaactgaagctttcagtttctgttatctgcacacactcccaaggcagcccatatcttagatcctcactcaccaccctggtgtcagctctctctccatttttgcctctgtagagacttacattcaatttttgtgagcttagctacatatttaaaaggttgttttttatattacattcagcatttctcagtgtctgtaattgggagagtttctccaaatatctattcttcataatactagaagcagaagttcaacaggccttctctatctgatgcttaaaagctagcgaggcagtcatttcagggctttggagaggtcctactctgttacctcccagcttaattacaactgaattttctagaactaaaaaaaatgtttaacatgagcagaggtgaggtgaggtgtcaatcaatccattttcacaatatgctaccacctactattcagtggacttgctaaaaagtcacctagcagagagagctttgccactttgttatgccaaaggatcaaataatgcagaaaccattcattcatacaataaatattcaccaagaatctgctctttgcaaggtacaaagtgctaggcaaacaaaagtgattaaaacaggaacttggccctcaaagagtttagctagaatgcctaaaaattttcttgccttaagtgcaaattgatcaataagtagagattgcctggagcattgtattaagaatctgaggccaggcatggtggctcacgcctgtaatctcagcactttgggaggccgaggcgggaggatcacgaggtcaggagattcagaccattccagccagcacagtgaaaccctgtctctacgaaaaatacaaaaaattagccgggcatggtggcatgcacctgtaatcccagctacttgggaagctgaggcaggagaatttcttgaacccagcaggcggaggttgcagtgagccaagatcgcgccactgcactccagcctgggcgacagagcgagactccgtctcaaaaaaaaaaaaaaaaacaaaaaaaaaaaaagaagaagctgaggacaagtctaaactagtgagtcatctgttaaaatacaaaccccactatgccatttccctgttgaagcacctctaatagcttcccattactcccaggttgtaatccaaactctgtggcctacaaggaggtcctcccagatgtggccctgcctgtctcccagtcttcctcttgttcactccattctatccatactagcttccttctgctcttcaaaggtgcctagttcattctcactttagctcttttgcacatattcttcctcccacctagaatattcttagttctttacatgggtcccacttctcatcatgagtctcagcttaaatgagacacactttgagagggcccttccctaaagaccctgtaaaaaggatctctcccaccatatcatttatctgtcacatcaccctttttaaattttcttcacagtccatatcagtatcttaaattatcaagttatttgtatattttctcatttattctttacttttctctatattctctaaatgtacctggcatatgtaatgggtgctctgtggtatacatatggatgaatacataaatggataaatggtcagtgatgtctgcaagcatgcaaaataggagggtggctctacttgtactacctaagtgcatcagaggaaaggtgacagtaacaaaaaacatcaactaagtgcaaaaaatgccgttaggttcaggagtgatgaaaggggacataatgaactctgttgggagcaagtgaaggacacaggcagggaaactgtccttgaaaaggcagcttaccaaagaccctaaagaaaagctggaagttactggcaggcatggtggaaaaaagcatccagacagaaaaagcacatgcagcaacaagcagctgtgagattcctccttacttcatgctatcaccctgaattcagggaatcagaacttcccaaagggttccagttttggcctcttgtccagagatgtccaggtggccaaatatcaaagtcctgtttcagactttcccattaactaatcatatggtttctaagagagtcattctacccctgggggcccccaccttcagcagctataaaaccaggatgtggctcgtaggtctctcatatcccttccatctctgcaggtctgttagatactcccgtgtttgctccagcacacattctgaattggccagtactggaactgtaaaacatattgattccttttggtgatttcttttgtgctggtttttgttttttaatgattaagagatagtctacagaatatcagtgttccactctgtcactcagttatagctaaacaaatcaattataaaattaagctctgaattttggtaaattccaaagccttgcacatgccgcctctggccagtctgaagtccaccgctccatatcactgaaagcccttctttagaatgcaggtgactgggtccaaccatttaccatccaaccccccagagccactgaattagcatctctcatgagtggggcccagaaatccacattgtcaacattggtaatgcccagttaattctttcttattcaccctcaaggagagaaccactacctcttagcttcgctctgttccaggataaaaacaaaacaataaccaaaacactaacagtggccagcatgcattgagtgcttcttatgtgtcgtgatttgtcccaggcttctgacttcctttcttgccccaacagtgttgaatcacttgcccaggttcacatagcaaccagctggggaatgaggatttgaatccatgttctttggactccagcatccatgtttccaactgctaactacactacagcagggtacaatgcttaagagcctcattcagctctagcatcggacttgatgagttcaaatcccagctgtaccatttactagctgtgtggccttgggcaagttattttgcctccttcagcctcagtttcctcaatgtaaggtgaggataataagcattgctacttcatagggtgcttggttgtgaaggacaactgagtaaaatgctgagaagggaacctggtgcatagtgagcgtcagccatgatgatccagcctccctttctccaggcttgggctccttggggcgtggtacttgtcccaaaggaaatctctgtcaagcatgagtagacggaactgaagaaaatccatcctctctgctggaaagcaacccacagcccatggtctactgacagtgggtcagtagtgttgtctttggagataaagtatggcacattatttgaacttgaatgttcaaagggcatcaactcctttctagcacacaacactttcagccttgctgcttctttttctttcatgcctcctaatggttctgtctgtcattatgaacctttcagctctgcttccacaaagcacaaagggatcccatcctttaatcctcaaaatagtttgtctttatagtttggcaggtaagagttggttgcagcagtaactcctgaaacctgcctctcattatgccaagaactgcaatgtgtttgccacataaaagcatgagtgataacaaatgctttccgatggtgagaactgctctttatggcctgctttccaagtgccctcttgacatagaagaactttttttttttacaacatcaatcatcattagtagcaaatggtgatatctgtatctgtccaggtgacatctcagccaaggaaggaagccacatcctgagaatgtcagctgttacctcaagactgaaatacagcaatagttacctcaagatagaaatatagtaaagaacttttgtctttcatgacagaaattattccataggtcatatttttactaaatcttctaaggaggtacttaaaattactttttcgttgtaaataaaactagttttagagtaatgcataatattttattcttttatttttgagacagggtctcactctgtcatccaggctggagtacagtggcatgatcctagctcactgtagattcgaaatcctgttccagtggtcctcccacctcaacctcctgatcaactgaactacaggaatgcaccaccaaacccagctaattatttttttgtagaggtgggggtctcacaatgctgcccagactgttctcaaactcctggcctcaagtgatgttcctgcccaggcctaaaattttaagtaagttcctatttatgaccacagatattttgagagtccattgccatgctagccttatgcaaattcagcgatgtacccatgaaccactatacccaccccaaaagctccacccaggggagacaaggcatctgaggggcacaagccccagcagaccaccacggatctgctgacctgggagcaaacagactcctcctcttaaaagatctacccactcagcaatacctgaactttgcaggagccagcaaacaagcacctcactccttggtaagactttccttttgctgcaccaaactggaatcttcctaccgccccaacctactgaatctataccattatttcagcaagagaaactgagcaaaacattgactacttgtgttagagaacaatgaaatattctcatcagaaaccctatcctagagaaggaaactgtctgcagtagagggaggagctccactaacttcgaacagctccaggactgacatcgctaaggtcttcccaactttatcttttctcactagcccccagagctgtccagttccagcacatggacatatatgaaaatacaatatcatatgcctcctccactgaccagggcaaaagctgcagtaaaagaactatcaagtcaaggaattatcttaaaatattactaataacattaccaaattacaaaaaaaggatctttaataagccttccatctaatgaagaatggaatgaaaatcaagaaaaaatgttgacagaatacaaaaagctgaagttcagatgctgaacacattcttttaatgttttatttatttattttgagacagggtcttactctgttgcccaagctggagtgcagtggtgcaatcatggctcactatagcctctacctcccaggcccaaatgatcctcccatctcagtctcccaagtagctgggactataggtgcatgccaccatgtccagctaattttaaaaaaaaaaaattgtagaaacaatgtctcagtatgttgcccaggctggtctcaaactcctgggctcaagtactccccctatcttggcctcccaagtagctgggattacaggtgtcagccactgtgccccagccgctgaacatatttagtcaaacttcttaccagagtaaatcccattgtaaccactgaggcaagcttggctcctcccagaatctgctttctaggctcagtccttcacatggtcttccttcttgtccccttggtcaccaagccatgcagcccttccacccttggcccatgcaggtataattctggtccctagcccccaaggtaaggaagcctcttcacttccaagtccccaaagtcacctgcctgggccactagccatgcagcagtaacttcatacttccctgttttgctcttcttgaaggttcctattgtccaaccataggccaggaagccctgctcttactaaatcaagtgttctcaatcaactcacctgagtcaaacaggccttaaaagtctacctatgccaatcttgtcatttacatgtaaggcagagaggctgaatgacttgctcaaggtcataaagaaaattaaggagtacaagccaagcctcctgttacccaggccagtggttttcacatggtaccaccgatgaagcctggggctgtagaccccgttgagccctgcccagtattccttttccacctgtcaccagtgctactgctaacctcacacctctaatcttctcgagagaaccactcttgggtgatatagccaccttgcccaagtatgcccgggaattatcacttaggaccaggttgcccgtagctcaagactggttgatgcaaagatacaaaattcctactttcctgcctcaaggaagaacacaccctgctatgattgatgcttcagagcatccacaggatcaggctcagaatgggcctcacctgaaagtgcatcctttctcctgagaatgctcgttaataactcattttgctaagattctcttatattcagctctgcttctagggaatctaacctgacactggggttctctctgagcattccaagcaagtatactggtccaggccccacagtgctcaaatggcctccatgacaatctttatccagagcccatcaacattcaatccagtccctcagtcaggaatatcccttgtcccttccagcctagaagtccactcttcctcctgagagaagcaccaagtccctccctcctgccctctcaagctctcacctgacttgtagttaggatctgaaagaaactctgaagtcagtgaatcatcaagctgaggtcatcagcagcataacactccctaaaatatttagtcttcggtgctccttagggagcagagaaatgcccccacagtgtcccttaatttgcttcttaaatggtgaaatctcttaaacagagaatgagggttttcattacagcattaacatcaccaacatgcagtggctcatgccagtaatcccagcactttgggaggccaaggcaggtggatcacttgaggccaggagttcaaggccagcctggccaatgtggcaaaatcccatctttgcaaaaaatatataaaaagtagctgggcgtggtggcacatacctatggccccaactattcaggaggctgaggcatgagaatcccttggaaccgggaggcggagactgtggggagctgagatcacgttactgcactccagcctgggtgacagggtaataccctgtctcaaaacataaatcaccaacaagccacccattgcttttgaagatactctaccctactttctcagaggaatcactgttcttgctacatgttctaactgatgttcttatctggatacaaaattaaaaaggtttgtcactctggagtaattatttaactatgacttgtttacataaaacagcatcctagaaaatgagtttgcactggtttctttcacagcagagatcagattattgacaaaatatccggagaacttataacctgctttgtaacaataatggctattcatgtatagtgcccaatatgttccaggcaccagaaatatgtcccttctaatccttgcaacaggtggggacaatactggtcagagaagttaaataacttgatcaaggttaagcaacaaatacatggtagaaacaggatttgaacccaggtctgtctacccacaaagcaagtgactgggccacttcaccacctctacctcctgttctccagtgcttgagactggttctaccctgcagcagttcctgttccaagctaagcttcgtacaagaattaatggacgttctcaaaagtacaccctgttctctgaccttgagagaggaacaagaagaagagcatctggtgtagacaaatgtaaggatcaagaggggctttgacaggaaggcagagtaaatgttctcttccctgtttctcccataagtctagctaaaaactgagcattagatctaaaacaagcataagaagacaccgaaaggtggggagctgccaagtgggttaaggacctcaggacccagggaatgacatggcaacgagttcctgaattttctttttccctcatgtatttcctcatctatacctgaaaagccagcaacctggaaacaccaatacacatagaccaaaaacaaataagcaaaaaaagctcctctctttgtccaaagaaccaggaaaggggcagcctagcttcttttagattgaagaaaaaaatgaaaacttttagataataaccactctactcgaaacacaccacacacacacacgcacacacacacacacacacacacacacacacacacacacacacaaaactgtggacccacccatacaagcaaagacctagtggggaacctagacagtagtgaggagccccaacacctccaccaggatagtttctgagaggctgagtgtggaggctggcctttcatctctgctaggtggcaatgtggctgcaaaggtgtcagaggaggctggtggagaatcaggtcttacccgccaccactcagcagtaatgaagccattccaaccgtgggagtggaggtcacatggagaaccataacaggactcctcctcctggcagccagatggatatgggtttcaaagagcaactataaatgttcttgaaacaaaaaactacaaagaactagcaaagtaatgagaagtatcagcaaagaaacagaagatagaagaaccaagtagaaactttgggactgaaatatattataaatgaaatgtaaaaaaaaaaaaaaaaactcaatggatgggttcaatagcagaataaagagaacagaggccaaaaaaaatctgtgaacttacagataaaacaattacccataaacaatcaaaataaattaggctggggaaaaaaatgaactaagcctcagagacgtgttgaactacaaaaaaaagatgttaaaggtaggtcatctgactcccagaaggagaggaaaaagagggtagggctagaaaagcatttgaagaaataatggctaaaaactttccaaagttggcaaaagacagaatcaagaatctgagcaccaaatgggataaacccaaagaaatccacaccaagatgcatcacagtcccacaaaaagacaaaggaaaaagccttgacagtagccagagagaaatgatgcatgaagccataggggaagaacaatttgaatgacagaggatttcgcaaaataaaccaaggaggccagtaggaagcagtgcaacattttttaagtgctgaaagaaagaactatcaatccaaaattctatatccagagaaaatattcttcagggatgacattctcagatgaagaaaaactaagaggatttgtcaccaggagacctgccctaaaataatgactaaaggaagttctctaaacaaaaaggaaaagataaaagaaagaatgtctcagaacatcaggaaggaagaaaaaaacatggcaaaaatatatataaatacaatcgagtttgctttgcttctcctcttgagttttctagattcagttgatgattaaaaaatcataacactgtctaatgcagttctcaaggtatgcaaaagaaataagacaatcatataattggaagggtaaagggaggtaattttctttttcttttacttttttgtagcaacaaggtcttgccatgttgcctaggctggtctgaattcctgaactcaagcaatctgcccgccttggcctcctaaagtgctgggattgcaggtgtgagcccctgtgcctggcccatgtctaggtttctatacttcgctggacctaataaaatgacaataatagtaggcaatgataaatcatgtatgtctacatgtttaaaaagccatgtcaaaagatacactctaaagcaatatagataaatcaaaattggattctataaaatgctcaaagaacccacagaacagcaggaaaaggtccaaggagaaactgaagaggaggaatggaggcatctgcccctccttctgccagggtcactttaaaactagacccttttcacaaggtggggagcacagtcatttctgctgttctgggggtacatctagggtgggacagggatgaacccaccaggcttttccacagagctttgccttgcattggtgaatgtgtgccctggtgcttatggaaggctcttctcaaagcccgcaggctgacctgccagcacacccaaagtggctccttgtcaaggctcagggtctcagctcaccttcagcatggtggagtttccctcctgggggagaacagtacatttgcactctgtttacaaaaagccaaaagctatgctttgtgtgcaacctatctgctggaaaaaaaaaaaaaatggaactaaggtgtctttgagaatgatctgatgcagctaggtcagggggaagaaagaaacgcaacaatttggagcagtgccccaaacgcttaaatgagctgggtacaaatcagtcagcgttggtaaactctacctatagatagatataatatctattttataatagatagattatatatttataatatatatactatatattatatagatattttataataggcattttctgacttagaaatactaagacaaaacagatactaagttccagagaacctccctttaattttattagggacaggagtcctgaatccttccaggcaagaagatagccccacagtcttgtagtaaaccgtgtgctgctgtgtttctagacccttaactttgtacctcctagaagaatgcttctaaaaactttcattacacttgttgataatgtttacactttaaaaaatacatatatctgggaaggtatttgtacacgtcattcattattccaaatataagggtatttgtacattacatgtcattcattatttcaaatgtaattttaatcagatcaacataaaagcatcttaatataatcagtagtggcactggtaactttaaatattaaaatctacaataggaaaaaaggagctttgattcattgtctcttttcaaattagcacaatcaacttagcacacacctctaacctttctttccaacctctcatgttctttctgccttttctcttgcttctcactcccccagcccatgatataacaaagagaaggctgtagagggcagagtcagggttgacaaaaaacagattccaattattccttctccttgcacgtattcaaaaacctatagccttttataaaaatatttcgattttttcccaggaaatctactttttatgtttgccctgtctttagccaactctaatagatttttctgttgagttctgatctgtacctgagattcttaagaggtatatttgcagacaaaaccaggaagatttccctgaattttttggaaacaatcttccttacaccaaaaagtaaattgcccaaggaagcctctcccacctaggacttcctaagagcagaactggcacttgtaaaaactcaggaaggttgcaaaaaaattggaaatggggttccatggtttcaatataacgttaaatttgaaaattaacgcctcaagttaatttggctctttctgtcttgagctgattagtgaacactagaattcatgctagagctcccaaaccatttgcctgcaatgcagggctcatgttccaaattctgctttttgcagtaaaaaataatatgctcacatcatttcatgactgtggtgctacagtgtttctaccggcttgcacgcctcctacgggtgggctgatgtttattgtattagtacataatgctgcaactttccactggcacacaaagctagtggttttctaaagcagtcctggaattcattaccatggaaacaaaaggtataaaaagctgtttttatctaataggaaaacttagaggaactctaaaaaagatcaaaagtgttttcaaagtaaaggtagagtcaaatacattaagtttaggttaaaggagcctcggaaaggaatcgcaagggttaacagaggaaggaggcggactctgtagtgatgggagaaaactcagcagcgccactgggaggctctgaaactgggacaaggatggataagtcgggctgccgaccaagtccacccccaaaaaagtggctgaaagaacccaatactcttcctctgccaaggtacaggagacatggttagaactccagtctctccccacagaggtgaaaatgagtagtttgttcttcggacataaataatatcatacacaccctggtcctaatacatccatccaaccattctagactctagattctagacatggaaacgagaagcaaatgaaaagcttaatataaatatgttcattttatcaactcatcatttgatctagagcttgatctcatgtgttcaggaaatgctgtcacaggtcctattttagtttgggaaaggagtaagcgcaaaccacaagtatttattttggtgtttacggtgtttccctaacatccaaataagttcaccacatcctgccatcagcttcaaaatagaattttggatatattcttccttccatggaaaacttcctgatacataaactgctctgaccatctgtaataatacaaactcttatccagtatcctcctcagaaaacatctggaacaataggaagctcccatcaatgctgctaaaggaacacaacgtttctggaagccatgtgatcattccggcagcagggaagatacatggggtcacaggcagtcagactccatccttgtactgaggccactgcccaccatgggtgtgctggccagcccatctgccattctagccagcgatatacggagagtatgaggcttacagagctgaagtcttctgcattaaaaggcttaattttcctgctcaaaggcagtcttttagaatagcaaggaaaaattattttaacttagaatggggttaaactaacagcaggactgtgtttagagaaaggaaaccatacagaaataatttgaaaacataccatctaaaaggcagtaaaaagcaatggttgaaagcatggacttttgagtccatcagacacataggtttgaatatcacatgcccacttactttccatgtaaccttagataagcctcagttcctcatctgaaaaccatacctatctgacagaattgttgtaaggatccaataagatcaggcgtgttacatgtttagcatagtgcctggcatatgggaagctgtcaataaacattacctcttgcactgtttctgttacagggagcaggtgatgtttagcctggagaactgaaggctcaggaagaacggggtcttcaaacacctgaaggactgtctcatgaaaaagagatgcacaagacaggagaattgagcagagagatgtttaactcaaatcgaagaacaaagacagcattgaatcaccacctatcaagggtcttacttgaatagactttggtttggatgagaggctatagaagaaaacctcaaaagtctcttccaattctaaggtttcatgattccaggcatttggagaattaggaaaaataatcacttaaaaaaaaaactatttagtgccaagcttcctaaaacatctttaaaatgtccaatatccatgaatcatagggtattatccattttatttgaaaaccatggaactctactactagaacttcattctaggttgtttaaaacaaagtacaatgcaaaactgtcttctttcataagaaccattttctagatgggcatagattctttgagggaattcttatcatgcagatattttacttcaaaatctaaacttgtaccactttactggaatgaaatattaacgctattaatttaaacatcataacattttttaaaaataaggtgttaaaataatatttattcatcaatcctataccactacaatattttagatcagtgatttaatatctgaaaaaatttatcacatactatgcataccactgatcagcagaggctgaaattttactgtaacttcagtccaaagatacaggttttaatttgagttctccataattcacagaaatatttaagggtaaatataagtcttaattaaaatccctattctcccagcatgtgctaaacccaccctgctccacatgcagacccttggccccaaacaatcccgagaggatgttggctcagagcagcaaggagctgacagatggggcattcggtaaaggagtggtgctgggttttttcatttttgttagagacgaaagctgtgggaaaaacattctccacttaatctattttattttcagcaaggttttacctgtaaatattaatttatacaccagcaaaactcactagatgcctgggctacatgaatataaatgaaataaagctatccaaactaaaaaatgaaatttcctgtatcttcctttctcaggcagaggaaaaatatccaaggatttaaaattctatccagtggtttcaaaggcaacaaaagatctcacattgagctctcatttaaataggtggggttaaccagggtagaaattacaagttaaagtgctgcagcataaagaagaaaaataatcatttatgccattttcaatacagaatttatttccaaatcaaaaccctttacacttggaatattgtcaaatctcaaatttttaccttgctgagatctacgaccaccttttgaaactgagacagtgtaggtatgattactccctgtatactcaagggttaggaaaatggaaaagaaccgtgagcccctcaagaatggtggcttttcttattggaatgaagtaaataaaataaattcattgacaatgcatttaatttctttcttagcaattaattgtgtatctacattgaatgataaccgtgtaaacagtcaagatatgcatgtggcaaatgaaaaataaagcaaaatgttttatcctgagttacatggattcccagagtgcaacggatggggaaagggttggggggagggattctcctaggtttgataacactttccttaaattcaacagcaattcacccctgtttagctgttctacaatgctgattaagagggtacagcattgtgccctctgggtgctctgtgctcactggcttgggtttttactgggacccccagttttgtgtccaatggaagttgggaacacagcactccaaccttccccatttttaatcctcctagagactcctaaaataatcctttgaagttttgtcatagcagagagatgctgtgagagggaaagaggtttccacatacttccacccccacatagctgaacatgagctggcatcaggtaaaagttcacaggattcccagtcttggaagactcttcctcctctcccggcctctcagtttgcacactcctatccattcctttaagcccagcccagcccaatcccatattactgcatgaagccttgtgctatagaatgaatgtgtatcccccaccagaattcatgttgaaatcctaaccctcattgtgatggtatttaaagatggcatctttaagaggtaattaactcataagcgtggagcccttgtaagcgcccttacaaggagagacaggagagagcttttcttatctctttcagcaccatgtgaggatgcaacaaggagacagcatctataaaccagggagagggccttcaccaagaacccaccaagctggtaccctgatctcagaattccagcttccagaaatgtgaggggaaaaaaaggctattgtttaagccacccagtctaaggtattctgttgcagcagcctataacagagctgattgagaaaccttggctgataactgcagcttccttggatgaagtcagcctctcttttaaaccccaggaccacactgtagccctttttacacggttttatattgctcgtggttattttacaggattttggtcatttcccctcaactacagtacaagtaacattgatggcttagagtcttcttttctttcatattatccactacaatgtcgaacatgcggcatatacctatgggatgctgcatagacctgttggtgggttgattgaatatcacctgcctacctgtattactaagttacagaaggagaataggtgggttaaatgctagcatctcttacactattctacttctcttgatgggggaaaaaaaaaagatttagcacttactgggtttagaagctataccaggcactgttcagcactgcctcacaatgctaggataggactagaccacattaaactctgcactgatttctttccctgtgaagtccttttacatttgagcaaattatccatatttgattgaaatgagaatttactagggcataattgatatgtttgactgaattagtcacattttaaacaggtggcacaagataggtcatagtgtgaatcagaatacatttagttccactgtttttctgattgtcctaaaatgaatgtgacttctagaacaagtacttctgaagccttttagtgctttcatttctgacatttgtatcagagatgataggaattagtgtcatgtcagccatctctggcagaaaaaaaaattattccctcaacaaaaggtaacattcttcatctggtgcaggcctgtgtttctgtccttaccacacatggaaaagaaagggaattccaacccaaaggacaggcttgagggctgccacccacccctggggttattcagctgttcatgctcaaccacaactccaccatcaaacctgtggcctctgtaagccagaattggtgatttttttctttttcttttttttttaaacaattgaatcctaagggtatttttcttttggcgctgaaacgatattaaaatttactgcaactttatttaaaaaaatagaaaactaatgtttctctgggtcttccattttttgaataaaactgactcttaccacccaacacatggatttggaaggatagcagtacaccaccttcttagctcacttggctggaacatgagctgatgaagtcctagtctcaagtttggccttcaagaaaactagataggcttgccctatgccagagccaatctagacctgccatcagttctgtttcttctttgtgtgtgtgtgtgtgtgtgtgtgtgtgtgagagagagagagagagagagagagagacagacagacagacagggtctcactctgtttcccaggctggagtgcagtggcatgatcatggctcactgtagcctcaaccacccaggcccaagtaatcctcccacctcagcctccagagtagctggaactacaagggcatgctaccacacccagctaattcttgtattttttatagatacaggatcttgtcatgttgctcaggctggtctcagatgcccaagctggtcttgaactcctgggctcaagtaatccatccaccttggcctcccacagtgctgagattacaagtgtgtgcaaccacacctggcccatcagttctgtttcttgaccaatgactatacctttaatgctaatctgcctttgttcacaaaatagggcaagtcagtctgaatggctgagaaactggaggagaggtaccactcaaaatgaatatcctcttaatagcagatgtaaatatcttcctcctcattatcatcatcataacaaacatttatggtgcctcctatggagcagggattttgcttaggactctgaactatatcttacttgtcttcattaaaaaccttatgaaaaaggtactattattaactggggttttttgtttttgttttgtttttgagacagagtcttgctgttacccaggctggagtgcagtggcgcgatcttggctcactgcaacctctgtctcccaggttcaagtgattctcctgcctcagcctcctgagtagctgggattacaagcacatgccaccatgcccagctaattttgtatttagagacggggtttcaccatgtttgtcaggcttgtcttgaactcctgaccttgtgatccacctgcctcggcctcccaaagtgctgagattacaggtgtgagccaccgcacccagcctgggttgtttaacagataagaaagcttaagaattagagagataaattatcttgcttaaggtaacacagttaacaagcattaggtcaaagtttgaactcgggcagtctgactacagagcccaacctatttcatataattcatattaatctattttactcacgagtatcagcaccactagataaatacgttaaaataatctataatttgaacagacatctcctaataacaaacataatatctataagtcgcaaatatctaagaaatttacatcagtatgacatggtatttgttctagaaataatataagttcaaacactctgagatgagacgataaatcactctgaaaactaacaaataaaattgccacaacataaagaaatagtacaagcactagtcaaagctagaggtcactctcaatccatgtgagaggaagcaagagtaagacactagagcaagaataagtcaccatccacatgtcccaaagaagcctcagtggcactgcaggagatacagagacagatccatggtgtccctgaagctgggactaagccagggctgtattacaccaaggaaaccagcctccctaatcccagagggagccttgaagcgtcttagagggagactaatggccaacattgagaacacatgtctattagcttgctgagcctaatgaagtaatacagcagagactgacctcattctagaaacagataacagtggctgtgcacaatgctatgcctagacccctacaccttgccagcctggtgttccttatgtattcaagatacataaagattagatgtgtagacgcaggttgtgaggacagtgtttggggataggaaaagcccccaattacagctaaaagagatgtctcttttgccagaaagtgtgttatatcaattaaatgggtaaataagcccttttcccactgtggggaagcaagggcctcttgtgaccctctattgattaagactgctgtggaatgttatttgcaatctcattgcataatggaaatcaggaggtagctgtcatggtttctgaagacaaattgctggtagctgagacaaatcatagcctctttcatcttttactgttctcaattcccaattaatgtatatcttacaatctaagtttcttaaatcagtctgctctactgtctcaggtagtaaaaatgtgtaaaatggtaatctgcctgaccctactttaagaaattgtgtttaagtgaccattgcactgatcattattcatgagctatgcattacttaataaggaacacaactcaaaaatgaacacaattaaaaataaatccacacaacagctgctgtgattatgaccaatatgaacagaaatccaaccaggtgtgtgtcaaaagaaaaaagctgctgccagacagaacactgttaaatctcatttttgttttgcacactttgacttgctaagtcagccagcaagcaatttgtatggagcagtgcttccaaagtgtgatgtgcaaaagagcagcatcagcatcacctgggaaccattagaaatggcagttctcagaccccaccccgggcctccccggacccactgaatcagaaactctgcaggtgggctcaggaacgcgtgtttcaacaagcactctgggtgatttctcgcatgctacagtgtgataaccattggactgagcacaggacagccttcagattttaagtcttcctaggaaggcattacctttggttgcaaacagctatgagaagagcccaggaagacacctgtgttaaaaccgctgcagtcttcaattgtgctgtgaacctaaaactgctctgaagtgaagtccataaaatttaaaaacctgcagtctctagggtgaatgggtagaaagagcacagtactttccttatgcagatttatttacatagaccctgacttattctagaaaggttttcagacaattttgtaaaccaaaatatataacatccagtcacaaaccattcttatggaaagacttctcactacttttcaaacaacctcattatttaaaacaccccaaacataggcatttatcactaaaagcacgctcttaagatgtcttcggtattcacttcaggatttcaggccatttaaggctaggggaaagaaaagaaatttaaattcaccaagtttaaaatgtgctccgcccaagagtcatggtgctccctgaactgtctgagcatatgaccaccatgctgattctaagttattgcatgtttcgaagagacatgacttggaatgttgtgtcctgtgaccctgtcttacagcaagatgctttcagcaattcactcatctggcccctttgttggtccaagaaagggccctacaccaccaaaattcattctagagctaatagtattcggatgaggctctagcattgtttcaactgtttttcaaaaaacaaatttgaagagcaaagggaagtaacttgtttatcagagatttgtaaaataaagtatggtccatccatatgattaaaaaccaagcaattattaaaaaaataaagtcctgcagttctcattcttgaccaaacatcagaatcacctggtgatcttttaaaacataccaatgcagggctctacaccaaccaatttaactggtcctggctagggtttgggcatccataatttttaaaagctatgctggcaatgctaacatgcagccaggatcaagaattactgcagtacatctgtattaaccaacatggaaaattttcccaaacatattaagtgaaaaagaaagtcataaatcacatatctgttaataaaatcatgtgtgcatgtgttattaacggatttatgcatttggaagtggactttcctttcatactatgtattgcttaaaccttccaaaatgagaatgtgttcatatattttgcttattttactttatttttgattgacaatttatatgtatttatggggcataatgtgatggtttatgtttacaatatggggtgattaaattggctaattaacaaatccatcatctcacattttttttggtgtatggtgaaaacatttaagatctactctttcaacaattttgaaatatacacgcaatttcttaatgttaaaaatacatttaaatggaaatttgtaggaaaaagagaaagcacatgaaaatagcaactctcaaaatataatcatgtttccttctttctccgcttctccctattagtctgctttcacactgctataaggaactgccagatactgggtaatttataaacgaaagaggtttaattgactcacagttcagcatggctggggaggcctcaggaaactcataattatggcagaaggcaaaggagaagcaagaaaccttcttcacaaggtggcaggaaggagcgtgccaaacaaagtgggaagagccccttataaaaccatcagatctcgtgagaactcactcactatcacgagaacagcatggagaaaaccacccccatgattcaattacctccacctggtctctcctttgacctttggggattatagggattacatttcaagatgagatttgggtggggacacaaagcctaaacatattgccctcctttttctaaaggagtatacaagaaaaataaacaaaattatacttctttcctatctattcaacacatatttccaacattgagattgggatgagggagagagtagagagatatgatttattcattcattcattatttctctgacaggcccatgctaggtgctaggaatacagcaacaaactagatagacatgcccctgcccacatggtgcttacagtctagtgggggatgcagacaagtaggtaaacaactacaacccagtgagagagacattaaggagaggaagcacaagctgcttgttacttgtaacaaagagacaatctagtcaaggaaagtgagaaaaggatccccaaagtggaagtggaccttcatcctgggtaaaaccctagccattaaagagttttaagaaggggaaagagattaccaagtctccattttgaaagatctctgtagctgggagtttaagtgctacttaccagtcctctctcacctaaggagagtgagctcttttcaaagttaaatgaaaccctgctacagtaccaaagagttgactgaagaagtccatctcccaatattccattatctattgccatcaaatgagattgaacatgaaatttacctcctactgagtttactgactgcactcatttatgagttcatctctagatgagcccggatatggcagatttaccttttcaaagttttgaagctaataaaacccattgtatgcaataaataactcaaaaaaatgcttggctttatagaagtggttgctacaattggtggagtctcttggaagaaaatatatcttcataaacatagcagggtaggcgaagactgccagggaaacaagctgcttctcagtatttcattgacttcacatgaagatcaattttagccatttataatcagcacacttccacatagggtgaaattatctagcccacccacaaatggatttctatttaaaagtctcatttgattgctttgggaaggatacactacagactatctaacccctatccttcaagggtagaaaattaacaatccaggtaaagttaactagaaaaacaaaagagagaggaattatatttgacagtgtcctcttacaacccagtgcatctttgtggacattaatgtgagttacctccagcatcaatgtgctatttttaacttagaatattcaatctttgctcaaagtaagacatatgattagtgtttggagtaatcaatttgctttaatttaaaggagagcagaggaaatgttctagaaaggagaaaaaatttgagctctttataaaacacaaatttatgggcttctcaaacatttccaaagaccctctcctttttaaattctttcaaaactacacaatctcttatggggagctggacccctcttttcactgggttgtctgcagtacaaaagcccctgaggtgtcgtttatacctctgtataggatggagctgttctgggtctgctattctaccgttacatgtcacattatcctaattgatacttctgttatctaaagccattagcatgttatatgagtgaagcaatcacctaggtctgctctgccccatgttagctgatatacgatgtgtgtgtgcatgtgtgtgtgtgtgtgtgtgtgtgtgtgtgtgttagggtacactagtgcatctaaaaagttcagatcattaaattcttgttctgtaactctcaaatttgtttccactcccaacacacctgagggatatgagacactcatctcaataaaaatagttcccagagaggggcttgggaggcacacatcattcactggatcctgccattcgaaaagcctcccaggtagttttaataatgcagcccacaccccttgtgggtgaggcaacagcagtatgaaccccaccgtacactcgaggttgagtatcactaatctagtaaagcattcagtatcctatggatctacgccacatggcatcttctgttcccaggttgtgtccagctccaggcccttattcaaccctcttctaaagttaaagaggcccatttttttcatttgcttctgagcttggataagaaaagaaacaaagataggatgacaccacttccctctaggtcagatgagcagggccacctgtattccagcagaggaggtggctatccactaagtgcagtctctgttggggctaaatgaacctccccaactgatgccagcatctcctttgcaaagacaaatcccatttaattccacaattagtgatcctgaaggaaataaaatgctcctctgacttaaacacagacatactaacatagagatagctgacaacacctagatcccttgcatcaggttttgattaggagaacacttaggaatacaaggactggagaggctgacacaggaggagcaagactgaagaaagtggtaaatggggctgcatggaagatgttgtctccttcacattttagttcaggaagatactgcaggtaaaatacatggccttcctaaagttgtccaaaaaaaggaaactgagacatttagggatcacttccaaatttggcccaaatattttccataaaattttaaacacatcgcaatcacattcttaaaaccccaatttatgtttattgttgagtaggacagtgagtaagttcatgaattaagaccctgtttgtattccttatgatcaaggttcattgcatatcttcagtggagatgctctaccttctttaactccattatctgggaataactagcaatacattaatttctgggcatatttttagattctgtgggtcttttgctaccctgaaagggcctaagcttgagaaaactgtcctaaaacttacttttactcaagtcataacctttggaaaattagtatttaagaaaagtattatttttcaaaaaggagctatatgccaatctccaatgcattaactgctaatcattcctctgataactattctaatatttcatgtccatcctagcatatatgtataaacagaagtcatccatacatagagtagacaattttctatcccaattgctttataattaatactacaaatggagtgcttcctgaaagtcacataaaaatcaaactaaagtagcataagttgctattatctaattcacattcttatggttccagaatcacctgtaagatggactaggcactgacatctcactgacggacttttgaattacagacgattttcaagtccaataacttggttaataactagatttgcttctgtaggttaaacgcgcactctggaccagtgaaccgatcatgttagtcatgacatctaccataacagcaccccctcctggcgataagtgacccacccactccctgcacttcagttaagggtagcaagagctgccctttcatgtgttggtgggtgtctcaagagatggcctggggcattggactctgcccagagagtcagtagtaaccctctcacccagtcagatggggtccctccagaattacccaagaaattaagagaactaaccagtcagtgagggaagaatagagaagagagaagccagatccccgctgcataaaaacaaaacaccctcttgccttcaggtggcctggagtttccttcaatagcccaaaaaaccaaaggacatgaccaggtcctgatggaagccttcctgcattttctcattaaatatacccaacaatctaacacaatcttattattcccattttgcagattggctgattctatggcaaaaaaaaaaaaaaaatgcaaacaagcttggaaaacctcatatgaataccttatctcctccaccacactcctcaaatctttgcccacttttggctgggcaccaggctacaggaaacagccaggattcacaggaattacaatggtattgacaggaacccgaattggtttataaggagagggaaaccaaaaggagaagattcttaggaaacttttcctctcctctaaaagtgatgtttttgaaccacagttgctaagttaaaaatagaaaagagatgccttggagcaggtgaggagggagttcaaatcagagagaagagttacagaaatgtctgagctggacaccaacccagagcagaaaatgccatatggcacagaaccggggtagctgggaggaatactagatcccaagatgtgggaggaagcctggagaattctggttccacatcttccctctaagcaaggagtccctcttactaagagaaatggttaacaactgcctagtttcccttgaaggtttccagaaatggagaactagagcaactctggctacatgttttaattgtgtccttctcactgtcaagaggcgcttcttaatgtcctgctcaaatgtctccagcacaccctgaagcctgtttgtgcctcttcagtactccttagacgcagagagcttctgcttagcatcctccttatttgagaaaatttcatctatctgaaaatagccattaagttgcctcataccattttctcttctaaactagggaaatccatacagaggctgcacagccactcaagggggtgttacaaagaggattccagtgccatgagtgggccagactagatgtgcctctgagatatctgccaagccagaaatcctttgattcaattcctttcatcttttgtgtgacatttcccatcactttgttcacatttgtcacaatacctgtcatctgtccaacttctccatattcttttaatatttctaaatctaatgtgcataggaccttttttttttcttttttttttttttgagacagagtcttgctctgttgcccaggctggagtgcagtggcatgatctcggctcatcgcaacctccacctcccaggttcaagcgattctcctccctcagcctcccaagtagctgggactacaagcgtgtgccactatgccgggctaattttttgtatctttttagtagagacggggtttcaccgtgttagccaggatggtctcaatctcctgacctcatgatccgcccgccttggcctcccaaagtgctgggattacaggcgtgagccactgcacccagccaggaaccatttttcacaatataaaacaaaggctcattaattcagattaagttgaaaaattcatgtccccctgagtaagaaaccagagtgaaagtattttcaattaaacaaattatgtctattacaaaagactacatattggttattaataaataaaatgagaaagttaatgaaaatggtgagttaacaataactttatttttactgcactttatacttttcaaagtatttttacatatattattccatatttccaattttattcaatatgtaaatgcaacatatgggtaatagatcaccaaacctaaatcaaaaagtctaatttatcctgctaaatttgaacttttaatgcaataagaattatatataattattccaagtctgtatcagagcagtctgaattaataaggttctgctctattgtagttataataagcctgacaattttatgaccatctcatctcccagagtgtcactcccatctacacattagtaataaatactgtttcttcatgaacaaacttttgtcataacagagcatcccaccttaaagaagtttcactcagtaaattaaatagctcaaataccatagaaatgttttccatgataaatgcgctgagttcattattctcttcaaaaatgcttgtttaatttaaaatgagcctaacaaagaggttatcccaagatgacaaggacccaatatatcacagaacttttcacctttctctttgttcaggaaaaaaaaaaaagagtcaaaattaatccagttaattgtaagtaatggaactaaaccaatacatgtagaatgccccatatagaatgtcccatttgaggaacctggtaacaccaaaagggtctatgagcaccttcaccatcttcactttcttcttaaacctgcagtaggagtcatagcatttcattgttctttcacaatggtcagaaagacaatgcctttacctaccttaaaaagtcttaaaatgttagcaaccatgatggacacggagcttgctgcagcacctatgacgccagaaatcttgtcgggcttggtgaaaatgggtggatctccattagcacacttcacatccgaagcatctttctctattaatgcctgcacgaatgttagagactgctccaaagcataggtgtccctagagcacgtgtcgaggatgcggacacccagagtgatgttggaaaggagatcagggtccttgttaatctggtcaattgcataaagcatggcctccagtctgtgaatccccttttccttcttcagctccccacaaggcacccctctctctccctttgcgtggacagggaagagaccccccaaaataatgtccccatccacccgtatggaatgggcatactcctggctgtgagttctttgcatcattgtgaggatccagtagaacttggcggtcaagaggaagaaacaagggcaagaggctgatcgctttccctcgcataccattttctccacaggtggtattgcaatccaagacccaaagtttattcttgccacagaagaaagggcaccacctgaggctgcaccttctggaggctaccatcagggcccatggggaaaaggctctgtgggcattagcaagttttcttgatttgaatgtcacagtgaatttccatcagacccctaaggttcaattttatttccttataagatcaacttgcctggaatggtgcaaaaattagaacatctgaggttctgatgttgggatgaggtcaacaattcatgtccttgaaatcagccttgtagcagaattattc

SEQ ID NO: 2634 - DNA, 804919 bp, Homo sapiens; identical to SEQ ID NO: 2633

SEQ ID NO: 2635 - DNA, 813778 bp, Homo sapiens
caacatttgcaaaacattcctttattattagaaataaattatttgtataaaaaattgcatgcatcaatcattgcatttatttttagcacaacccagggcttcaatctggtcagccattacaagaaacagactcattgtcttatacaagttaaacaatgtgggacaggaacgggagttctcacaatcacagaaaaatacaagaataacatcagacattatttatttcaacagcattttttttcacgagctaacattagttttccttttgtgatttgttttaactgctcatgaataagcaatactttagcttgacactcattggttttattgtataaaacgggtttcttcactccccgtttattgatacttttggctcatggctaatttttgttccttacaagactgactattgatttgattgattgtagtctacggagatctccaggagtgaatttttgcggtctcatgttcatcatttaagatcatataccacatctcttcagattgtgccatttccctgtttcagattgaatgattgctgtaactgatatatgttgtcttggtagaggaagctgttaagataaatgaggacaaattaaaatagtatataataatacatccttttgttaatatgattttaaaattcaagtcctgtaatgactttttaataatatccagcttttacagcatgttactcattatttttaaaccattcacagtcatgcacagcacaacgacatttgagctcgacagcagactgcattatataaaggtggtcccatgagattataatggagctgaaaaattcctatcacccagtgaacacataacacaacacaacacataacacaacacataattcacatgtttgtggtttgttgtgtaaacaaatttcctgtactaccagtcatgaaaaagcatagcacatacaattatatacagtacatagtacttgataatgataacaaatgactatgttgctggtttaaatatttactacactatactttttatcattattttaaagtagacttcttctacttatacattataaagttaactgtaaaatggcctcaggcaggtcctccaggggtattcccgaataaggcattgctattacaagagatgacagctccatgtgtgttattgccccttaagaccttccagtggaataagatatggagatggaagtgatattgataatcctgaccctgtggaggcctaggctagtgtgtgtgtgtgtgtgtgtgtgtgtgtgtgtcttagtttttaatacaagaagtttaaaaagtaaaatgaataaataaaaatagaaaaaagtctatccttgagtaagggtataaagaaaatattttttatagctggacaatgtgtttgtgttttaagtttttattacaaacaagtcaaaatttaaaaagaataaaaagttcataaagtaaaatttatagtaagctaaaatagtatatattgaaaaaggaaatgtttaaaataaatttagtgtagtctaagtgtagagtttttataatatctacagtggctgggtgcagagactcacgtctgtaatcccagcactttgggaggcctaggcaggtggatcacgaggtcaggagtttgagacaagcttgaccagcatggtgaaatcctgtgtctactaaaaatacaaaaattagccgagcatagtggcacatgcctgtaatcccaattactcaggaggctgaggcaggagaattgcttgaaccgagaggcagaggttccagtgagccgagatcgcgccactgcacaccagcctaggcaacagagcaagactccatctcaaaaaaaaaaaaaaaaaaaaaaaatttacagtactgccatgtcctaggacttcacattcaatcaccactcattcacttaaagatccagggcaacttctagtcctacaagctccattcatagtaagttccctatttacatgtataccattttttatcttgtatactctatttttactgtatctttactatgtttagatatgtttagatatacaaatatcattgcattacaactgtgtacacaattcaggacagtaacatgctgtacaggtttgtagcttagatagactaggctacaccatattgcctgggtgtgtcgtaggctataccatttggtttgtgtaagtacactgtatgatgtttgcgcaaagacaaaattgcctaacaacacatttcttagaacatgtcatcaagcaatccatgactgtagtaaaaattaaatgacagtagaaacaaaaatgctgcagcaattttaatctgtcaaaatcagtagcctcatttatagtatataaatatttactagaaaactaaaaatataaaagtgctaatctttaatattttggtaaaattttacatttgcacatatgtaaaatgaaagaacagatcaattatctgtcctacaaaatataaaaaatattttttactacctaagtcaaagacctcaattcttagaggctgatgtaatgaccaagaaaggtaagtaattataattagctgtcctatgagaatgaatacctcttccacttaaaaatacacaataatcttagactctagaggtaaacatgctaaaatatcaaatatatagaaaacatgtgaattgccaatgcatatttatggtttcttttggtttcatcaaaaggagacaaatgaagataaaatttaagaaaataaagactcaaataaagaaatgtttaattgttctgttgccaacatactgtaaagtaaaactcattattgtaaggccattacagagatattatgccaaatttatactcatgcctaagcttctggagaatataaatctaaatccaaataattcctttgtattgttgaaagatgtgatgcaatgaatctctgtcctaaaattcaaatgtgatgtcctattttttcatgtaattctggaatgaataatcgtaagataaaagatactttaaaaagcaaagaatgtatgtgtttcaatatatgaatccaattcaggatgaaacagatttttagaaaataatttatttattgaacattgaataagactagaaattgtaaagttcctcctcggaaataactgacaatcagactcattccatcttagtgacactattgatggattagacaagttcttaccagagaccaagttcatacaaagttcacaaccactaaaattaactcagatagccctaagaagtgctactatagatgtttttttcattgttgttattttttatttcattgaatattatgagcttcaggctaaaaatagttgacatatctgcttatcttatctacattgcttatccttctaggttattattgtggcaccctgcaaaggaagtagactttagacctggttttaaattacattctattccctgcaaaatgcgtgaaaaaaaaaaaatcattgggccaggttactgggcctcagttttatcactggttcaaaacctacaatactgtgttcctgtaaggtcaaaagcagaatagatcgggatggaacagctgtagtctggaagaaccaatatagaaccagcctccctccctcctttcctccctatctcccttcctttcttccttccttattttcttttctttccatgaaccatacatgagacctaatggagtcttactttctacttaacctttccaaaaggtaaaatatttgttacatttggtttggtgtgaagtgaaacacaatgattttctatgatcactcacttttactttctatttttaatttatataatactctcgtatgcctctaaatttcctctaagaaaataaaatctgtccttcagttctgcttttgaaggactttcatataatcttcacagacaaggtggagaaaaattgtcataagagtgataaaaatgactgttaaaagggtcatccaacttcctacactgttcaatattttcaacaataactaaaatgtatgaaatagttataaaatttgtatatagctagaaaaagaattatggttgaaatagagtagcaagagctgatagatcttgaacaataaagttttcagaagatgtccattcaacagatggcagtttggattagatcagttttaaggatctttctaactttggggctctgtagctaattaaaaattaacatattattttttgaactcttaaacatggtttctagaaagaaaatggtagaattctattgagaattgagaaaacaattcacaaaaggacagcaatgctaattttcctactggttagaaaaggaagtgtaaggttctggaatcagatgatttagtcaacatgaaagcaatgataagggacaaactttgtggatggcagatacctcgcaagaatctttatcccagaagtattatagagcaaaatgaatcagagatgtaccaatgagttcatagggagatgtttttcacggtgctgatgaatatgctcatatgaaaatcagtttttgagcacagcaacagtaaattaatttccttgtgtgcatcacactgtgttcataagctagaaaaaacaaatctacctccagcagcagctgttttcatgaattattcatgaacatagcttaaagaatactatgtacagcatttgttaattgggtacagttggcaaaattcatatatatcaactttgtttctaactcccctcgcactctgttgtgaaataacacttgaccttttttaaaaatgtaaactatagtctgcaaattcagcaactaacacaacactcattggtttcccatccagcttcgtattacttatatttactctgtgtagcttttgaaactttaaaatcttgaacacagatctaccctttcattgtaggatggccatggaagtgaacaaaggttaaaaatggtgatctggagtaggattgtggaaggatgtgtgaagatgtcacacatctttctctcctgaatgagtacactgtaatcactttacttcggcccaacttattcaaacctaaattatactcctgtaaaagatcaatgcactaaaatctccaaagtacaattaaacttttttttcaggcagtaactgatattatcttgatttactttttgactttacttcaccttctaaacgtgagcatctgactcctccagaatattataggcttaccctccaaataggccttgtttttgcaatctttcattcttattttagagaaaatagagaaatacatgcaggctatataatttccatttcaacattaatagaaaataaccaaaggaaaacagtatctgtatgagatttacttcaataatatgagattggttcttatcaatactgagaattttgtttttcagggcatgtatttattcttttaaagtggtgaaaaagtttattaaattttttctccaccactttccaaaggtgagtctgaatgactggtatttatatcactataagtttggttctttaatttggcaaccatattttataaagttttctggattgctgctaaaaaagaaaaaaaaaagagaaaaacaggtaaaacaatagactctggtgagtcatagtgagaagtgccagtgttcaaattacatcactggccaacagcagtttattggcatcctataatagctttcaacttcctacactaatgctgtcaaggtaggaaaaaaggtaaaattctgtcctcaaatcacaagcattctactttgatgcctttaatggcagttacagtataccttttgctaagagccgaaataggtttatcattagtaaattgcttacctatactcagagatgattgtaatgatttgttactaaagcccatccttaccttgcttcgcatatttcttacttcacaaggtttcatgtttgcagaaaggtgaatatgtggagggtgtttgtgaaattcttgtaaggttcatttctctacacgtgactaaatttggtattggtgacccgaagataatctttttagaaccaatctggctaatgattccaggtaagctgatagtaactgaaaccaatatgtctaattaagcaatgctaattaactatcacaggatagttctgtgtatggtaaattagagtagacaatgcttatctagaaatcttgatagaaaagaaggtttgtagatggaatgtagaccataagttgctataataattaaaccaaataaaattaatttttagttttttcttatatttagtgtcaaaagtatggagagtaggggatacagactgctggatgaatatgagaggaagagaatatttttgcataggattttgtccttaatgcctgaccgggtgtggtaactcacacctgcaatcctagcacttttggaggcttaggtgggaggatcacttgagcctaggagttagagaccagcctgggcaacagagtgagaccctgtctctacaaaacaaacaaacaaacaaacaaacaaacaaaattagctgggcatgacagcacatgcctgcagtcctagctatttggaaggctgaggtgggaggatcacttgaacccaggaggtagaggctgcagtgagcctagatcataccactgcactccagtctgggcaacagagcaagctcctgtttcaaacagaaaaaacaaatattgaatccctatgctatattccaaaagactggaagccactctaatacaagtacctttgcttttctttcttttttgattcatctgtagaacctagtaaggtaaaggttgtaatgtttaccatattcagcttcctggtattttaccatacaaatcttcaaattatttgccactctttcatagataccaagatgggcttcaatagatcagttaaattctactggttgagcacagatttctgtgtattgttatcatgtgctttttcctgggtggactgtagagacgaaaataggtaaagaaaagaaaaatggaaaggtggttgtagaaaagattctatttccaggatcatgaggcttttaaagaagaactttaattatcttaatatatccaagaagggaagtcaagggaagccctcaggaagcccaaggaaaggggaccacgtgggagaaacaagtattaactgtgacttaactaaacatattggctaactagagttctcatttccctaaaggcacaaataacatcatttatatgtgtaagatctgtagtgatattctgtaagtatcagcaaactactgatactataaaaagcacccagtatggaacaagaaaaattgtggaattgtttccaagtactaaaagataatttttataagaagatgacgctttcaaataccaagctttgtaatgcttcaaaagaaagatctgaatgtcatgctttgtaaaagagattttgtgagcaagtttgtactctgtagaacagccgctcatcttgagaccatttgcttcgaatggttttaaatgtgatggtgtcacggtatgtgagtaccatcatgcccctggaaacatgtagcacaatccccaagactaggagaagaatgttcaacgtacatctattaggaagtgctcccgctcttgaccatcggaaactctacagatgacttactgttggtttcaagactctcacagagttcacttttcacctcgccatttggtctgtcatttcctttttggatcagtttgctttgcatggtggcagctgtcaccacagccttgaagctcctcttgcgtttttgaacattctgttctggatgaaaaattataatataaaccttgggcatatagagcatgcccagagatactgaagcacttaaactcatggagacagtaagtgttgttgtctggatgtacatctgagggaagaaaaaaaaaagaatcactgttggtaagcctaacagtaggagataaagcaaataacatactattttctaaaattgttccagcttctctgctaaaggcacattaaaaggcacttattgaaattgtccttaattatagtcaaccattcctgtgtcctaacctgcaaatgtaaatgagtaaggttatttttttattgaacccaatttattaaaataaaaatacaaacaaccaagctggtggagtttattttcctttttagattataaataaacatacataaggaaggggaccaaaccagtctggcaaaacactaacacttaatgccacacagaacttctttagaaggtactagtgggccaagtgttattgtagcaataagtttaacccagaaggtaagtatacatagtgaaaatagagtgggagtgcaacattccagaacatcactattacacacctgtgcttgaataatgctagtggttgcatcttcacatcattacataattccaactaccaaaaatcacaagcatgtcataagggcttgattttttttaacagtccctctaaagaacacttccagaaggttctcagtgatagcatcatatcgaaataagtcaggtgcttttataaaatatgtaagatctcctccctccaagatatatgcactgggatatggtcccggtcactgcattctgaaattctccccctgtgctcattgcttgcccttatcccactgaaatcgactgctctgatacttacagagagagctctttctggaaggtttttctttctacaagctagaggttaagaatctgaaaaaaaaaccaaagctaaaatcactgctttggctttttcttttttggttatggtatagaaacagaaacagcagtatttcattctttaaaaacagaaacaaaaacctttgatctggttccacttttcatgtcctgagctcaaaatagaattttccccaaataacttgggatactgaggccacggagaaaccacatcttaagactgtaaagagattctccctttgtcatatctacgaccctcattaatagatctgttcactctatttacatctctgaatatgatcctgattagttggattttttaaatatgttttaatctgttagtcttgctaacatctatcatactagttagatctcatctggcaatcctcaagaccaaactaattgtgtccttttaaataaagaatcaaaaacaaaacaaaacaaaacaaaacaaaaaaaaccattcgccctcaagggtaaataactgaatcagcattagtgttgccttttcctagaggagaaggtttctcttaacagatggcaaaaccttgcggtaaagaactgtccaaaccatgagcaggatgtgaggcacaagttaagaaactgtctttggatataaaatcataccatgcacactgctgaatttactgcccagttcatctgccactaaggctgtccttgcatccttgcataagagctcattgtttaagtgtggaaaatgctttaacgagatttactacaaagtttacaagatttactacaattaagaccatcccaatgaaatagggatgtgtacgtttacggcttataaatctcctaagttttgccatctacttttaagcaacctattattttaaacattcctaagcttcctaagtattggttaatcttttttgaattcctgcttattttcaagctagcattgctgcaaaaacctacatagaaaattgactgcagagagaggacataaaggtaagaaaagaatgtggcaaagtacaaaccacacccatacatgttccaatgccagtcaaatagaaaaccaccagtcagactctttcaagtcaatttagcctaaaaacaaacaaacaaatccaacgacgaaacagccataaaatgatgggaacatctatactgattagttggattttttaaatgtgccttaatctgttagtcttgctaacatgtatagtactagtccaaatagtataaaaatatttttgtaataaacatcctatacattttctctgttaccaaaaatataaataatagtcttctcttatttggaataatttctgcgatatatagtaaatttaatcctgccaaatattagacatgaagaggactttggaatgctagcttcctcgttaaataaattaccgcagtctatccttttggcaagccaactcaatgaaagatgtaataaacacagatattagaattaaatagtaccatggttagtgtagcaagctcttcattggacgctatactttcaaattataccaaaatgctgatcttaattatgtactttcttaagacagcttctgaaaaattttaatgtgagtttaatacaggaaaggcatctaacaaaatccttagcaaactaacagaagaatagaaaaccaaatactgcttgttctcacttataagtgggagctaaatgataagaacacatggagacatagaggggaacaacacacactggggccttttggagggtggagggtgggaggaaggagaggatcaggaaaaataataacaggtactaggcttaatacatgggtgataaaaataatctgtacaacaaacccccatggcacaagtttacctatataacaaacctgcacttgtatccctgaacttaaaataaaagttaaagaaatccacaaaatcataccctaagtccacaaccttacagtggcctagcatttgttacagggccatggaaggaatatgttccagtagacctgggtatgaattctgaaccaccacttaaatacatttttttaaaagataaagtttacagagaaactctagagttattttctgggtgattaaagtccccaaaccaacctcccaggctacaatctaaaccaatcaatcttccctggttattggacaaatatggtatcttattttcttctctgaacagtaagttcttatctatgtcacagggtggggttgggggtaatacttttctcatagaggagttacagggtagcatgatatatttataaaatctcttacagatacaagatagctcaagaaacattctttaccctacaactttgcatctaaaaatatgctaacaaagtatcctcccaggagtataggacaaaagaaggacctattacacacttattcaaaccagttttgtttagagaagagctgatagccaggctctgactatacgatgttgaggaaaaggcctttgtaatctcactttaatgtagacagaataaaattttgtccaaatgtgaactcaagaccatatttactgcctgggccacatgcttagaataatataacagctctttatctcaaagttacagctcatcagaatgcaggaggggactgtattaactcccactaacccacaaaaattcaagagatgctagcaatgatattggatatgtcaataataatcttctctttcccagccttctcttacgtgctccctcctggccctgtcactccaaaatactaacacccagaggatggggactatcttttctatcacacgcactgatggcttgttacttactctgcctccatgccccatggacattttgaacctgaagcagtcagatgccctgaagcagatttaagcaatctctagataagccaggggtgagctgtgacaatggagcatactaatatgaaatcttttctgggacctattacagttccctcttcaaactctggataggtcatttgtacatatcaaggtctactcaacgtaggccatgatgtggtatcattaaagactccaggaagagtgaggagggaggagattttatttttccaggataaaggtcagtcttttgctttcaaccagctgccagtgcacagaccaccacagactctgacatccaacctggtatttttgcaaccccttagtaactaaggtaaactattatgaaacctaacactcaaagcaactttatgccacgtgataagaaacagactcagtatttattcctgactatttctgttttgccctcgatggtttaatcttaccactttgttttagtcaccaggttctgtttggctgctttgcataccgtttgaccagctagaaagctacactaacactgacagcctgtatttctctgcttctgtttctacttcctcatctgcgtgtctgccaaagtgaaacttgcatcaaaaaatgggttttcttttgctttttagcagccaatggacttcaaaataccatttactactagaagtgattttttttttttaaagatgaagaagtttatagagaaactggagttgtcctgtgggtggtaacaccccaaatcaatctatcatgcaaaagtccaaactcataaaattcccctagcaattgaaaattgcaaaaaccagaggcaaccattcagctttgctggctgagcctgaaaccactaccaagctcatatcaaacgtttttattttgttcctgtcttgtttacattaaatatcttcctagtttcattgcttagtctttttctctctgtctcttactcgcttgctgatcatattagaattacacccttaaaccaagacaagcttcatgggtgtgcacttgtacacaagaccctgtaatagaagggccccatgcttggtttaatgctctgccacgaatgttttgaagtctgtaataattgttaaagaaagactcctgcattttcatttcttactgggttccacaaattatatagctagtcctcttttaaaaatcacttatatactgacaaattccgggcttttcttaggaaaggcatttgtcttttgggtcactcccttcggtgcctgacagcatctgaaacttaacaagcctctgattcccaatcttcatccctaaacttgatctcccagtggtctaccctatctcattaataccgtgcttctagttcttgggagagcaggtggacagggaacttgaaattgtcttttactccttttttatactcccaccctatctatgaccatatcctattgattctaccttcaaaatttgctcagaactttcagaatgtctccactggtgttacattgctcagagccatcatcatctctcatttggatcagtactgtaactgtcctagtgttctctttcctgctgcccttgctctcttctgtttgagcatttgattgatcctaacacagaagctagaataatcccattattcataaactgaattaggtcactcctactctccaaagcctactctccaatgacttcccattgattgtatcttgacaatggtccacaagatcctctgagaactcctctggtttactctttttttactcattcccttccacccatactggctccctggctgatcttggaacataccaggcatgcttctacttccagacttttatatctggtggcttgcctcttcactgccttcaagtctttactgaaatgccccagctcagtgagacctttcctgaacacaccattgaaaattgtaacccccaaccttctaccagtattcctagctttatcacactccttagtatctaacacattatatcctaaaagtctatatattttactcatttaatgtatgtggtacctatttcccctagctagaataaaaattccatgaatattgggaattttacctgtgttgttcacggctgtaaactcagcacttagaaaactgtctggattaagaaaatgtggcacatatacactatggaatactatgcagccataaaaaatgatgagttcatgtcctttgtagggacatggatgaagctggaaaccatcattctcagcaaactatcacaaggacaaaaaaccaaacatggtatgttctcactcataggtgggaattgaacaatgagaacacttggacccaggaaggggaacatcacaccccagggcctgttgtggggtggggggaggggggagggatagcattaggagatatacctaatgtaaatgatgagttaatgggtgcagcacaccaatatggcacatgtatacatatgtaactaacctgcatgttgtgcacacgtaccgtaaaacttaaagtataataaaaaaaaaaaaggaaagaaaactgtttggataacagacattctctataatcttttgagttggtgtgagttcatactcccaaatttgggttttaaggaatataactcatgtatttccaagaaggaaaaaaaaaaacagatactgaaactacaaaatatcagaaaactggaggactggaggactccattctttttcatagcaatctctaggctgggagagaaatgtaatcttgggcagataaacataatgcccttttaaacagtaaacttggtaataatgggccattttgctctccatcagcaatgaacagtataattcaaagtcagtcgttttcactttgggaataggagagctctgggatctgccctcaaaacaagttaactgtataactgagggtcaggcactcacattacttctaagttttcatagacttaaatcaaaggatttagtgagacaacatatatacacagtggcacagagcctgggatatattaattaataagggatagctttattgtcattatttaaccttgacaacctgttctctattcatcttccttcattctccacgtcagaaacgcttaacactacttctctctcaaaatcagcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgctgctgacccagcagcaggtcagatacattgcactgtgttttcattagtggaggtggagaccagttgtctgtaatccatttgcagtcacttatcacatcccctttcggctcaggacacatatttgcaacatgaagagtcaaatcaaaagctacgaataaagaattgtgaaggaagactacagatgcagagcagggcttgttctccctcctgtgaggtctttctgaacccttaaccttggaatgattgggagaggtggaaactagctaaagagaatgatacagcatcaaccaacaagcagaatatcagcttctctaatgataggaaagaaccacgtaaggaagctcaagatctgttaaagaaggagaaaatctatctgatttacaatgactataattaaacataagtgatctttaatatttggattagtaaataatttgtttttattaaagcctgatggaaaatttaaaaacagagtaaatttttaaaactatggcattattaaataaaatgtggtctttaattttcaattattatatatgagaattatttacagaaatatagtaaataagtaaactgatgttgcattttctactgggatatgtatatgaaaattaatacaaggtgtctactctctcagtgcttattaattcctcctttacaggtatttttgctcatgttttccttcgtggatttctgcttccatggtaacttttggccctttatcactgcagcagcatggacagaactgggaataacagcaatggggatgtctttaattattatcatttgaacggatatcaaaatataataatattttcaggtagagaacaaataaataaaagtataaattagtttagaaagaagcaaggaagaggaaacaattgtttcaggaacaaaatttatctctgaactatattttaaagtatctctatctctatctatctgtctatagttctagaagccaggaaaagagaaaatatgttgaatcctatatttatcactgcctagagacggaagccttgctagaatttaaattttaggctaaataataaattcaggttgtgttatctaaggaaagttggtaaaattatgaaaatggtttcaactgtagttttgcgaaaggcactaaatcttggtcagatagatattttctctataaccctttttaaagacaaaataattgattcagtaactcagtgcaggtgcttttgcggaggcacatgatgttttaaaagtgctatttttttttttctggtgatatcccttaatatagtaagaatcaagaaaaatggtgttatgggctgaattgtgtctcctccaacatttgtatttcgaaggcctaacccccagtacctcagaatgtgactgcatttgaagacggggtctttaaagaggtaattaagttacaatcaggtcattttggtggtccctaatcccatatgcctgatgggcttataaggagaagaaattaggacacaagacacacagaaggaaaatcacgtgataacacagggaaaagatggccatctacaagccataagccatggagagaggcctcagaggaaaataaccttgttgacaccttgatctcagacttctagtatccagcagtatgaggaaattgatttctattgtttaaaccaccctgtgtgtgatacagccctggaaaactaacaggaatggggagttgatatcactgaaaaagttctgaaagttctgtgatagtagttggttgtggttaaatataccaatagaatctcaaagatgtctgatattgattaaaacgatgagtttagatactgtacaataactacaaccataacatctatcaattattgaggatcaagtacagcattatgccaaaacttttatgcacttatttaacccctcacactaatcctgtaaggtaggaatgaataagtctatttttgagaattacacagtcacgaagaagtcatttttgagacacagtcacttttgaaaagtcatacaatacatgaaaataaagtgtagattcaaactgaggtttctctaatttgaaagcccatatccttaccacacaccatctggcccccataaatacaccgagaagtgaaagagcaggattaatgtgacttgagtcctctccaaatcagagaagcatcccttttctaatagatttgggccaaatttcttctaaataatagaggcacagttaaagcacttcaattaatatttagttgtgcattagagggtttctgctgttattaatcagctactttcttcataaataaaagcctcatgtggatcctagaacagctctggctttcttataattacatcttcttaaacttgacaaaataatctagctgagaatatgggcctgaagagctggataagttaatcttttaaatgatgtttagcattgagtttgcactgggttggagcagaaaagtctctgatgaaccactggccaccagaaagaacagggattccctacatgcagaagacattgctgcataggcaccattccacctctatagcaccagagacaggctattgacaatacagcaggcaggcgaaggtggattcaaatacagatgaactgacaaccaagaattagcaaatacttaaggagaatcaagacaccttacaaagagaataatataaacatacaaaaatagatccaatagagctaaagaaggaagactgtggaattaaaattattgttatcttagagaagttttgaaaaaaaaataacaaatccataaaaatatcaaataaattcatataagctaacattttaatcattaaaataaaatctcagtagatgaaggacttctgattctggctatggaggagtagctataatcaaaccaaaccaacttctgagaataactataaaacaatcataaagttaagggaaaaaagactatttggaggtgtcagaggagaaccaaggtagccaggactcaggggaccaagatcctagtaaggaaaaagaaagcacattgacatatgtccagcactctccactgcctcttattcccaggtaacgtactgattctacataggaaagacagaaatctttagacagacctgtcagcagtctcatgggactagggagataaaatctggaatttggggttatcattgcaatcaggacttaaggacccacaattctagggtactacagagaagtaaaccgggtattttataccttttttttcccttgagactttgctgaatcctaagtgtaagaaagcagcaagctaaaaaaaaaaaaaaaaaaaaaaaaaaatcaaacataatctagattcagagagaattcagttagaattcaggtccatggaggagaatgattactcataaaatatcagacatttagccaatatatctaaagggatattgctgaggaggaaaggtaaatcagaaatagacaaatccataaaaacctgaaacttatcctcgaattatcccaatcccagattatatcaaggtgaaatgtcttgatatatatatttcaattgccgactagtagaaaattgaagcttctctagaaggaaataacaatatatataacatctacatttttttaaaatgtacaatgtcagttattcaataaaagattaccagccaggcatgctaggacacaaaaacaaatgaccaaaaaccgtgggcaaacaacaacaaaaactaaacaggtgacagaaatggtgccacagatgatcagaaccaggcttctcagacaaaactttaacataaatgtattgaagaaaatacataatacgatattttcatcagaggactggaatgtgtctgtgtgtgtgcctgtgtgtgtgtgtattgaagtcaaaaattataggagtgaaaaatataataattgaattgaatagatgagtttaataactaattagctacatggcaggaaatgactgatgcattaaagataaatcagtaaaaaaaatatccacggtgaaggatggagactataaatatttttaaaattcagaaagaaattattggagatatataaaacatgatacaaaatttgaataaacatgaatcttaagtcctagaaagaaaggagagatataatagataaaaagaaacacttaaaagagacactggacaataattttccaaaacttatgaaaaataatctattaaattgtacagaaaaaaattaccagatggccacattctgggaaatcctaaaaaatttcaaggatttaaatacagggtatgctatctgactaatgtgaaatcagattagaaaatagaactaggttggaaataaataacaaaagaaaattgccaactgtttgaaaattaaacaatacatttctaaatcactcataagtcaaaagaaaaacaatggaaattagcaaatattttgaactgaataataagatacaacatatcaaaagtcatgggctaaagcagacacaaaagaagaaatcttgatatgattattcatctcaaaaaactaaagaaaagggagagaaaattaaatccaatcaatatagaaggaaggaaataataaagataaaagtcaataaaatagaacacaaatgtaacataaagaaaatcaacaaagctaaaaaaaaaaatctttggaaagactgtaaaattaaaccactcacaaggttgaccaagaaaacaagaaacaagacataaattaccaataatttggtaattattcctaaaaagggaagaagatgtgatataagattttaaaaatatgccagcaaattacttctaaatgttgttagccaaaaaaaaaaataaagtgtatgtttaaagtttaagagcaacttagaaaaaaatgaaaatagtatctaaaactcctgaactatcaaatgaaaaaaaatgagagaaaacttgatcagttaaaataatttcagagaagacaaaaaaagaaacatgagaacatagtaaaaagaaaacagaaaacattagcaaacataaatcattaattttcattataaacactaaattccctatttaaatacagatattatcaggtttgattttaaattgtattctcaaaagagaaaagcatatataaagattataataagccaagttgaaaatacattttctatgccaggaaaatgtaaacaaagaaatctggaaagtaatattaatataggacaaaatagaatgcaagatataatcattaaattatgcaaagaatatatatacacacatacaattaatccattatcacaatgtatgtaagcaacgcattatagaaatgcaaggatagacaaatccataaccatcatgagagattttaattcatcttttcaaagatagaaatttgattatacaatatataattaagaatagtttgaataagtcagtaataaaattatcattttcactgcattattttaaaacataaatgagcttcacagagatcaattatgaattaggttatccagcaacaaaaataaaattttcataacaggaaacatgagactatatcctttcacctaaaaaggtaatcaaattaaaattataatttataaataaatatgagtttttatttggaaaccaaatatcatccctgtaagtaactcctataaaaaggaaagtacaaactatttagaaattgaataatcatgaaaacagtatgtatgaaaacttgtggatacaacctaagtggtgcttgaaggaaaatttaaagtccaaaatggcaatcttaggatgcaggaaatctcaaaaattaatcatggaactaggtaaactttaatagaaaaaaaaaaagtaaactcaacagagaaagaagaaagtatttgatataaaagaagaaagcgataagacagaaaactatagtactcataaaccatatcatatttggtaatatgataagtccacatagaaatgaaaaataagatgtaagtaccagtacaaattagtttttttaattctaaaagcaaattttgcataactttacaccaataaatatatacatctagaaaaaatgcaagattgcccaggaaatagatattagaagtgagaaaacaaaacaaaactatatggaactaaaactatggtgagtaaatcagaaaggtagtacgtgactgacagaatgatgatgaccctgcctgagagagagccagccatggagtgagaacaaggaaaacaaggaaagtattcacccccagctcctatgctgttcccctacctctcatcctctgacacttacatcagcatttttattttgcttttcattgtgtattaggtagggtacagtccttttcagaattagtgatgcaagtgcatggcaaatatagtggcagagacaatttttctgatgtttaatctcctcttctaatattttatagtgtcttgctgctatttgaaaggaagaaaataatggtgggtatcttttcccaacgtgctgaaaaaactaattacggtggcaatgcagaggctccactcaccccttatccctgggctatctctggggagcctggatatttgctaagattggcccctttactaaggacagccctatgataaggagagttgaggaagatgtaaagggaactctatctgaaagggtggaaagcataagacaactaaccacttccaactcagcctcaaagactcagaaccctttctgtgttccacaccttgataaatggtatctttcacaactcaaggatcatgacctgccatgattcagcaatatttttacctgctctttttatgtctgcctagatcctgacagccctagacttactacatctctgagacaatatatagggagatgttcctgggtataagaaaatcttagtgctaggactggagcctccagaagattcccatgaaggtcaaagtagccaggtttcaagagaggaaaattctcagacatgacatttagaactttctataattggtcactatcatgtctgatgtagatatatgggtctgcttggatactagctatggctgaagcactccagaaaattaaaactttatccatacatatggtgacctctccaagtcactatacctagccaagatgaagcatgcactaatatgagaccagtaatctgctacagtgtgtactgattacacaaattggcactaagagccccatgttgaagattcaattatttgtggtaatgacagctttcaggaaaagacaaaatcatttcaaataggtcaaaaccttaaaacacccagtaatcacaacctcagaaactgtaggtctcaaataactaccagtgaaaggtggagaaggctttgaccagtactcataactctagaccacagacaaaaagtcctcttcttgcacattattccataagctctgtgatgtaaaagagagcttagttgttgcacaatcttatctacggctgaaaatcctcaccagctttagcagaggcattactctgaataaagcacctacagggctttaagattattaccgtgaccaggtacctgaaagagctaaatacaagagagtgaaggagaaaagccttatgtacaattttcaatgagaaactagcccgaagtccctcccacaacagtttgagacagcttctaggaccatttcatgacagtcattaccttgctggtagccctgcaactgacataagttctcagaacaagagagttgtgaagtatgagccagaaccaagaaacttgtaagtatattttagagccattagtcactcagaagccctaggcatctaaatctcctaggacagtgaactcagacatcatctgaaatatccctctttttgatgagcatagtgccttatgctactagtttcattaacttcattgatgtcctgggttcagatgacctattttgcccccacccagatcaactggacaaccttcttaggtcctgaatagtccttaggtcattagcagtctgactgagtcttctcttactgaagccctgtgttctgttgagaataaggacagcagattactcctctaatcaccagtctgctcccaaagtgatgcagctcagacacaatattccactgaaccaactagaatactctgaattttattgaaaatcactcaattctttatacatctctcacctgtaaatccattttagtgtgctttgtactcctaacccacaaccacaactcctctctatccccagcctcttctccctgcctctgcccttgtggtcttaactgaaactgctctttccaagagagttgtttccaccccagactttcaagtcatggttgtctttatttcttcaattcatattcctcagggaagatgataaggttggaccatcctttattcacctttgctgcttccaggtcattacagacttgtctttttctccaatatcctgcctttgaaactgtcttaacattcaactctacatcctctttctttcatccttgttcccgtatctgccatcagttgccttcattcattggaggttctggctctggtacctaggcttgctctcaatcccaaatgatgctgttatttcggatgaattctacatctcattctcatgatcacagctagaatcttcaatactgtgtttagtttcttgtaatacattctgtaaaatacttttggcttaatgtattgtttttagtaagagattgtttacattgcattgcattttcctttaagttatttcatttttcccttagaataaatataaagagttatgtcacatgcttcagtgatgtgagcattgttgtcgaggagtgacaagtaactaaaaatatgtagaagggatggatatttctcacttctcataatgcatgtttccttatggaagtggcttgccaggcagcctttcaaggtaccaaaattaatataaatgtgtacaggaatcttttgcaataaaactagttatgacttgttccaagtatattttaaaactgaggctgttaagttttaccacactttactgtgacagaatgtgaacttttccaagtgtgaaaatataggtattaaatagggtaacttgtattttcctcagtaataaaaaagcacatctagctattatcagacaaggtatgtgcagttataatagctgttttatatattatggtgttaaaaattttaattaaatattttatattcaaaatgaatctttatttctaggatttttatggtaattacccacatcacaataacaatatttactacagttttcattgcaaaggtcctgtatttcagttagacaattagttagatagacgtttgtggatggcataaagacaattatcacatgtaatattatatgtataaaattatatctcaaatgccaccagtcaatttaccagcataattttggaacataaaacatttttaagttggaaggccatctggatgctattattaaaactatgttcctaagagtaggagtaaagaattatgtggataaattattccattagtaaatctgataggctgagttccaaatatgtacaaactactgatgcttcagttttcagaataattgcactcaagtgaaaacttttattgtcgtggaggaaatattgagtattctttcttttgatgtgatacaaaaaatggtcctatactttctttttccttttattatttttaccaagcaactttataaatgtagcattttaccaagatgacactcaggagaaaaagacagacatttgtaatagggaaaagggatgtggcataggtagctaacaggacaccaaaatgtgtactccttcttccattgtattggattgtttctggggagtgcctggccagtcatcgactgttctgactagatgtagtgtggttatttgactggttttcaacctatataatgtgaacaagatgataaatgtcataaaagtgttttacagaattaatgtgtgtgcacttttccctagaaactcttacctcctgttgctgattctattatttatgatgaagagacatcaggggatgcaaagctataggatggaagacataggggttcctgaatcactccatggaagaaaattgccattcaaccaggaactacctcagactactatgtgagtgggaaataaaattgtatactcagtgcatatactttgaattattttcctacaagtggtggatacgtatcgtataactggttagtcagcccctctgactaaggaacaagtgaaaactgagaaggatgacagatgatttccatggctatggcagaaaaatgaaattacagtatcctcagatggattgtaacgattgaccttgtgcacattaatacgatgttctaacaaagtgtctagtctatcaaatataatcccaagccattaaatttattcctaggttcagtgacctcggtctttggttagggaaagaaagcaccaagctaggctttttattaaattttcaaggaagaatcatttcaggtacttcatatagccttcagtaccagagggagtttataggaaaggaagtctatataacagcatttccaaaaggaagttgggctgtcaagttaatagcctaaaattcctatgtcagcagctttgcacttgtgcctgatgtacaactttctcttttgacctctttccctcagctagttcaaatctgacactgcctgtaaccaacttctttgtctctggaaacaactattgccaatctctgaatatctaagaaaaaaaataactacaaatttgtcttcatttaaatatagtgtttatatatatacatttttatttttgccattatgctgtgtttctactacataaaatatagttacagttttaaattgcagttttctatgattaaagaagctgaattgcttttcctataattattgagcatttgagtatcttcttctgaaagtgatcaaattttttgcccattttctattgagtcatttatcttttttcttatcaactttagctcctccattacatattatggatacaagtttcttgtatgtataatgcaaatatcttccacttcttttactgtgtggcttgccatctttttatagtttttgtcttgaaatctattttgtctgataaacgtatagctacccttgttcctttttggttccaatttgcatggaatgtattttaccattcctttattttcagtctatgcatctttatggtgaagtgtgtttcttgtgggcaacagatcattgggtcttgtagttttttattattttttatgatttttgaatcgattctgtcactctgtcttttgattgaagattttagcctatttacattcaatgttactttattgataagtaaggacttactcttgccattttgttatttgttttctgattgttttgtggtcttctcttccttccttcctgacttcctttcagtggaggtgatttttctctgttggtatgttttaattttttgctaatttttcattgtttatctgttgtatgctttttgatttgaggttgccacgaggcttgcaaatatcatcttatttttttagactgatgacagctattattttaaactcatgacaatgtaatgcttattacataaacaaactaataagcaaagagaaaactattaaaaactctaaactttaacttcatccccccacttttgaggtttttgttgtttccatgtatatcttagtgtattgtctatgtcttgaaaagttgttgtagttgttatttttaatcttcatttcttagtctttttactcaagatgggtagtttacacatgacaattacagtattataatagtctgtgtttttctgtgtacttaataataccggtaagttttgcactttcagattattttttccttactctcctagcatattttttttgataatcaaattctctcagctacatatgttgaaaaagaatttccacaaccctccattgtgaccattatcatgaatcagatgaacatatatgacggggtctgtttctcaattctattccattccattgggctatttttccatccttgtatcaatacctgctgctttgttactgcataatttgatagcaaacctcaatacttggtagtatatgtcttccaacttaatttttttctccagactgtcttcgctcttcttggtcctgtataattccataaaaattttagagtcagcttgccagttttcgatacacacacacacacacacacacacacatccctactgggattttgattaggattgcattaatgtatagctcaatctcggtatttgatatctttataaaattgaatcttctgatccatgaatttttatatacttccatttacttaagtcctctttaattcgtttctctactattttgtagttttcgatgtagaggtcatttattttgttagatatatttttagttatttgatatttatgctgttgtaaattttatatttttatttttatgtattcattccttctatatagaaatgtaattttgtatattgatcttatattcagtgaacttcttaaacttattgattctaatagtttatctgtaatttcttttggaatatctttacacagaatttatgtcatctgcaaatattgaatcttaccttttctttctaaactttatgtcttttttctttttattgtcttgcactagataggaatatcagtacaatattgaataacagaaattattttcagtatgaaaaacaactaggcatctttgcttttttcccaaatccaggaagaaaacttttagcaattcactgttaagtgtatctgctgcattttataaagcacttattaccagattagataaattctcttatatgcttagtttgctaataatgcattttaagttataaatggatattaatttaagtgaagtttagttaatttaagaaaaatttgcctttttatactttttcagtcttcctgtcaataagtgtgtcttttattaaaatcttgttctcagtctttcagtggaatcctgtaattttcttaaaaaaggtactttttttttagttagaattgttctaaagaatgtaatggttccattataaagagggtattttttaacccatcacactttctaacaggttattaataggatataagagagatgttgatttttttcatttaaaatgcatctggtcattgtattccttattaatgtaagaagcatttacttgatgtctgttgatattctaggaatatgatagttgaaaaaagaaagattatttttcctcttccttttgaagaagtagaattcttgattctgtataatgtccatattagtcagggttctccaaataccaatttcctattgatatatgtatatattatggaaattggctcacacaattatagaggctgagaatttccatgatctgccacctgcaggctggggaatcagaaaagccaggggcataattcaaagtccaaagacctgagtaccaggggagccaatgatataagttctggtccgattccaaaggcctgatgtcccagagcagaaaaaaatcagacgccccagctcaagaagagagacggaattttcccttcctgtacctttttgttctattcaggccatcaatggattggatgatgcccacccacactggtggaggggtggtcttctttactcagtctacctattcaaatgctaatctcttctggaaacaaactcataaagatacccagaaataatgcttcattggctataaggcatccctttgcccagttaagttgacacaaaaaacttaatcctcaggacatactgcattggttttgaatttctgggtaaattctaaataaaattaaggaataaacattcttttattattattattatactttaagtttgggtatacatgtgcagaacatgcaggtttgttacacaggtatacacctgccatggtggtttgctgcacccatcaacccatcatctacattaagtatttcccctaatgctatccctctcctagccccccaccccccgacaggcttcagtgtgtgatgttcccctccctgtgcccatatgttctctttgttcaactcccacttatgagtgagaacatgcggtgtttggttttctgttcctgtgttagtttatttcgttgctgagtcttcaagaatgcctctagaatcttatcattatgaatggctttaattctttaagacaaattttcttcattagcaaatgagagcatttttctattactagttttcacagcaatttcttttcttttaaaaaagaacagatatcgaaggcttcatgcttttttcatattccatttatagtatcttaaggcttttatgattagacaaaataactagatttccttgtatatttaatatattctcattgtgacagtattttaattctattgaattgttgcttccactattttatttactcttttacatctgtatttataagtatagttagtctagttccttttaaacaaagtgtatactcttaataatgcattactacaataactaacatgttatgaattactatgtgtgcttaaaacaaaatacttagtgtttatctcagcaaagggcagaaaaaattaaaatgtattctgaaaacaaaatcaaatatgtttaagaattttttaaaattccattgcatacaaatattcaggcaaaggcaggggctttataaacatgtcaaagaatgaggtcaatatatttggttgtgatactcaataaacttccatttaccattctcagaacatatccatgtggaaattggtctcatggaaaaattttttaaatcattttccagccatagatatagtggcaaatgatttaatataatcaaacttcaatttcctcatctataaaccttttataacgatatcatctctaattgtctcactagataactataaaaataaataagataatgcatatgaaattgcctcataaaccatgaagcccataaagcactgtaggacactttgaatatctggtgttgaccataaaatttcaatatctgcccttattgcttgcctacaatcccagagagacaactggtgcaaaaagaattgaaatgctgaataacaagaaaaagacagtgtaccattgacataatatttgaaggttttgtatccagctaaatctctgtctctctcccctactattctttttgatatcaacatgtacattgatagtccacccaattccttggcctttcaatccttttcatttctcacttgcaataatcattttctctcatttgtcttaagaataattgcacacttgccaatgtcttaacttcaaacatcctgagctctgaccactaccctactttttcaagcctatttcttctcttacccacatcaacaattcttcaatcctacaatttcctgtgatactccaggatataagccctctcatattcatctattccttcattatctgtcttgcatttcattgccattaaaagcattgctttgaaaaattcttcacttctttgttcctttctcctgccattgtctgtgtccaaaaaagaaagttccaacctgctaaaatctaactcactgatacttctattgcaaaagtgctaaaagctaccagaatgctgaaagttagcttattgtcaattagactcattttaaatggttaacgataagcctcaagtgaatctcaggcagcatgctatactattagattgtcctcttcaatcctacctttcaagaacatgactaattcatgtatctttcctaaaaactgcaataccccctcttctcttaacttttatttgataaaatagttcttatctcacaaagaaaatagaaaagacaattggagaacttcacaaacttctatacaacttccaacaatctactgactcctttaatctttgtttcagcatttattgttgttagtatataagaccaacacccacttgtgcataagttcccatctccttcacctaataaaggacacacttggaacttgttttcctcacatacctacattttcaattttaccagagaataatccagtagatggctatcacattctatcttatgaaaagtcttctgagattctctaacaaatattttaaaaatcaactttcaccattctacagtaaaattcagtgaaactattatctgtatttgctgaatccacttgccttcctttcattcttttctgaacctactccaattaggctttcccctcactcttttatgaaaactgcttttgtcaagttaacccccatgttgtcaaatcaaaatgaccatttctccatctgatatggtttggctatgtccccacccaaatatcattttgaactgtagctcccacaatccccacatctcatgggagggactcagtgggagggaattgaatcatgagggtggttacctccaggccattcttgtgatagtgagttctcatgagacctgatggtttaataaggggcttcccctcactcctttgctctgcacttcttcgtcctactgccatgtgaagaaggatgtgtttatttctccttctgccatgattctaagtttcccgaggccctcccagccatactgaactgtgtgtcaattaaacctcttccatttataaattacctagtctcgagtatgtcttcattagcagtgtaagaaaggactaatacagtaaattggtactggtagagtgtggtactgctaataagataccagaaaatgtggaaacaactgtggaactgtggaactgggaacaggcagaggttggaagagtttggaagtctcggaagaagacaggacgatgtgggaaactttggagcttcctagagactttttgaatggttttgaccaaaatgctgacagtaatatcaacaatgaatccaggctgaggtagtctcagatggaaataagaaacttattatgaactggagcaaaggtgattcttgccacactctagtaaatagactggtggcattttgcccctgccttagagatctgtggaacttttgaccttgagagagatgatttatctggcagaagaatttcttttttttattttattttattattattatactttaagttttagggtacatgtgcacaatgtgcaggttagttacatacgtatacatgtgccatgctggggtgctgcacccattaactcatcatttagcattaggtatatctcccaatgctatccctcccccctccccccaccccacaacagtccccagagtgtgaggttccccttcctgtgtccatgtgttctcattgttcaattcctacctatgagtgaaaacatgcagtgtttggttttttgtccttgcgacagtttactgagaatgatgatttccaatttcatccatttccctacaaaggacatgaactcatcattttttatggctgcatggtattccatggtgtatatatgccacattttcttaatccagtctatcattgttggacatctgagttgcttccaagtctttgctattgtgaacagtgctgcaataaacacacgtgtgcatgtgtctttatagcaacatgatttatagtcctttgggtatatacccagtaatgggattactaggtcaaatggcatttctagttctagatccctgaggaatggccacactgatttccacaatggttgaactagtttacagtcccaccaacagtgtaaaagtgttcctatttctccacatcctctccagcacctgctgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgctcatgtccttcgcccactttttgatggggttgtttgttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggctttggttgccattgcttttagtgttttagacatgaagtccttgcccatgcctatgtcctgaatggtaatgcctaggttttcttctagggtttttatggttttaggtctaacgtttaagtctttaatccatcttgaattaatttgtgtataaggtgtaaggaagggatccagtttcagctttctatgtatggctagccagttttcccagcaccatttattaaatagggaatcctttccccattgcttgtttttctcaggtttgtcaaagatcagatagttgtagatatgcggcgttatttctgagggctctgttctcttccattgatctatatctctgttttggtaccagtaccatgcttctttggttactgtagccttgtagtatagtttgaagtcaggtagtgtgatgcctccagctttgttcttttggcttaggattgacttggcgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgaacagtggtttgtagttctccttgaagaggtccttcacgtcccttgtgagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacaatggggttttctagatatacaatcatgtcatctgcaagcagggacaatttgacttcctcttttcctaattgaatacactgtatttccttctcctgcctaattgctctggccagaacttccaacactatgttgaataggagtggtgagagagggcatccctgtcttgtccagttttcaaagggaatgcttccagtttttgcccattcagtatgatattggctgtgggtttgtcatagatagctcttattattttgaaatacctcccatcaatacctaatttattgagagttattagcatgaagggttgttgaattttgtcaaaggccttttctgcatctaagaaatttctaagcagcaaggcattcaagatgtgacttgggtgcccttaaaagcattcagtttcattcattcacaaagatatggtttggaattgaaacttatacttaaaatggaagcagagcataaaagtttgaaaaatttgcagctgacaatgcaatagaaagtgaaaacccattttctgaggagaaattcaagccagctgcagaagtttgcgtgagtaatgagaagccaaatgttcactgccacgacaatggggaaaatgtctcccgagcatgtcagaggtctttatggcacctcctcccatcacaggcctggaggcctgggtggaaaaatggtttcctgggcagagcccagggccctactgcttcgtgcagtctcgggacttggtgccctgagtcccagccatggctaatagggtccaatgtacagctcaggccattgcttcagagggtacaagccacaagctttggcagtttataaatggtgttcagcctgtgggtgcataaaagtcaagaattgtgatttggtaacctctgcctagatttcagaggatgtttggaaatgtctgatgtccaggcagaggtgtgctgcagggatggagccctcctagagaacctctgctaaggcagtatggaaggaaaatgtgggatgagagcctccacacagagtccccactggggcactgcctagtggagctgtgagaagagggccactgtcctccagaccccagaatggtagatccacctagagcttgcaccttgtatttggaaaagctgcagacactcaatgccagcccatgaaagcagccggaactggggtggtattctgcaaagccatagggacaaaactacccaagaccatgggaacccacctcttgcatcagcatgacctggatgtgaaacatgtagtcaaaggagatcattttggagctttaagatttgacagtcctactggatttcaaacttgcatggggcctctagccccttcattttggcgaatttctcccatttggaacaggtgtatttacccaatgccggtacccaatgtatctaggaagtaactaacttgcttttgattatgtaggcttataggcacaagggatttgccttgtctcacatgagactttggaccgtggacttttgaattaatgctgaaatgagttaagacattagtggactgttgggaaggcatagttagttttgaaatatgaggatatgagatttgtgaggggccagcttggaataatatgcttaggctttgtgtccccacccaaatcttatcttgaattatagctcccacagtccccatgtgtcttgggagggacccatttggaggtaatttaatcatgggggcaggtttttcccatctgttctcatggtagtgaatatgtctcatgagatctgatggttttataaaggacagttaccctgaacacactctcttgcctgtcacaaggtaagatgtgcctttgctcctccttcaccttccaccatgattgtgatgcctcccaagccatgtggaactatgaatccattaaacctgtttttctttataaattacccagtctcagatatttcttcatagcactatgaaaatggactaatgtatcatttttatattcgttttatattcattgttctctcagcaatatctcatacatttaattatctcagtttcagttgatgtcctaaaacaatttggaatgatttattttccacattccaaaatgaagtgctagatttccaactaaaaagtatttgcaaaggaggtatttgaaatacacacacacgtacacacattcatatatgtttgtgcatgtgtgtgtgtgtgtgtgtatatatatatatatttggagacagggtctcactctgtcacccagcctagagtgcagtggcaggatcttggctcactgcaacctctacctcccacgcttaagcaatcctctcacctcagcctcctgagtagctgggactacaagcataggccaccatgcctgcctaattgtttaattttttgtagagatgaggtttcaccatgttgcccaggctggtcttgaattcttgggctcaaataatctgcctgggatcccaaagagctgggattatgggcaagagccaccatgcccaacctacatgcatttttaatccttagctgaaaacctatgttcatcctgaaaagactttaaagagtcctagagataggccgtgagttgaatagggaattttcttgaaggaagctactgtgctgctatagctttttccttcctaggcttgcaggggagggttttcctgcctcatataagactggtatgtaagaaataacagcacatgaaatgtatcattcattcagcaaaatcaagtgggttttatccctgggatgtaaagatggtttcatgtacacaaatcaattaatgtgatacaccacacttatagaacaaaggataaaaattatatgatcacctcaatagatgcagaaaagacatttgacaaaattcaacatcctttcatgataaaaataattctcaacaaattaggtggaaagatcctcaacataacaaatgccatatataacaaaatcacagctaatgtcatacttcacagtgaaaagctgatagcttttcctctaagatgaggaacaagacaagggtgcctacttttgccatttctattcaacatagtattgggagttgtaaccaaagcaattatgcaagaataaaaagataaacgtcatcctaatcagaatgaaagaagtgaaatgactaatgtttacaaatgacatgattttacatacaggaaaatctaaaaactatgaaaaaaactgttagcataaacaaattcagtatagttgtaggatacaaaatcaatatataaaaatcggttgaatttctatacactaaataacaaactatccaattaagaaaaaaattctatgtgccatcacattaaaaaaataaaatacatagacaaaagtttaaggaggtggaagatctgtgtactgacaaccataagacattgatgaaaaaattgaagaaagacacaaaaaagttgaaagagagtccatgttcatgaattggaataattaatattgttaaaattctcatactatccaacatgatctacaaattcaatgtaatgcctatgaaaattaaaatgacttttaaaaaatagaaataggaaaaaataatcctaaaattgtacggaaccacagttaactccaaatagacaaagtaatcttgagaaagaagaacaaagttgaagacatcagactgcctgattagaaactacattacaaagctatagtaatcaaaacagcatggtgcaaataaaaacagacttatagaccaatggaacacaataaagagcttagaaataaagctacacatatgcagtcacctaatcttttacaagggttccaaaaatatgcaatggggaaaacatcatccaacaaatggtggtgggaaaactggatattcacatgaaaaataatgaaattgaagttttatcttatatcatacataaaaaataactcaaagtgaatgcattaaatgtatgacctgaaaccttaaaactctttgcataaaacacagggaaaagctcctttatgttggtcttggcaaagtttttttatacaacaccaaaaacaccagcaacaaaaataaaaataaacaaacgggactacatcaaattaaaaagcttctgcatcctgtaatcccagcaactcaggaggctgaggtgggaggacagcttaaggacaggagtctgagacaaaccaagttatgttgttttgaggctgggcaacatagcaatactcatctctaaaaatatgaaaataaaaagattagccaggcatagtggcatatgcctgtagttccagctaagaggctgaggtaggcgggttacttgagcccaggggttcgaggctatgcagtgagctatgattgtgccactgcactctagcctgggtaacagaaagagccatctctaaaaagtgcttctgtgcaggaaaggaaacagcaaataaaaatacaagttgtgaaaatagagaaagtatttgcaaaccatacatctaataatggattatgtccaaaatatgtaagaaagtcatataactcaatagcaaaagaaacccctgattttaaaatgggcaaaggacctgaatagacattttttcaaagaggatatacaaatgaccaataggtgtatgaaaagacactcaacaataataatcaccaaggaaatgcaaatcaaaacaacaatgacacattacctcacaactgttagattggctattatccaaaagaaaaaaataagaaatgttgacaaggatggggagaaaaggaaaacattgcacactgttcatagggatgtaaattgttatagccattatgaaaaacattatgaagattcctcaaaaaaataaaaaaaaaactgccatacaatctagcactttgggtatatatctaaaatgaatgaaatcagtatctcaaggagatatctgcacttccatattcattgcagcattattcacaatagcagagatatggaaataacctaagtatctgtcagcaggaaatgaattttaaaagtgagatatattcaattctttaatagattattattcagccttaaaaagaaaagaaattctaacatatggtacaacatggatgaacttggagaacattacgctaagtgaagtaaggcagacatagaaaaacaaatattgcattatcccacttatatgtggaatctaaaaaagttgaacttatagaagcagagactgaaatcttgcttgccaggagctggtgggtgggggaaatggggtaatgttggtcaaagcatacaaagtttcagttatataataaataagttctggagatttaatgtggcagcatggtgactgttttgtatactaaaaatttgttaagagagtagatcttaagtgttctcacctgacacacagacacaaagataactatgtgaggtgatgaatatgttaattatctttattgtggtaattatttccacagtgtatacatgtatgaaatcatcatgtcagatatcttcaatatatatactttttatttgtcaattatgtctcaataaagagactgagaaaaggagaagtaagagaaagaaagaaagaaagagagaaagaaagaaagaaagaaagaaagaaagaaagaaagaaagaaagaaagaaagaaaaaacgaaagagaaagaaagaaaagaggaaggaaagaagggaggaagggagggagtgatgaagggagggagaaaggaaggaaagaaggaaaggagggaaaaaaggaaagaaattttaaaaacttttctaccaagacaatttatttagagtattgtgttactttcctgtggctgttctaacaaattcacacaaactgggtggatagaagaaacaacagaagcttcttttgtttgttttcaagtctggagaccaaaagttcaaaatcaaggtgttggccatgcagttctctttccctcttctagcttctgatggctccaagcattccttggttggtggctgcataacttcaatctctgcttccatgtccacatggccttctcttctactctaaggacacctgtcattggattcaagtcccatttggctaattcaggatgatcacagagcaaaatcattaactttagatctgctaaggccccttttccatataagatcacatttacaagttccagaggttaggaagtaggactatctttttaggagacaccatttaacacacaacaattattaatctcatcccttgctttatcctttcttgcctaaattaattttcttttctttgttctgaatgccacatttactttttactttaatattctgattttaagtatgtatgcatattgtcttaaatccatcttgagcaaggtaaaacataaatatgagattattctttaaatatccaaagctggatcagagacattactggcgtgagataaggaaatcaacgatcacttctctggtcagtttccatttttttcctgtttatctatgattatttttctcataattagaataattaatacctaacagtaaataatctatttaattttcatggtttttgtatattacttagactcaaaattcagaataaaagcaatattttgcatactgtttattacattaaaaaatgatttctcttagaagctataaaattgtcttcaaagtagccaaatgatatgagcatgctaattgagaaatctagttatcattctcaaaattcatgctggtaatcactagaaagtatcagggctttgggataagttagacctagatttgaaaactaggtcgaacactaaatggctgtgctaatttttagtaagcttcttgccctctctactattggggttcctagttttcaccttatgaactaacaccaaaatatatttatgataaagaatatgaagaatcaatactgccctagatcaaagcagaaatgtatgatataatagccatttttataattaaatatgggtaaatctgttttcaaaagaggggtaggtggtaatgggctagatattttcacatatttctcagaagatgatctttagtctctacatcaatcatgatattaactttcttttgcttgaaattttgacaagcctcaactaccttagccttttatgctaaaaatctacactagtaaatatatgataatattctgttcttcacaagcaaatgaaatgatcctaatcttgtgttggtaaactgaattacttttaatgtaatggaagagagttgtgcattaagacatttttaaataaaattattgatacagaattcatgtatccacttaaagtacacaattcagaagtttttagtatattcacagagctttgcaaccataaatgtaatctaattttagaatattttattctccctgtacccattagcaatactctccatgagccttcccctagccctaggtaatcactaacctactatatgtctctgtgtatctgcctaaatctggacattttataaaaatagcctcatactatatgcaatcttgtgattgccttctttcatgtagcataatgttttcaaggtttatccatttcatagcatgtatcagtacttaatttcttttggttgccaaataatatttcatcatatagataaaccaccttgtgtttatccaccagtcagctgatgtttatttgggttgtttccagtttttgactattttaaataatggtactatgaacattaatgtacggatttttatgtggactttcaaactttatcgtggagatgacagagagatagacagacagacagacagacagacagacagatagatagatagaaccactgtgttatatagaaactatacttaacattttgaggaactgccaaattgtcttccaaagtagctctatcatattataatctcagcaatatacaaggttccaatttctccacacttttaaacacttgttgtctatctattttcatttatgacatgacccagagggaaaaaaatcaaccagaatgtgatggcaacccaaggtggaatgcagactgtgacgaatcaatctaaccgtattacaaataaattatataactagactgaagtgggtgaagaagaaaggaaatgacctgagtaactgaacaatggtgttttgggccaggctcagtggtgcacacctgtaattccagcactttgggaggcagaggcagacagatcacatgaggccatgagtttgagacctgcctggccaacatggtgaaactctctctctactaaaaatacagaaattagccgggtgtgggggcgcacgcctgtagtcccagctacctgggaggtgaagcacaagaattgtgctaacctgagaggcagaggttgaggtgaactgaaattgtgccactgcactccagtctggttgacagagtgagattctgtctcaataaataaataaataaataagtaagtaaataaaatggtgttttgactagctactgtaaggttaaagacaaaatcagttgtacacaaaaactataattggtaaatttgtttctcacagagctatgggttagatttgtaagctactgtatacatataccagggcttaacaaataaagatatatattgtatataaagggagccaaatttctcactgtgtgagaaagaaggtacaatcaagaaaacaggaaaagttagaatgacccttgtaatgttggttcaaagtcagaggtatcagtaaaacgcaagggctttcaacatatatttatgtgtacgtgtgtatatatataaaaatagatgcaaaaataaataaataggtgactgtgcccatggtttagtgcatatacatgttttctagctttgagagagcctagagacagtgacaccccagtagtaatgggcacacttagcatccagattttgatttctaaataccattctccagcatccttgtagaagacatcgatcccagggttgtagccgggaaaatacaagatgaacctggaacatcttggggtacaaaattaaaggaaataatttttacgaaaatgatggggcatgccaaaggtaaacaggagccatctcaaagagctctcaaaggtcaaagctaaaaaatttgagtgcaaaatatatgatgattagattggattataaaccaataaataaaataaatacttatgtgtccaaactgacataaatatttgaataaataaattgaagagaaaggaaagcttttcccttaaaggataattccaattagtgaacgaaaaaggaataagggaagtagaaaatcatcactagaacatcacagtaataattgctatagacaagatccagttatggatgacaaatttagtggatatgttttaagaagaaacacctatttgtacagttacaaaaatctcctccaaataaatatttatcaattaccaatgaaaaaatcataacttcataatggagaaatctggaaaaagctaccttaagcaaataagcaaggttcattcacatgtaataaaacatattactgcatattagtacataagacataagacatcatatccttgatatgatacaaagataagagtgtattatttgtgtgacaatcttcccaacagtatatacattcaatctaatcaagagaaaagtgaggggtacttcatgaagttaactgaccagtactattcaaattctcaagtttattaaatttgaagaaagcctgaggaactgtcacagattgaaaaaaaccaaggaagcatgacaacttaagataacgtgggatccagggttagatcttacgactcaaagaggatattaatggaaaaattgttgaaatctgaataaagttggtagttttcttagtatgttagtttatttgttttgatcattttacttaccatagttatatgcaatgttcatattagggaaagctgggagaaggacgaaggagagctttctgtgtcacttttataatgcttttgtaagtctaaaagtatctcaaatttaaaaattaggggaaaaacaaataatcaaacaactatattaagaaatgggcaaaggacttgaatagacaattcttcaaagaagattatgaatggctaataagcatataaaatgatgcacagcatcactgataagtaggaaaatgcaaatcataagtatgagacaccacctgatacccattaggatggctactactataaaaacggaaagcacatgttggtgagaatatggagatattggaatctctgtgccctgtttgtagtaatgtaaaatggtaacgttgctttggaaaacaatatggcagttcctcataaaattaaaaatagaattactatataacccagcaattccacttctggatatatgccacaaagtattgaaagcagggtcttgaggatatatttgtatgcccatgttgacagtagcattattcataagagataaaacctggaaacaacttaagtgtccactgacagatgaatggaaaaacaaaatgtggtataaacatactatggaatattattcagcctcaaaaaggaaactctgacatacacttcaacatgaatgaatctggaagacattatgctaagtgaaacaagcaagtcacaaaaaagacaaacatgattctgcttatataaggtacctagagtactcaaaatcacagacacaaagcagaatggtagatccagggtctggggggaagaggaattgagaagatattgtttaatgggtatagaatttcagttttgtaagatgcaaagagttatagagacaaatggtggtgctgattgcacaacaatatgaatatacttagtatcactgcactgtatacttaaaaatggttgagagtaaattttatcttctgtgtaactttactacagtttaaaaaatagaaaaaaattttaaaggggaaaaacatgaccatgggcaaatatctgtgagattacaagtgtgttcaggagtttaatctggtaaattctataaaggtttatgtgacagtctcatgattttggtttttaaacttttttgacagggtacccacactaagaaaaacatttatatcttatccaagatgtttatgtgtatacttattttagttacatatatatatgtatatgtataatttattttagttacatatataactatatttatttgttatataaatatataactaaatatatataatatatataattataaaataaaatccttccttcctttccttcaacttccttccttccttccttcatcatgatgcattaaagagattttatggtctattgaagggctgacaaaaaccacttatgcgtccctaaccaaaattgaaaaacaacatttatctggtctagagtatatataaacgtgttatctgttactcaagttttcatatttcctcaacacttataactagacttgagcatcagtcactacaatgtttatcacaggtactttatgtataactaaaataaaatttaataaaacatacccttagtattcactattctctccctccctccctccctccctcccttccttccttccttccttcatcatgatgcattgaagagattttatgatctattgaagggctgacaaaaaccactaatgcgtccctaaccaaaatttgaaaaacaacatttatctggtctagagtatatataaacttgttatctgttactcaaattttcatatttccaaaacacttataactagacttgagcagcagtcactacaatgtttatcacaggtattttatatataactaaaattaaatttcataaaacttacccttagtatttccctccctccctccctccctccctccctcccttcctcccctcctcccttccttcctttgctggtcatgatacattaaagagattttatgatctactgaagggctgacaaaaaccactaatgcatccctatccaaaatttgaaaaacaaaatttatctggtctagagtgtaaataaacatgttatctgttaatcaaatttctgtatttccaaaacccttataaccagacttgagcatcagtcactacaatgtttatcacaggtacttttggaaaagtgctttgcttcataataattaccctatcagaaggcctcaatttataaagcatttagttacttagtgcttatgacgtaaatgtcacagttcaagtacttgatggagaaaaatattaaatgaagtgcacttgttttgaagataatttcatttagcatctccaaagcaggggataattaagttactctgtcatacaaaatgatggaggctttaaataagtaacagctggttaccccaatgatggagcaactgcagggcagcctttggcaaggacagctgtgcaaactcagcccacgtggtacgcaaatagacctacattatgactaaggaaatagctgaaatggaatgacatctagaaaagcaaaaaaacaacaagactgggatcccttagcatgcatttcaatagcattaagatatagaaatattaataagaagtgctcatctatcatttctgtagtcaaatgtgtttctcacgtctagacgaatttaaagttagtcattgcagggcaatgagcacattcataagaaagtaccctcatttttaaatgtaactactacttaaattactttacttactactacttttacttactactactttactccaagcaagaaattaaattcaatttattcatattttaacattagtacagtgattttttttaaagttatgctaaatctttattccaaaagtttttgtttctttaaaacctcttccacggaaatcaaatttgtaacagtgaccttaaaatgtgagagctggccttcgtaaaacaaacgtgctattaaaaatattaaataactgaccccatttttggaaagctgggtaaggctgtgctagcatggatctatcgttaaacgttttttgtttttttttttgaaaactttttattgtcactcgatctgcatgtaaacaaggaggaaaaagtgagtctgacttatgtacttgattttgtttaccagaattttgcttaagtcatactatggacctttctgacttgaaatcattttcgagttggttatcagactaactctcctaactagtatttgtattaattatttttaagcaagcatttattatcattgattatgcaagcattattgagcaagcaaatgcaaatgcaataagcatttttaagcattaactatgtgttaagcacaaggtctctgtcctgaagaagcttactagccactagacaaaatggacacagaatcaagaaatgtcataataatatggggtaacacatgacccagatttggagttcagctaacagtttcccaagggaaatgagtgcaatcaaggtcttaatagacaaatcatacataggcagcaacaacaacaacaaaaaaaaagggggtggggggcatgaaaggctttccaggggaggaaaatagcacaagctaaggcatgagggcactaaatagcacagtggggtgtgtcctcgatccccataagtaattgcaatatgtgaaatgatgagtggtgtctggggatgaaagctagaggatcttcataggggcctttatggaagtgttaaggaatgctaaagagcttggcctttgaagggatttaaagaagaattaaaatcagacctctctattatagtatagacactgggtacaagggagacaaaactgaagactaaaaaatcttcagtggttgcccctctgccaaattagcagttgttaaccttttcggcctgagaactaaaactacagtcctaagctcctggaccctcccttggccaaagggaccccagagaaaccttaaagaactgagttcctggccaagacagaatggggacatgcctcattatactccctcctttttgcagtttaaacacaattgaccagcattaatgataaactagagatgataaccaacagagcgaactcttttcatggcaataagataacaaattataaacatgacctaaggccatgcaaggcaagcattaagtcacgtacctctacacttgaagaataaactctattataactgccacaaggttttcctttttctagtaggtaaacaagccctggcctctagataagcaatataattgcagctcattcatcagacactgaccagttgaaccccccgtccaacaaaccatagctacatagctctgattgactaagagactaatttcagtaactttctcgtggtaagagaccaccaaccactgggctcagtctggcctgctctcagaggctgcacatttgaatgccttcatgctcctgcctcaccttttgacatataagacctaattgtaatgcatttaaatgtcgtttccactccaaaatgaacatgggacacatgtaacatacatgtttgttcagtatgcatgtgtcaggactccctttgtgaatatccataagacctcctcaaacctgttgaatatgtttacttggccaaccttgtcagcatatatccctgttccactctcccctccctcaaagtgccttctggtttcgcctgaaggttacacttcccagcctgtcagaatcaccatcttgaaggctggaaccattcgtaagctacatatatagatctcacaatttttaaaaatcttgatagggctcatgacccctttaaaatcttacaaaatatcgaggatacctcagtgctttgttttttgtggattacgtctgttgatatttaccatatttgaaattaaaactgagaaatatttaaacaattatgtatttatttataataacaaaggtaagcccattatatgtttaacaaggaatacattttatgaaaattacaactcaatgctggttatgactcaataaagagatcttgtgatttactgaagggcttacaaagattactaatgtgtccctatgcaaaactggaaaaacaaaatttgactagtccagagtacagataaccacaatgtgttagctgttaatcaaatgttcatatttccaaaacacttataaccagacttgagcatcagtcaccacaaattttatcagaggtactacagactagtgctctgtttcaacagtaattaccatatcaatttatcaacctcaaattataaagcattttaagttacttagtgtgcatacttagtgttcttttcaaagcaaagtgttattgaggagtggcttctttttttacatttttgcaaatatctttagttagtggcttaatagaagacaactaaattctcatattttcttctagatttaatctataagttgttttggtaaaggtttataatgaaaaccccgcttcagacacgcaatatggttgaaaaattgagacgtattttaatttttctaagagatggggtctgcaatgttgtctaggctagattcaaactcctgggctcaagcggtccctgttctcaacctcccaagtagcagggactacaggcatgtgccaccacacgagacggaagtaatattttaataactttttctgataattatagatttatttattttgatactaccctattacttgactggggtagtttctggaaggttaatggcagtgtagaagccaaaacaatgtcaatgacctttccctatactattatattaaaatccattggtcaattttgcactttaaatggatctttcatctatgcatctacttttttcatgatgatttcctaatatcatacatttctcatttggtaaacattcgtacactgagctgacagattttactatagaatataaaaaatacacttgttaatatcgtcaccaatctcaccaaaaaaagtatttaagaacggaaatgctatcaagctcatggtgatggaatacattttccaaaattctactttttgcttgaaagctcacattttatcattggcaacaaatactgtcagtttgtttctttgaagtgacaagcttactccactcattttcaaggaaatatccaccatatgtccaagtttgaataaacataattatctgtcagtcattccttcaactaaaaatggcattccatgaaaaaagcaactagatcagctttcaacctaacctcataagagcttttccttgaagcaaccatcatactttaaggattagaagttcttctttctcatcatgtagaaacctggtaaactgagatttaataaacttcataattttccttgctttatcaatagcattcagctgtaactggacagaaaaaaaaacaaaaaacaggaagttcatggtagcgaagaacagaatgactaataactgttttggtggtagtgccaacattcatattaacacactagcaattctgcccaccagtacttttgtgccagcagtgtagatgtcaactcagtgaaaaagacaaatgatggtttagtattatgatgaaaatagggttcatcgttcttcacagtccctgaaaatgtctttgggtatcctggatgtgttcaggtcacactcaggaaaatgttatgctaaaagcctcaagtctaaattcttatacctaacatccatccacaatcttgttccactctattgataaccttgagtaaaacagattttttcacttttgtaaaacacacctttttcccctctcatcttctaatttcacattcttcccaatatttacaatatataaatcattcaatcttccaggagccagtccaattcatcgccattccagatctctgaactattttctatactattggatatgtactcacttatatactatttatgatttttctttgggaattagaattatcttccaaactagattgtcagacttccagaggtgaagatttttagttcttctgactttgctatagtattctgcacagttatgcatatgataatgatgataatatcttgaattttataaatcttaattttttagtgtaggtcacaaatacacatgtgcccctattgtatttgtagggaaaacatttaatattataaattatgttatcatgtcttctactttgggtaactaatatatatcaaatatatacttaatatattatagaatatcaatttataaagcagtgtataatttcaagcatacaaatatgacaatgcagccgtatatagtggaaaaaacctaggctaggaaatagaagatctaaatttaactgtccacatagtatagacttaaagaagcacatggatttagagaagccacaaaacatatttgagtcccaatgtctgcaacagtgaaatgcttatccccgttctgatatttaaatgacgtattttatgagaaagtttttttttgaaacaatgtagtaatcaaatgcaatcttttggcatagctattaccctgagtcctgcacattaactgcaaatcaatatcagctattaacataactacatgcacagcatgacaattaaaagaactaaagacacacaatggagacatctttgagaattaaatccaagtaccttgaggtatgcagtacttgtcatagaggatgatttgaatattggcaaagtactatgtgtgcacagatttcatatataatccacataaagcaaagacgccttattacccggtattagtagtctaaatctgaaaggtgtaaagaaaaacaagactttgaagacgtattacagatttatacaggataccacaaagaaagatcttgtaaaaaatctttagacttttctttttccctttaaggttttaccctcatccacagcaaccttaatttctctgaaagttatgtgtcataattacttttatgtgttaacttaactagacttaagggatgcccagatagctggtaaaacattatttcttggtgtgtgagtgagtgtgtttcctgaagagatgagcatgcaaagcagtagacagaataaagaagatctgtcttcaccaacttaggtggacagcatccaatccagtgagggcccaaatagaaccaagacgcaaaggaagaacaaattcctccccctcccccaccagagccaagacatcagagtttctggttcttgggcctttgaactctgagaccagttactcccaacccccctgtagttttcaggccttcagcctccaactgggagtgacaccattgcccactggctttcctggttctcaagcttgcagagagcagatggtgagacttctcagtttccataactgcatatgcaaattcccatactaaatctcctcttacatatctatatctgcggcctactggttctgtttctgtggagaattctggctaatacattacccttaccaacatttgggtcttgtttatttcatctttctcctcttatccaagttctctaatatgaccacctcttcatttcagacaagcccttggtaagggcacattccctgcatgctgacaactgctgttctcttaaaaatggtagcatattctgctgaataaagccttccatcttgtttataaaatcttgaagccttaacagtggaaagactagccttagagagctttggcaatcaataatcacagcatcttgacaaaaaagggtattaataagcatgtgtcatttcttttaaaattaggttagaagaaatagatccttagagaacaagaactatgccaatggacaaacgttctagcctcctattattcagatggatatatagaggaggtggtctccatgtttcagaggtcttaggagagtggaggccccatggactctagacacacccttacacacctctgctgcctcccctgtttcagtcacaatgtttcctcacagattcttcctcccaaataaactgcctgcatgcatgtctatgtctcagacttctgctttcaggaaaactcagacaatcaccgtcttttatgcagcttacactacattgtagacttttcatataggtgatctctaattctagaataatcctagtagcctcccattttaaaaattggaaaaggtaatttaaagaggttaagtaatatgtccaaggcatagtaaattctttacagaatcctgaatgtgagtattattttcgaaccattcaactccaaacttatactctttctccttttatggtaattttgtcaataatagccaaaatgaattgaaaaccttctatatgatgtaccattggaaagaatgtttcaagtgatcagtgaagtttgttgaatctataattaccctatccaccatgatgtctgaggttgaatgtttccaaccaaactggcttatcttgaaatttcaaaaataagcactgttctacaaccgttactagcatcttatggctttcatgaagttatatactatttcacagaaacatgattttcctctccatagaccctagacaattttctcaatgtagcccatcttcttttattttaatgaaacttaatccaggactattacaaatgttcaaaaacaaaagcgttttaaaatagtgtgtctattatcttcattttacagggaactacaatgaaatggatattgtttttgtcatttacattttcataaaaactttatgtgctttttcaaagaacttcagtttaagaaaaagattattcacaaatttacagtgcttgcattttataagtatgcaaatgtaaatgtacagaacttaacaaattttacaaattttcataccgttagaagtaatggggcctcatacaaacaacaatgaatgggaaacaaagaccatgtgaattctcctgattcttttcttatagcttctgtgaacctttagccaatttattttatctttcttagccacaggtgtcatgtttgtaaaaccatgttaacaataggaaaggctgttgaaagaataaatgagataatatttggaaataactttagcaatataagaaaataatgaatctgtggatgtggaaaggatctcactgtttcctgtctagccttcaataaatttcagaatattttaatcattcatacagatcatatatatttccacaagacctgtttcctcatttatttgtttgaatcagtatctaaataggaaagtggacttcagagaagaataataaaaaagccatcccttctttcattgcatagtatcaattatgctcaattcccacaagccttaaaaattcaatgattacataattaacatttctgaataacttttatttttctttgaggcagggtctcagtctgtcacctaggctggagtacggtggtgcgatctcagcttactgcaacctcctgggctcaaatgatcctcctgctttagcctcccaagtagctgggactataggcatgcaccaccatgcctggataatttttgtatcttttttagagacggggtttcgccacgttgcccaggctggtctcaaactcctggactcaagtgattcacctgcctcagcctcacaaattgctgggattacaggtgtgagccactgcacctggcctataaggaactgtttatgtgctaggaactgtactaagatttttacattatcttaatttaatcccaacacaatcaatgagtacagtgttattattcacactatatacatgaagaactttaagatagaaaggaaattactgacttacacaagggcatggtcacagggtgattgttaaagctggcctccatctcaggttttctgtctctgaaactttgttcctactaattcacctcaagccagttctttattaatatagttgggtcacagtaactatctggtaacatttaactaaatagaattgttttcataagaattaagattcaacccatattttgaacttaggtatttttattattttggaatcactgagttaacagataaagatgtaaatagctttatagataggtattccttatatatagatttcaaaattaagtaattctgtcagatggacctcttttccttggcagaggtgatagacaatcaaaatggtaacataagcagaaatcacaagtcgacacatgatatatgcatttgaatattgcctggaaagcctctccaagtccattaaattatttttcctagggtgaatgtaaaacatatcagtatgggcaccagcacatgtgcgaagggaagaaagcattgggaaagtttgtttgtgtattgattttgttggataaagttgagaatttttgtttgttgagctttgttttgttgagctttgtttgtttttattagagaacagagtggataaaacattttcatctagtaaaactgctccactatggaatcccctttccctttttatggttaataatcttaattgatcttaatctattcaaagtggaaaatagagggtagaaagcatccagctttaagaaagcagggctatgttacaaaatgcaacagcaggactaacagcaggagagactggggtcactgtccagatacagagcacagagtatctcacatgtggtgagagagggcagagttagagcgaagaagcagagcagaggacagtgaccatgaggcttaggcggttctggctcgaagaaattgagtgaagtttctctcagacagagaagagagtagcatgtaccaaaagattaatagggatgtgctaatggagcaatgatcatctttcccggaagaacagattttaacacaagatgggactgagctgttgaaaattctatggcaaccactatgtgagaagaaaatgagtagctgtatgcaatagcacaggtctacagctgcgctacctttgactaacgcagcctccctaagtagaacatgtgaagctttgctccatcagtgactagctctgtgaccttgacagagtccctgacctctatcagggtgctttttcattttctaagttggaataataatggctaccctagagttttcaactaccaactctatatgcagttctccctaatctgtcttttacccagacatctatatggttccctctggaagggggagtaatttatctgatcagtaagattagacaaaggcactaggaatgcgtaactcagccctgccaagtttatgtttttgggatcagctggctgtagaaggctgtcatgaggagcagcttccctggcatgactggcaggggaagtcacagctctgcggagctgcttcctctctctgataatgagtctcaagaatcacactcatggccactggggaagcatggggtattaggaagccagagttcagctctctaatccaagctctactttccatcacatatttaccagtaatgaagatgaccattttctcattcatttatacctccatattaattgtgcaattggtttagagtctgtagggagacagcagcatgactgtaattctcacacactaacaactcttctgatgcaagtagtgtaaattgtcaccattttttaaagttgcaatatcaccattagctcaaatagatgcacacactacttactattatgtaaacaaaacatcatttcaaacaatcttagagaatgtctgcaaaccacacgcaggttgtcagtcatacacttaattctaatgattttcaggtagctttaggagccctatcatctatgacatgataaagacatccaaaaattcaagtcttgatgttaatcatttatatttttatctctttaaataaacaaaaacagtaaaatatgagcccagagaagaagcatagtaactgattgcaagcacttagaaaatgcttgaggaagacaggtaaatctttgacactctacttattttctttttatttcaaagagctcctagtacatttctgcatacattacacacacacacaaagacagaaagtaacaaaacacttcaagtcttcaaaaatagaattgtacatttgaatgccatagccactgccactgttaaaaatgcagaatttcaaattgcacttttcttgaaaatacattgatactctgctggcttagtttactaaaatcacaaaatacaacgcctaagagtgtacaaaatacattccctttgaagaaaactgaacattggaaaatactatatacttggttaaaatagatgactgctcgtgaatatgttcaattaagttcaaagcaaaataatttcctaagatctcttattaatggactttataataccaaaaacattaaattaaaaatcaattaaacaaataaaatgcaacccttacatattaaataactgtttaatctttcaagtggatatgacctattaataatagaagcatttgcaaactgtgcaacagttctggtacagagccaggtccaaggctaagaggtcaggaaaaaaataagaatatgacagtcccatggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgaggtaagtagactaaaatccattaattgggggatgctactgagaagactgcaatgatgacagtacagcaatcagaaaagatgtgacacatccagaaggatctcaaggccttttatcatttttattctaattttgatattgagctgaacttggagtagaaaccaactacccaggaacttaaatgtagaattctaattgggatttccagtttgggtaagggagtatatgaatacacagtgcctgctgagtaacaagttttaaattattatttttcatctggtcctcatcattaggggtatcaaaagttttgtttgtaaagacagcaactatctggttaaattcttatactgagaacgaatgtgtaaagatcagctcagcctactcatgtgacaattgttaatgaatccattaactcatatctttctgcttcttaagcacatatttaaatatgcataaatgtgtgtgtgtttgggtaatgagaaaaatttgttggcaaggtggctaacgaaaatatccaatctcactaggcatacgtgcatgctgataaaattgtttgcacagtaactgttggtagattcaaacaactacttcagagtagaagctcaaagccaaatacttcaaaactgaagggactgaattcagtggtcttctaactggattccacagggctccagagtcctgagctacttgatgaatgttagggtgggggtagtaaataggactctgactctctgagctctgtttcttctattttacacttagagtttcagagagattttattttggaaataatttttgctactaaaaacaaaaggaatgcagaaaggaaaggacagagagaaagggaggaaggaaggaagaaagggagacagtgtggaaggaaggatggatatacggaagaaaggaaggaggtaggagggaaggaaagaaggaaagggaagaaacgaaagagaatctgcagattttatagattagataaatgaggtctacataccttaagtgacatttcacacattcctgacacaggtagaactaaaactcagtcttccttattcttctatgacaagaagtattgatggctccatttgtgcttttagaagagaagttctcagatttttttgagccaaaggtttcaatagttccactactgtgaaaccaagacacatctgtcacttgcacttagatgctaacagacttttctgaacgaggaaatgttcactggaaccatgttttttgccatcgttttttactagaatatctaatttgtcaacctctccctttgaaggtaaaatcatccagaggtcagttgcacttaaactatgattatcactcaataactcggtggctttggacaagttcttccctgtctaatcagttgcagaactagtaggatggttgtaggagaaattggggtgatgtagttaaatcacttgagtgtttctcaattgatttctcacattgttcctcacaaaaaagcctttttagacattattttcctaatctcccccccacaggtgaaatttaaacagcatacatgcactgtatacctctttatgtactgaatgcatatctgtgctttattcataataagagaatgagttttggattttttttttttttttgctgctgctgtgcaaataaccaattttaatccctttgggggcaataatgttatcattgagaaggtatgaaataggctaatatttaataccatacacaaatagcaagggttgggcatagtgattatgagccaatttcagcgtgtggatagaatgcagagtaccagagagccaacatccctccaaaataaaagatgcagcagattacagaaagatgatgggggcacacatgagaaatactactaattattacagtaatgtgtactgtactatgctttcaactttacatttgccaattcattaattttcttaaaagccttaaaaactatttaaatatgaggaaacttgggagcaacaacagtggatggagggccatccttcaaacctgggtatgtctgtctccaaaattcagggtattttcattagcactctgacatctaacttggcattttaagctgcaactgcctgaagttactaatttctaaagagggattcactggctattcttgtcaaatgactggctgtgtatgtagatatattcgaaataatattagatggtcccagttggaactgccctgcctggacattctccttggcctgttgatgtccttgccccatttctgtcattataacaacccaataattggtttaacctcttaaaattattctagatggaatggtttttatcccctatgaatacattacaatctttctgtaaatggtaaatgtaaaacttaagggctgcattgcaacgttgggttaaacccgtatgtactgatgtataaatgtgagtcttaaatgataggcagtagtaacctatgatgctgagagtgccctattataaaacggagggagaaatgggcatcagtagatcagccatgaaagacaagcattaaagggcatttgtcagtagagtgtaggtggggacctcttgcttcttgaatggaacataaagtgcaagggaataattggagtgcaacagaaatacatttttagatgagggctagaaaatcaagcctaagacaaagaaatcccttgaccctgaaatatctcctagagaagaaaaggatggattctggaaacttaaggaactcagacacaagtctccaagggttagataatttcatgatgagaggtggggtctgaagccataaaaattcttggaaattaccaaaagacataggagagctgtgtatacggagggacagctttgcatattgaagctgcaagtactttaagaaactcaattgttctgatgtatatttgtacctagaaaactgtttcttataaagaaaggaaaaaagaaacatcttgactgctcatgcatgataaactgtgtgggatcaagtaaaggaagatagtattaagggccaaagagaggcataagctctttctcaggaccataaaagcaagggtattagcctttgacccatgaccattagtgggggcctcagaagattctgctttctgcaagagtacctggtttccagggtaccattttaatagaccatagcatgggaagccccttgctggcataccatcatagacaactgaaaacggctctacagaaaacactcactcacacaggaggcagtaagtctccagaaaagtggggggacatgtactgttggctgtctctattgcttttgtctgattaatgagctggcagttgatggtaaatattttatagcataatttacttcttcactttttccaccttacttctgccctgtgctttaccaatatattcaagcttcattggcagtacctgtaaaagacaagctctaatggacataatgtagctaatgtgtcaaattaggactttcattatgtgaaatttgattatgggtcataaattacgtatttatcttgcattaactgatgaaggtaacttgttaattagatgaaatcaaagttattgacctatagtgaatctcttctacatttattgttggcataaaataaaatatcatgacaagaatacaaatgcatatttattttgttactagatatgtaacattttttaaaaattcctgggagaacagatgtgaaatttgggagaatctatgagagatttactcagaattcatatttattatcttttccgtttatgaagttgttgtctctcaacaaacctctccaaatttgaatctctccaaatccactcttctatatactctgtttgtggtgctgggggaagagtgtctgcaaactacatttttttttttattttcttaaggttctattttatttttaattaacaaaccacaatgagatgtcaccttctacctgttagattagctattatcaaaagatgaaagagcttaaatgttggcaaggatgtgtagaaaaggaaacccttctatactcactgttggtgatattgtaaattagtaaaaccattttggaaaatagtatagaggttcctccaaaaaaaaaaaaactagaattatcgtatgatccaacaatcttactactaggtatagacccaaagaaaatgacatcggtatgatgaagggatgtctgcactcccgtgttcattaaagcattattcacaatagtcaacctaagtgttgtttccatttgagtatttctacacagtgaaatactattcggcctttaaaaaaaagggaatgtctgttatttgtgacaacatggatgagctgggagatatgttaagttaaatgagccaggcacagagagaaaaatatcatctgatctcacttatgcgtggaatttaaaaacgtcatagaagacaatctaaagaactcatagaagtagagagtagaatggtggttaccagaggctggggggaggtgggtggatggggaaaaaggaaatgttggtcaattagattggagacataagttctagtgatttactgcacagcaaggtaattatagttaataacactgtattctatatatacaattactttgttaattaaaaataaaactaaaaacaacaattgtatatatttatggggcgtgatgttttgatatgtgcgtatatacatatatacgtagaaagatcaaatcaggctaattaacatatttatcacctcaagtacttatgatttctttatgatgaagacatttaaagtccactctttcagccattttgaaatgtacaatacattcttattaactatagtcaccttgctgtacaatagaacaccagaacctagtcctcctgtcttactgaaattttgtgccctttcatcaacatttccccttttcctgtcctctctcccctgccccctcaacctctggtaaccaccattctactctctatataaattccacttttgtaagttccatctgcaggtttcttcttgttagttggatttctgctttgttcttcgaatagaaggtgctagagggagatggaagacaggaggagagaagggatttttcccttccagagtcccagcaacaacccttaacccaacagcaacttttgcttctggtcttcaattcctgtcatcctcctaaagggtttcatgtacctccccataagaactggcacagttggcagcattcttcctcagaggactaagctctacctctggtacttagaggaaagatcagagatcagaacaatatgtttggaaaagaacagtaggaaggaaaacaatgcatgaaaaatattcagttaaaatattcagtaagtttaatatgtaaaaaatactcagcacggtgtttggcatgtagtaataaatgtgaataagtgtgaccaattattatacagcagaggctcagcttctgttagtcatctatagaggttttccttacatagcttttaatgcattatgatatacattaggaggtaatgtatcaaccaaaagggggtttgactttttaattgaataatgtcaaattaacatagtatgaatgtttgcttattttgtagaccattaagctatttgctatttgttatgctctcccttagtctttgtttatcaaatcacatgtttattttttctgaccctttataaactattttagaacagtcctttattcttataattttttagtgctttctaaaatgctgcttacatacaataataaatgtacttatttgaattatggtaagacttcatactcatatcatgtattttatgagtgtatttccaaaacttctgcatgaattacttacgttttacagcagaactagttacaaaagtaaatgctaatacttccattctacagatttttaaaaattaagtacagaagtggaaaatgattttttaaaaggcaaaggatagtcaaaggagcagggcttcattatggaggcacattgaacattggctacccaaaaatcaacttttcagttgattttttcaaccatcacattttctgaattttcaaacaaaaaatagttggaaggggaaacaaatgtgttcatcacatatcagactactcatatgatcccagctgagaagaaccaagactccaaaagatacctgcactgagactggttaaccatgtgaagccttagaagcactggcaaagtggcagtcagtgaagaagaaagaggaaaagacaatagaagaaaagggagaaggctgacaggtcagcaacagtggcagagataatatttcttagaaacaacagtgagtaaacaacattaaataagagcaaatacttgtcattggggatttgggaaaactttgaatcaggccggacaagttctagagacttagctaactcttcaagagatccaaatctcaagtcagagagcaggttcaggcagggtggcagttggtgtctgacagtataactatcaatgaaggctgctacaagaagggagaatgagtgtcaatggggtccaggaagagtcggggcaggtctgggcaggccaactgtcagcagtacagattttaatcagccagaaggacctgggtgtagtggcagggtgcctattacagaaatgatcaatgcctggtagatacaggtgctcatagaatgtttgcagggcttgataacttgatatgatttacttttttagagcaaaaaccagcagcaaggttggattgattacagttaccatatgacctgttgggattagatataaacttttggtcctaatggagaagaacctgtcattataaggctaagtgaggttgtctttaaatgtttgggatgcaaaggctagaaatgttcattctaagaatgaaacataaaaaagaaaaaaagacttgtaatttagtgatcacttgagaatggaagaaaatgacaaacagctacctgtcctttaatgttacaccatctctacagtgacaagctaagtacccacatatatggtggcatgtttgagaggtatgcaagggcagcacaatcaaaacaaatgtagtttagaagcctccctctaagatctgtttacaggaggaggggagaaagaagtttccaaatctacctgcttaaagtgttacagatagatccgattgcttagttctccctctaatccacaaaagtgtctgctatatacaaaaatatactaattttagagaaaaatatgaatatttgcatttgacttcaaaagaaagtttgctaaaatatttacagaagaggaaaacattggtttatgtactgagattgtttcagtaaaactctgcagatacctggtgttttaaaacaattatatagtacaaactagagcttctggttcttattccttatgatttattcttggtaaatgacttgagaatgcttttaattccaccttaatggttatttaaaacattttaaaaattagaggcataaaaatgctgctgactggatgtgtactttataatacataatttggggtgtccaatatggactcagagttaaaagagtagacataattattaaacatgatccacagacataggttgaagggacctttctgtttctatgggaacagtcctgtgctccatattccagctggttccagtggtgctgttaagcaaagactcttcctggatgtcagcacaggaatgatcatgagtctcaagcctttcatgaggacctcattcctatggcaagtgggattggttcactgctagggaatgagactcaaacaagatcaaccaaagtgatttccaggaatggagacagtatttatcttcctactagagtcactgaaacaggaggaaatgatctgggattgctagccttcatcttctcctgtcatcaagcagcagcatatctggatctgggggaatgaggctcacatgattaaaataaaataaaataaaaagcaaaagtacagcaaagagagggacaagatggagaaggcagtcatgccagagtacacaaatataagatgaatatgagttgtatctctggaaaagcctgatcagacatgagactgtttctgtaactaattagactagtatttctttcataaaccaaactttcgaaagcagaagatccaaattacttatattttatgaggattagtttgggattatcaaatattgacatgagcacaggactagaaggctaggaaaatctggcaagcctttttttcattgttgttagcaattgtttcattgttgttagcaaatctgttgttagcagatattgtggtactttattcataaatctggcatatttacaaaaaaaggtttaaaatcttttagcttaatgtgtacttcagaaatatgcattatatagtaaaattttaaaatagtctgtacattaaaaaattcttataaagttaacatccatgacagagatagttgccactcaccaaatagcagtgtgtattaggccctccttccccaggtctcatgtagacaggggagttgtgtagctaggtcacaccagtgacatctgagcagaagtggcatctatcacttacgggctgaggcattcaagagccactgtttgattctctagctctctgctttcaccttccagatggaagcatttctcattgcccattgatcacatgaaggatgtggctctggaaggtctcctaattcaccgcagtctttgcatgaattaaaacaaacaaaaaataacttctgttcttacgagccactgagaattaggggttgttctgttaccccttcactaacagtctatcttcactaatattttcctttttattgcccatctcatttttctcatggagtttggtttgataatatctgggtgagacactttcaaaagccattttggaaatgtacacgtgatttacagacactctattttcacagaatcatatgtctttataattatcaaatgttttataatgactgactagtcaagatgtgcatattacattttaacaagatacagccccttattaaatgtaaaagaaaacattttaaaattcactattagtttcctattctcatattaattcagtgtttcatctgttattataagtcaaaatgtccttccttgaaaacatggactttttctactgatttatttatttcctattttctacatttatggtgataatgtgtatgtatggtgccagtgtactgatgactttgctgatgacttttaattttttatgtatcaatagacatataaaatgagaacttaaaacctatctactgggtactatgcctattacctgagtggtgaaataatctgtctaccaaacccccatgacacacaatttacctatataacaaacctgcacatgtgcccctgaacccaaaataaaagtttttaaaaattacatctttaatcaatcaatgcaccagttatttttcaatttttctgctaaaatcacatatgctggtgataaaaataaatgaatatatgacattaattgattgcccctgaatattttttccagtaacatatttaccagtgtttacacaggataatcatgattgggtgccccaaattttacaacagtgctctggaaaagagcttcttgcccactaatttccaaataactaaatttttattactaactataatacaaaatatcaaaatcacaagttaacaagcatgaataactggtagtggagccaagttatagaggtttttcattccaagaaggaaaaatggagggcttcaattgcacagttggagtcattcttcagtttcaagtgttcaaagtggaatagtgaacagaagaagcaattcttgtcaccaattaggctacatattgacggatgcaagcaaaccttcactaggactaaaatggatttggtgtataagcagacttatagacatataaaaaccacaacagttctgcgttccttcttgcaacacccaaatttactttagtgtcttaattctgtaggcttataataaatctaaccactaattaacatgaacactaattagaatggccccaagttaataccttaagtatcttctcgaatagacagactttagctctttccatggatttcttacagaatgtataaattcataagtgttttgcccccatttacacatccccaatctaaaaatggtccttactcaatgaaggctaattcagacaagtggtggccagagaactcctcagaatctaggacaagaactgaggttccccaaactaaatggagcaagaaaggagcaattgctctgcaaactacttttacctgtacatagttgaaggtaaataaagtcctaacaaggaaaattgaggtaaacaaaccttaggtccagtctgccctttctagatgtctcctgccccgctttatataatttttagaagttttaatctgctttttaagaacagcttgttgaagtataattgtcaaataaaaactgcatatattcaaggtgtaaaacttgacatcttgatatagatatacgttttgaaatgatcaccgcaatttagctaattaacatatccatcacctaacatatttaatattttctcttttttattcctgtggtgagaacacttaagatctacgctcttagaaaatttcaagtatataataggtgttgctaactatattcaccatgctgtacattaggggtcaagaacttatcttgcataactgaaacttcgcatcttttgccctgtctccccattcctctcctcctcctagcccctgtcaaccaccatgctactctctgcttctttcagtctgactattttctattccacatataagtgagatcatacagtatttgtctttctgtgtctggcttatttcacttagcatagtatcctccaggttcatctaacattgttgcaaatggcaggcttttcttcttttttaaggctggataaaattccactgcgtatatgtgtatacacacgtatgattgtgtgtgtgtgtgtagacatacgtgtatctacacacacacacatatatatgtcacattttgtttatccactcatccatcagtgagcatttaggttttccctacatgactttatgatgcttctttcaaatgtactccctacaaaactcttaccttcacgatgtggacattagatctactgcctattctgactgcaaacttccagaagggactattctttcccagaaaaccccttcccacctctgaaaattatactcatcatttaagcctcaataatttattcaataaacatttcctccccagcaccttgagaggcccaggcgggcagatcacttgaggtcaggagtttgagaccagtctggccaacatggtaaaaccctttccccactaaaaatacaataatagccaggcatggtggtgcgcacctgtaaccccagctacttgagaggctgaagcacgagaatcacttgagcccaggaaacaaaggttgccgagagctgagatcacaccagtgcactctagcctgggcaacagagtaagactctgtctcaaaagaaaaaaaaaagaaaaagaaaaaaagaaacatttcttcaacctctctctgtgcttcctctgctaggcaacaggatatgtatgtaactgaaaggcaactcttcccttcaaggaaataacaatctaggggtgaagacacagatgcaaactgatatgtaaaataaaatgcagtaaattacataggcagggcatacaaaatatgtcacagatatgcaaggagagggcatatctaaagaggctctcaatgaagccttccaaatcacctacagccaaataagtggtcctcctacttttactttccgcaagtaattttctcgtggcaatatgctttcttgtggcaatctaaagaggctctcaatgaagccttccaaatcacctacagccaaataagtggtcctcctacttttactttccgcaagtaattttcttgtggcaatatgctttctgataaagaaatgatgtcagaagccagacagcatgtcttcaaatcccagctctgtcactcacctatctttgtgacctcaggcaaatcacctcctttctggagatgtcaatttatctatctcatttataaaattgaataaaaatagcacgtcttatggtgtcagtgtgaggatgaacttgtgtcatgaacagcagtgtctggcacttagtaattacttaacaaatattggctacaaatatatcatttttctcatctacaatcaattagagtttgttattagcataactatgacctgtaataaattataatttctttgggtgaatttatccatattgccaaattgcaaaaagtagagctttaataattgattctttactggtacttttttctgtctaaactcctgaagtcttctctttctctgaaatctaatttgtatttgcctttcactattggcaacattaaagtatcaacttccctttgatgaaggtccgcagcccagggcctgaatggaacatctgctcttattaacaattccttctttttcgagcttgtctattcttttagagcaacttggccctaaataccccctaacacctcatcttcaaccctaattccctgtatggccctcccccaagttttccatgacttcagtctgttcaacaacaactccatttctattagtccaatcatctctggggtctgggttctctctctccccatcccctctgttcatttcgaaaccctctatgtttccactgttttactcaaagtaatgagtaagtacctgcactggcaggacaagtatagaacgtcaacaagtgaagatgttcaataaaccctcatcatagagtattcattaattatgattgaagaagtaatctacacctccaacttcagcttctggcctaaattacatttttatacctttgtatattatatttttgtatattattatctcagtttgttttgtgttgctataatagaataccacagactgggtaatttatcaaaacacacacacactggcacacacacacacacacacgcaaacacacattgatttctcacagttctggggggctgaaaaatccaagatcaaagagctgttatcttgtaaaggccctcttgctgtgtcatcacatggtagaaagtagaatgacaaaagagagagcccattcctaaaagcccatttaaaaatgatattcctccattcatgaggatggaacctcatgacctaaacacctcccatgaggccccacatcccaatactgttactttggcaattaaatctcaacatgagttttggaggtgacaaacattccaaccatggcaacaataaatgaatgagatttgttttagtgcagtaaaattatttgttgtatttttcagtaatatttagagaaaagcttatttcagcagaagcaataaatgtgttataaatgatccttccaaacatttatacttataattgtcaagcacagccatctaataagagttgaaaggtaaattagttaggaaaactgggttgcctctcaaataaataatctagcatgtgttttgaagaatgaatgacgtatataaggaagagtttagaggaacttttcaatcctagaatggcataaaatatatgaagctctgtcacacttcataaatcagtactgttagtagatccatgtcagacagcaactgtgtttgcaagtaccaacgtaattataaatggagggcatcaccaggagtggttctacacagatctgacccaggtgatttacaaaaaggttgtctctccataacatatacttggatgcagtcacttacatttgctaattgctactgtttcctaattattcctgggagcaagagggacaaatgatgcccagaataaatttgaaaagcatattggaactctgaagacaggggcagaaaagtgaatattttaggataaacatttttaacacctttttcttccaaaaagtgttaaattttcaatatggttaaaatatcgaaataggtaggttattgctgcaagagaatggttggcttcatagctaatatcacatagtggaattttgacttctgggatgtggcttatgacaccagaaagacagacacttgaggcaataaaggtcattatttttgagattcagaaactatatatttgtccaggtaatggctgatacgcacataaataaattgaacgtggagaggagtgatgaataaaagcccacattcagttgtgaaataaattacaaattgagcacattatgaagacaaatacactgtagaaagcacattaaaacaaagtaataataaaagtattattacaaatcagtgaatgattactatatcccaggcacttgaaggtatctgattcaatgccccagtatccctttgaggtaggtaattatcacctccaattacacagattttttaaaatgaggcttaattgatttaaatcttgctaaaattctcagagctagcaaatgatagagataaaatttgaaatcaggaccatctgattgcacagttcatcatgatacctagacatttaggagaaaatattggagaaatgggcaggaaaagtcctaaatgacctcagacacctctacacataggacataggtaataaataaaataaaattgtgatgataacaggtgagaaatagaacttcatagatgcaaataagatctgaaaaataggacaattattcccattgttgtcattccggcaataccagaagaggaagctttaagcacatacacacacatgcacacatgatgtctattagaaagaaaggtaaaattgtctgcaagtccagatgacatgcacctgtagcaatactgagttccctctgggaaggatatgaatgaggtattcccaacatgatcacaaagttgcggcatgcttttaatctatagctgcacatttcttttggcagaaagaagactcttctaagttcttccctaaataatacagcaatattttatgagctttaaaaaagtatacaaatgacactggacactatccatggctcagcagaagtacactttaaagacacataggttttagcaaaaaaaaaaaaaaaatgaactcaatatgatttaagagttgatatggcttccaaataaaagatgatgtgatgtgatcgtagtattcattaagagatctatctaatctagttccctgagagaactgacctgtgctagtccaatatctcttggcatactctgcttcattcttgtcaaagatttcaagagggatttattgaacatttaaaatggaaaaaaccagaatatctgaaggacttttgaaggaaataagcatgtttaaagtgaaaataaatttcaaagaaccatggtggctaccctcaaatatgtaaagaattgattgattgccacgtggaagagggttagaattttttatggccaactatgttatacattagcttggaagataaagagcttctagttactggaggcatttaggcatcatctgaactgatgcattggttagcatcactttttagtgagtaattggactcagtgtcttttaagagctctctcagtgctgacactgtactctgcacatattccttcactgccctccatgtgacattggcacatatttgtgaaatattttgaccaaaattagaagtaagtctttagagataactagcttgagggcttgcaatagagctacatggagatttaatcagtggccttggactcattagcgccacatcctccaaacctggctcttacatagtcatggtcaaagtgtgttggtgaagcagacaggtaagaagccatctgaagatattcttacaattcatactcatctacatattgagaagtctgccttttctttttctctatggagatatctataagcaggtagtgggttgtagggagatcagtactgccagtagcagctatcccatggtcttcacgtagttgggagactcactaagacgaagctcagtgaaaatttcagggctgtgctgtttattatggtctgctatggtatgatcacccaccacttctggtttacacctatatcaaattccaacagctgctgagcctgagtaagtcataaatataatgaactttgacatgactgaaggaaagttaatttgaattatatcatctcagcaatacatctccttgagaattttagaataaaaacatcctcaacaaatctatagacaacatggcaattttatatacctcttgtggttttcaaatcattcttccctccaaggccaattgtgatgagggtgactctatgggttatgtcttttattccattgaaggcaagttatcataaggctagttaccagaggaaagttaccaccaaggagatgaagagcatgtgcttcaatgaatgactgtgttaacagtgtgttaatcagaacaagtactaggaaaagtgggaatttaaatgtggcacaaaggccaaggcatgcaccaatgtaaatttagaaaactgtcgagaaaatatgtatggttactgctggaaataattcttcagccaatttggtaaaactctaagtgttaaagtgatgagagatccaatgggaaatctctagagtttggctgtgagttataaagttcataagaatgccaaaaaggccaaagaaaaaataaaagtaaaataaattagttgcaaaatcatatgtggggttggatctaaaggaaagttgaacacatagaaaactgagttaaaacaaacttttaagtcctgaaaaggcagagaattagccggtgtaggaagctgagtctcaaaattaaggatcttgataactctatggaaacaaaaagttaagaaaggcattttctgcttatagattaataaccagtattggaggagagaaacatagcaattcagatctgtttcccttctcccccagcagagaggatgaaaattggccattgtgtatacctccccagactcactgtatacctccccagaggaagttagagaataagattgacctgatcaactggtatattcagctatggctggaaagagagagttcccaggcaatcccattattaactgtgctggtggctactttgtgcagattccctataggctcagaacagacctccatattattccctgatagtctgattcaaatgagatcccatatttcctggtaggagaacatggttaacaaggtgccgtatgccagtctgagccacactctcgacacctgacctctcaacaaatggtgctgcagcctcttgtggcctccccgttattgctcacaccatcaatccctctgtggtataaaacggaaccatccagtatgtgctccaaatcctaggctgtgactctgcctgatgcccccagcttgggatacaaactccacagacatcataatctacagctgaaacacaggtataagaggctttggacatttccaggctgcctcagcactccttcaaaagcaaaatcaaagaataagaaaatgtttatcctgaccatccaaaccatgcatataaggttgaatggaaagatttgggaatagtgctgagatgaatgacttggaattgctacacctgctggagtttattccactccaaaatgtctttattccatcaggaagggaactgccctggaaataggtgctgttactggggccatctcttaggcaggaaaaaattcagacaccaacaaaagccagattatagctcattgtctgtgacttgatagattgaagacagaccattattttcatggaccacaacaccaaaagctacaaatggcagagccaatatatccttttgtttcaaaatgtcaactataaaaagcctagagttttcctatcattaccacttttctggatacctgtatgtttcagacaatggaattattttctctgtaggcttttaaaaataagtctttaaaaattggtctaatatgttgtaccaaagtctgtcaattaagaaataaagctcttgtttttaaaaaaaaagagtcatggaaacaatttctaaaatccatatgctttaaaacctgcagtaagatcatattgtttagaatgaatgtgtgtggtcttcttacctgacccttcgggtattttttttttaagaatcccaggacaagcatgtgtagtgataaaaacagcaaacactacacggatatttcaccaaaggctggtgaaactcaggatagttaaactagatagctttcatttccatcactggctctacctaatgttagtatatttcttaaaccaggacttcttaggaagttcagtgggcactagcaaatctgcactatgcaactggaagaaacttgtatacatagccactttccagtcttggctaacaccatcagcacaatgtcagcttattttccacttccggttgctctactgtctgttatcatcatgttgacacagcatacatttcccttcattatcacctctctccttacttttatacttaggtaagtaggactgaagtcaagtgaaacctgttttttaggttatgaaataaagagagattagaaatactgagaacatgggtagtaagagaaggaggacttagagacctgtttgtctatattaattctccatcagcctaaatagattaaatactgattccaaattgattataatcagaggtgtatactaccaaacactgaattactctctcttcataaatgaaaactgcctacatgtagctttttatcggagttctttttaggtgtttcaagaacaaaattttaatcatcaggttctaaaaagaaacaaagtagagagaacagagtcagcctcatttgtgcaatcatgcatttgttcatttcttcaaataaaatgtcctgcttacctattatattgtcaagcacagtgctgggtacaggaaacacagagatgaggaaaataagtatcccagtgcctatggagatgagcatttagtgacttaaatagccccagcaagtccgcagatgctggagttgtggtccatctgtttttgtttctctcattgacttgcaattgggataccaacaagaaatctgatattactccatgtgaaggacgatgcatccaatttctatgtggttttataggagcctagttcaataaagctgtagtgaatgcttaaaatgaagcagtgggtatggcttaaacaatttggactttggagacattaggcttcaaaaccaaacttgcatttaaatccctgttttacaactcacaaattccatgaaactgttttactatcagaaaaatgggtgaatatttatgaaatgatctttgtataactgtggtcaaagtatgcattagcatgtgtattcttctctttctctaagcttttactcaacaccttgaggacagagaatgcaaaactatataagatcaggaatacaggaagataacacacggcaagaggaactttgaatatgactttaaaacattttacacccaagaaaatatcaatgcttataaaattaaataaaaactgtatatagagatgaataagaatatatatttagataatacattttagataaaaatgtatatctctaggcattgttcattaccattctcattgtactaattaaaattctaaatattatttggaggggttaatatttctgtatcaaccaaattctaagaattttttagtattacattgaatgtttgataggaatttatttctagagtttaaaaatgagctagcaaactcaacttgtattgtactagcaatagtacacttactaaattattataattacatattgcaatccttataatctatttgtttctttaaaattattatatgaaggtctcccatatttatcacacgagtatctgatataaatgtgtgtgttggggggtatgtaaaatatacaactttcatttgacttgtattttggattttgttcttttgtttttgcaatggctatatcttaatttcatcatatatcataattgaaattggtttgcaaattttcttcaaagttatatatcttcatttactatacacatgatcaaatgtgaattaggatgcttaatgcatagtatatcagcttaatatgccatgtttcaaattgtacattcatatcctttgaaaaatgtttaagattaaacacatttttaaaatcatcattattattataagataatcttaagggattgtatgtcatgtctaaaaacagtagaaaattatacaaaaagtcatctaaatcaataatgtacacagtatttacttactgtataagtttcctattgctgttataacaaaattaccagaaactcagcagcctaaaacaacacaaagtcactgccctgcagttttggagtcaaaacttggctccaaatgggtctcacttggctaaaatcaaattagcagcaagattgcattgcttttggaggccttagagcggaacctgtgttctcacctttttcatcttttagaggctgttttctgcattccttggctcatggccccttccatcttcaaagccagcaatgacaagttgagtctttctcaggtcgcactactgactcttctgcctccctcttccatatctgagacacaaccggataatttaggataacctccttattttaaggtcagttgattagcagccttgattccatctattactttaattcctttttgacatttaatatattatattcacaggttctggtgattagaatgttcacatctttgggaggcccttattctgcttaacacaactatttactgttgaattttatgccatctattcaaggaacactggtctactttatatattttattctaatttaagcaatatttgtatgattaatgtttttatgccttaaatgtatttgtagaattttattaaattcttatagcaagtatttcagtattccaactttttgtttgttgtttatgattcatcttatcaatctactctcatcaacctagaatacagttgctggataaaatacaggacatccagttacattttaatttcagataattatattttaggatgccactttgtatgacacatttacacaaaataattatccattgtttatctgaaattaaaatttaacataacatctgcatttctatttaataagtctagcaaccctatcctaggaaaccctgaacattgttcctctgtagaactgaaaaagaatttgtgggatcatctgttaagacctcttatggagaactgagacccaaatacaactgcagttgatgttggaatggtttcaaatagaagcagaaggtattttttttcagaattttaaatgactcaaaataaatatttggccaacagaaatcagaaagaagcatgctgctattgcatgaaattaaactaagcaagcatctatgatttcctgacagaaagtatgcttccagtaggatagcagcaagaaagagagccctttggtataatacctgattacatggcaccactttaaattagtgtaatattctaagaaagagaacatgggaggcaatttgagaaataagccatgatttaggaattcatagtataagtggaccaaatagaaaatactgttacttgtatatatcttactttatctaagatatttaagatatctcaaagttaatttcaactatggttgttttgctccagaaaataaattgtttatgctttttaatcaaatactgcaaatatatgaattcttttaaaaaaacacatatttaaagatttcttgacagactatgttattagagtgtggagaatagaaaaaaaagtcttataaacaaatcatgttataacatatctctttctacttagtcatattacggtcataaaaataattttactttaaatacaaaacaatttagtaattgatattaaataattgggctcaattccattaaatcacatgaaaatatgaaacattttgtgtctgtttagggccagttttacaccagaagagtacaatgcttataggtactatagttactgcagatttacataacaagaatataaacttaacatttctcaagtgaccaaatgcatcagcaaaaaagtagggacagcagagtttagagaatgccaaagggatttaggttggtcagtatggcaaatgaagactcgtcatctcacttaccaacaaacgagtaagaagaagcaggagtcttagtcaatactcaaaccaatcctgtgtgctgagcattgtttttatccccattttacagacacgagctgaggcttagagtgggaatatatgccacgtcacttagtacatgcccaaaccacaatttgtgtcaagcatccagtctctacatccatgcttataaacactataccatgctgcctccatgcaattaaactgaatgtgatttaattgctcaagttgttatgttaaacagtgtaaagtttgtaactatcacacattgtgatcagttaaaattgattatataaaatattatgtgtgttgtgaatatggcctttatttttcaaaataatcaaaacttatttcaacttgcactaatatcttcatagagctcctggataatggcataagagtttggggaattaagattctggagaaaagcacctgcttttgaaggtttcaagtctaagggaaataattattttagatagattgccccataggattttcaaccaaaggaagagaactcgtcacctatatggtttccatatttgaattaagtcttaaactatcatgaatttatttttaagaaaattacagcttttcttgttcccaattacaaaagtactttaaagtgttggctttttcttaggttccataggaagagtcaagagaaaaagacataaaagggaacttaactggttcttgtcaccaacactttacaatttgtcatgacaggactgcttagtagacacaatgtccttccctcttttttagccattgaggcagagcaatttatgatactacattaactggcagtatgaggaaaacgtggtagaagaggataaggaactcgctaatgtgaagcgaaataaaaaatgagtttctaataagagattactttacacaataacttttctggggtcacatcagtcttccagcttgtggcttatgtatttccataagaggaaaaacattttgaatgacaaacaagaagtaatgatgagtagaatgtgccacagaaaagttaggtaatgttcaactagcaaaatctgatatactgagaggtatctgctgtgggctatacttttatttttgcaaatagagagcaagaaatttataaattaatgtaaagtactgagtactgggcatcctttttctctttctgcctaagatagctcataaaacataaacatatggttatcaatagataccccatagggctcttgggaaaagtaattcggattctggatcatacgtttgtatcatgctatgttgatgtgaatgcaattgattaaggtttatgagaccaataatccaccttaagtatatttatcttctaaaatgcttcctgcattaatttgcatctctcactgaatatgcataataatcttcatgtgcatttgcttaaaaattaggtcatgcctctgagtagttgaccatttcttatgtagctggcatttttttttctaaaataagagcatcttagaattaaacagacccttagagactacctagtcaagttctcatcttacttgaggtaagaggacaagattcagagaagataacttccttaatcaagtccacagatatgttaatgagaaaagaatctcaatttcttgtctaccaggccaatcatttcctttacttttaactttaactcactttttagaacacattaactcagaattggcttaaaaatgtttatccctttttcttttctttttatcaatttcaacaaaaaccttgtacttgaaaactagttgcaaagcacttggattgtggggctggcaagaagtgagagttgggaagaatgcacaagaattatgatgatctcttcctgaggaatcgctgaatggaaatacaaccatagttgcataaataactgaagaacaacacagaacacaaatctggaaatgtaaaataatggacatccagatagagcacatatgtgtttagaacttgtattaatagggaagatttcatggattagttgatttcataagaaaattggtttcactgaaatgaagagtggtataacaaaatgaaagtggtattaataaagtttggaaagtttggatttgagctaatagtcaataggaattaattttactttaagaacccttaatagcaccactgagagtacacatagcaatttttactgagtaactaaattatccctttaaaaaagtctcttctacagaattcaagctccacgatggcaggccacttctggctcaaacagtgctgttagtattcagcagaatgacggtgttaaaacaaaaatggactgattgagtaactataaaagaagtggcagtctacggccataccaccctgaacgtgcctgatctcatctaaaagaagtgacaaagaagaagtgttgtgcaagaactttatggcaaaaatctggaagtcactttcgagtacagtgatcagtgcttatgtagctagcaatttttttctaaaataagcatcttaaaattaaacagattccacccagatgtggactagagatttgaccttggaagtgagaaggaaaaaaatagatctaggagaaatttcaaacaaacactataatttgttgacagagtctaaacagggtaaaaagaagagaagtcggtgtcaacttccaagtctggatctctgaaagacaaagataatgttgacatagaaaggaggaaataaaatagacactgagcataacagagaaacataaggtaggttttaagcctgagacctatggacaaaaggagatttgaccttggaaatgagaaggaaaaacatagatctaggagaaatttcaaacaaacactgtaatttgttgacagagtctaaacaggggaaaaaagaagagaagtctaaaaagaagtttaacttcttttctctaaacttctaaaaagaaggttttattattctaaaaagaagtttagagaaaagaaaatggtttaaatataaataacatgatttggcatgataggaaacattcaatgaatagtgaccattttaaacatgatacatttggggttttagatagcttaatttcacaatttgggttttggattgctttctgatcccagttttggattgttttagttcacatttttgaacacgtaaaagggcagagattaagaaagcagtgaggaaagcacgaatgcagcttttctagcaggagatatgtgaatgatgagaatgtcaagggaatagtgcctgggagaaagtccaaaatggggcaacttgaacagaaggaagatgagataaagaagacaaagaaacaaaaagattcaaagcaatgtggtttcccagagtgcaggggaggggaagatataaaatgaggacatatcattagcaatcaccaatctatgcctgcgctatacataaaaaatatataaaataataagagaggtggaaacaggtaatttgacggccttctttggagacatgtacgttataatcctatggtagtgactccctctactcattgccagtcttcttgccatcttctatacatattcttcttttgtatttcgaatgtaattatttcgtgctttttattgtcagttcttaacaataaataggcagtgtaaccaagtgttcgataaattgccatttgattggacattttagcatggggaaaatgttttgttgaagaaaggacagcactacagtgataagctgcctgctgatgtaaacactttaagggtttatgacaggctcactatctaccaatactattttcaattcaattcaatttgagtagatgaggattttagagaaagcagctgccaggagaaacatatgacatttaatcttatctgagaacatgaaatcttctgcagaagctataagtacatacgtgtgtgtaatttgagtcttagtgtatattcaaaaaggttatagaggaagctgtattctataggatttaagccaacagacaaaagaaaatacatttcttggtatttttcccaagatacacttgactgaacaaataacatagagagtctaaaattccaagtgaaaacattcaactgattgcaatttttgaactattttttttttcaaaatggtaaccttaattcctcttctaaaatcccacaaaaacctacaattagtgtggatgctatttgattggttgaaaactagtccctgttaacaggattcaaaacactgccaaaatacagaaccctgcggattaccttatggactcaatatattactttaaaaaatgattttaaagaaaaacaacagaataattgaaaattgactaattctgattttatatgcaaggcactcaaaattacacaaaactgagttgtggtaaagaaaaaaatatttagtgaatttggtcatgaccatgacaaatagtaaaaataaagattactctaaaatttgcccaagcacattgtaatataaaatccatttaactttcaaatttatataataaactgattatatatttaaattggatgcatcatttacaaataatttggcttttatttctaatgaatgtgccttttatttcaactatcaaaattcatttccacattatttagcagatttgtttactcaaaatcataatctaccagatactcatgctgtgtatctttacttttgcttttatccacacaaattgatttttacccaattttcactattttgagcccaaatattcttctccatacttgtctagatgcagtcattagccatttaaaaactggtttgctcttttagtccagaccagagagaaagctatgactcttccttgaagtccaattgggtagaaaccttgtagcagccccaaagaaggttgcacattacaagcacaatcacatgccataaactgcaaacatctcattttccattgtcttctgttcccaattcaacttgaaatgagtcctctcctttccacttccaccgccacatgtcaaacccccaatatttcttgcctggatttcctcaacaaacttgttattttattttttcttatccacatcccctgcaactcttcagactctccactggcagagaaatttcccaaaatataatggtactgagaacatattcatgctcaaaaaggttaaatatactcgaatccctagcaaatgaagtacaaacatggcataaatcccttcataaaatgactcccaattatctgactatccttgttttatagtaatcatataatttttcgcccacactggaaaatactttttcagtggaaaaggtgtgttattaacaaggaaaaaaggaatatgtggcctcccagttctccttgtggctatcttaaacttaaaacaggtttttggtcacaggttttacaaacaatgcccaactttcccttctctgaaagtgtaaacccactatttctattgtctaggaggctgtttgcatctgttcctttccctcttttaggcctttttaaattcccacttccttcatggacagtttcttcatccgttcaccatccctggtcccaagacgtcatactgtgaacttcacctccattatcttactctgccttgaccagtcacttctgtgcttggtattatccccctgacttgacccttaaaaatctgatgacttcttattcatttttgcatttttctgaataccaaacaaaggtttttgcataaagcaaacatttaataaatacttttgatgaaatgccatcatcagctataagctgacacttaaattgtggccattgaaaagtatttatttagcaattgtattaaacctaaagaagaggacgttcaaaaaggatttttgtcaaccaaagattttgagtcattttacaaattcaaaatcattcatccattcctgcatcaaagattttctttaaaaatttattatatatcaaaagcccctaatatgaaaatgtacctttatgttgtcttagaaaagtttttcttgagactttcatttaaattcttctgtatgcgatgatttatacttgaataatcttacatctcctgatcccattgtatagaattaatgagtttgaatgtttttttgttttgtttttcctgttgtgtaaagaatgtactcatatctcttgagttaccaattttagatagtatctattggctactcacagaaaaagatgagtgatttagtgtttgcacaagtcccctctctattgtcccttttcacagacctctcaattttttttttttttttgaaacagagtctcactctgtcacccaggctggagtgcagtgcgcataatctcagctcgctgcagcctccatctcccaggttcaagttattctcctgcctcaggcttcagagtaggtgggattacaggcacctgcaatcatgccaggctaatttttgtatttttagtggagatgcggtatcgccaggttggccaggctggtctagaactcttggcctcagcgatctgcccacctcgacctcccgaagtgctggcattacaggcatgagccaccatgcccggccagacccctcaatttttaaaatttatattactatttttgatttacagggtttgtataatatttacattactcacattagtagataatatttgtttgtataatatttacattacttacattagtagataaattaatacttctctattttgtttctagattccttctaacaacgtaatatcaattcaaaaagcaattactatattatggctactaaatattattcccttcagattcattcaggtagcataactggacttgcagaaaaggagtaagcataattattaaaatcctggtttttaaaggattatggatatatatgaatatattgtgaatatattaaccaccagggtctaatatatcctttctcgagttaaacaaaaagttaaaaaaaatccttctggatcatatgtgattgccactgccttactgtctcatatctgacatgcctttttttggataattcatatgtagatatgtaggcatcagattttctgggccatttacatttttagcctaacattgattgatagtttggttggctatagaattttaagtttaaaacacggttccttcaagaaagactttgctcaattctgtttagaattcaaggaggcacatgagatctgatgttcattctttgtaggtatctttttttcccttctaaaagttcctagaattttctgtcaattagtgaaaatttactaagatgtttggccctttccattttttcaattttaagaattttctttcttcagttgtgaaatcttccttctgttttgtttttgtatttaggttatttccattctttgtctctgtttcctcttctaggatgtttattagatatatattgggatcttgcatttatgctcaacatgtcttaatttttcctcatattttcctttttttcacttttctttctggttctgacttttattttgccctctagatctctgctctggttctatgtttcagcacatctgttcagctttttattttcacattcataattttagtttctgggatcatatgcttattccctgactgatattttccatagccacttgcatgtgtgtgtatgggtctgtgttcaatattttcttgattcactcttaaaatgctagttaaaattgttttttaagaacattttcttatatttcctgaattacctgtgggattttttttttgagtcagttaatgctgttttgtttcttttttagtgttttaaaattctgctctgggttttctgcagttaatcctgccatccttagctgttgatgtagaattataatgggaggaccaggttgcatgacaaagattactggtggggtctgttttctttgtttgagagggctgactatgaacttgtgagtttagtgattgttttacctggctcgcttctcttaaagatgcatggatattggcaagcaagcagcctggaacttaccccaggagaaacctgttctaagagttgagaaacttatattcttatcctaggtagagctgtatttcctattccccctggccatatctgaaataaaatcacttccaatcctgccctttctctttcagtgccttataggtacagaagtcctctgtcctcacataattcccatttttcagagttctttcttttaactggaactctttctacattaaggttggagcagaaaggggaagtgaggagcccagctggcccatatctcctgaaatgcagttctttaaatatttccctaatggtcactctgatgcctgcttcaggactttatgttgactttaggtttggaaattatttgggacttttatagtaagaaccacttatgcatcttgggttgtgcttcccttctttgaatttctccataaatcagacccaactggcttttactttctgagagtttctcagttttaccaaatgtttgttctaacaatataatggcttcctctcattctctctccctctctttctcctttccttctagtcttctttcttttttaaaatctcattatttttgtcatttacttgttaccttagatggaggacatacatgtgtctttgtgccagccattatcttgaaccagaaaccagattaaatttctttttacatatttcttttaattattcaaataaatctgtttcgaatttattttagatagcccggaatatatattaatacttggttaaatattttttccacactttaaggtaggtggtactaacccatatgataccacatttagatttttcttttacatttctcaacataaaaaatatatatatatgtggttacagccaaaaggaactgtttgcttgcaatctgttcttcctggcaccctgtatgttccatgagagataagcatctactgaagcataaaaagtgtcttacaaaatcatagtaagtaaatcagtcactacattctgtattatcaatagtcctgggtgtcattaaggttctgtctgtatagaaaagattaggtttgtgtatatgatattctcctaaagcattttaacataaagtcatggtcactgaaatctgaaaatattcacatttcagtcttaatcaaatctagtacctcaggatttttcaatcatattcagaaagttcaaccatttcgatgtgttagctctagctctaagttcccaggctgaatatccagtggtctagttgcataaattattgtaatttgggcagagaattcaaactgtttgtaaactcaatttcaattgaaaaataccacaatgtcactaataatcaacacttaaattaagtaatcttcagccccacagcttcctcagaacccccaaaagtaggatgtgtaatctaaaaagattcattgagcaaatatttatttgtgctatcaaagaagatggcttcccccaaaagaattcctccaaatgttaaagttggtaattttctgcaggattaatatgtagcacaatcagaaaaaacaaaaacaaaaacttatataaggcagcattccctaggagagccacttggcagtcctgcctgcatgtgccctacatgagaattccatgcttcctctgaatcttcacaagcatatcatttaaattaagagcataaatgaggccacataaatgctttcttttccagtttttttaaaatttacttcccccttccagagcagattgcaacagtctggtataattgatcttgtccacaaaaaatcgaccgtaatacattaaatagttctgtaatgtggcaccgttaaaaaggatctgcttcaaatgactgtgaactgacaaggaaagaaaatgttatatagttggctgggcgcggtggctcacgcctgtaatcccagcactttgggaggccgaggcgggtggatcatttgaggtcaggagtttgagaccagcctggccaatatggtgaaaccccatctctactaaaaatacaaaattagctgggcatagtggtgcacatctgtaatcctagctacttgagaggctgaggcaagagaatcgcttgaacctgggaggcagatgttgcagtgagccaagatggcgccactgcactccagcctgggcaacagagcgagacttcatctcaaaaagaaaagaaaagaaaagaaaatggtatatagtttaccaacaggtagcctaagatagttatatgcagtgattaacgattacaaacatacaatgtggatactgataatcatttttactgccctcctttaaggaaatggagaaatgtcaggagacaaggtacagctgaaaattttcctccagtttgatctattctgcaaatctcttccatccttgtccaggttattgacactatttccgcaggattttcaggctgttcttttctcatctggactattccttagagcaggaattttattactaatctccaaactacctctcgaatattagaattattcacattccaaattataatacaaagatttcagcaactgctctctgatgatattttttttcttccagtattgtctgttaaatatttgaaggcaggtacacactgcctcaggaacaactctgtcctctctccaaatgctccagattcttctctccctcacagccctctttaactgctgtaatctgtaagatctactcttcgggcaagcctctatgtttaagaaaacactttcaggccgggtgcagtggctcatgcctgtaatccagcattttgggaggctaaggcgggcggatcatgaggtcaagagattgagaccatcctggccaacatggtgaaaccccgtctctattaaaaatacaaaaattagctgggagtggtggcgtgtgcctgtagtcccagttacttgggaggctgaggcagaagaatcacttgaaccctgaaggcagaggttgcagtgagccgaggtagtgccactgtactccagcctggtgacagagcagagcaagactccatctcaaaaaacaacgacaacaacaacaacaacaaaataagaaaacactttcagttgggggtctgctcagatatggtctaaatggcaggtgaaattgagacaattacttggataaatcaaatcacatcctcctacgcaattcattcgaatatattcagtcattaaacaaatattttttaaagaacctattacagactcaatattatgctgagtgctgaagagaaaatggtgagcaaaatcaaataaagtccttgccctcatgggtaacagcctaatggtgatgatagccaacatttattcactgcctattatgtgcatgaaacacttttcatgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaatttgtattgtccagggggaactcattaccacctatagatacatagccacttgcccatgttttctcagctatttagcagacacaggatttgaacccaagatttcacattcaggagcttatgctctttcttactccactggcacacctgtgtacccctacactcttctgcccctaaggtagataaatagagaaaaagaacaagaggggtgatatggcaaaagtatctcaatagttgcatcaattctcctttgctttgtgaattctggatgaaacaaaggacaactataataattcttgcttgctcttctctttaaacatgtagtagtcctatttgagaataagtgataatgacaactttttagaaaaaaatctacatgacccatcattaaatgggaaaccatttttttcagaaaaaaaaaattgttataatggagattacaataagatgcctacagaagattcccattgtgctatagtctaacttaaatcacaaatacgcatttatattattatatcattaatattagctcattgaataggcatttattgagaatggactataagaagagctatatgttaagagacatattcattcagacagacattgcttattgtccacaacaacgatgacttttaaaagtaagaagaggaagtaaagtaaaggggcaggagtgagtagagggaggagtctaaggtgacaaccagctttctgacttaagctgctatgcatcctgaggccactggaagaaaatctggtttgagatttattggaggttttttcttttcttttctttttttgcctttttgagttttattttcttttccactttgagggtgttttgttttgtttccatcggatgctctagaagaggcagagtgctcattggaggttgacagtgtcataacccttgtctgattatctcgattttatgagcccaattaaggatgataaaatatgtgttttagagatttctgccatccttacagccccttaccatccctaaggatacttctcctgactattaatcacattttaatttttttctcttttcagtacaattatgtgagtttgtgttattgcatggccatgcctcagtggtctacccttccttcacaccacttttctatagggaaaccaaaggtgcatttataccataatttagttgaattcagcagtagttacaaatgatgttattaaaatctattgggaaaaatgattcatcttgattcattcaaaatgattcattcaaaaacagaggacaaaggaatgtggggaagttaaatgatatatcattgaataaaggcacttcagaaagctctctgtcttcataactgctacaagtgtcctttataacttcattttacccaaatgttttccaaaacatctgtctaaacttttcaactaagtttagttgttattcttgcttcttgtaatttcagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccgggtgagtatgttctctatgagcccactgcatgtcttccacctgtgggtataaaaaattaatgagccttccatttttcccccatttataatatcctaatcctagccacgggtttgtaatgaatcacagaatgctgacagtacaaatacagtttaccataataagagtctcgttttttttcccctgatattgactttatgaaagtgttaagtgactggatccaatatatcattcacctcatcaacttgatgagtgtcattagtttccatttacctcctcattgctgaccaatgtgacatctggagagagatttattggtcaaaacagttttaaaactaaaaaaaataaaatacaaaaaaataagaagaagccccgtagaaagatgctttagagttaatcacaaatataaatgccagaatccctgaaacactgggctaggatataaacatatataaaagatgatccatgtctttctaccatacttagggaaattcaaatcacactgcatcaattttgaaaggaaatggcaaaatgagttaatctctgactttcctcatgtgttcatggagataactatattaatgtgttttgcccctgtttaggcttgaaatatcctttttttcttcagtcttgcatttccatgttgtgcaaaacaccatgctgaatgagataacttgatggtaatgttttttttactgaacgaaagtggccctatggtgatttaaagcagggaaattagtacaaatgagattttccccactttgcttagtatcgcttcagggccttaaaatccaaccttatgctttcaggttaaatcatagaataactctatcgagatacaagcagttcgtgaaagagacagcaccaatcattgatctcttacctttaatttgcttttcttattagacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcctgtggcccgctgccactttgaatagggctagtctgtgtaaacaatagtatattccagaaatgatgatacgtctcttctgaggccaggtcataaaaggcattttggtttcggccttgctctctgctggataattcactcgagtggaagcactccagtgtcactgatgcaggacagacgagccccaaagtgggaccaagcctgccagaattcttggctccacccaggaaagaattcaagggcaagctgatggtggttagaagaaaacagctttattgaagcagcaattatagctccatgactgttcctgcagagcaggagcagcaggcagagagcagcagctcagggcagttctgcaattgtgtttatacctactttcaattgcatgcagagtaaggggtggattatgcagaaatttctaggaaaaaggtaataactactaggttgcaggtcgctgccatggaaagaggctgtaactgccatggcaatggtgggcatgtcttacgggaagctgcttctgtcctgtccctgttttagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtgcttacatttttaaattttcaatcttttcagaaaagtcaactaggagtactgttttataaactctttaaaaagaatataatttttagagaataattttcttctgtatagttttaataactcctgaagaaaggattacaagaatgattacaagaatgttgaacaagtaaaatccccattataattaataattttcagtcttcattacagaactctcaatctaatatctctaatacaatgtttttcctaaatatcaagtggtatttttttaatgtgcttaccatatacaggatgtgggaaaattttaaatacattgtttacagataactgatacttagtcataccattcttaacacatttcctcttgctctacatgtaataattttgttaattattattaattaataattattttgttgactagtttgacacctcgatattcaaaactcaatatttctgacttaagtaatggaagactgcatgtgcaattacttccagagacactaatgattatttttaaaccattactcattaaatttcatataaatgcatacaatctgcatgggtacttaaaattttaaactttagtgccatattttgcatatcacatgattcacacatgaatgagtacatgttgcacagttaatctgataacagaatataaaattatgtaattatatgcattatatgtgtctctctatatatatatttcttaatattctgcatttcctttgagtcatgtacagctttaagtgaccacaaagaaaacaatatttatctcttcttcaaagtggcccgtgtcctttgaaaaatctaatatgcttgagatgattcccaagctgaaatcctgtttttttgtgatgttccagatctatataacctttaaaagtgcgaagacttctcctattttaaagacaatttaaaataaaattaaggaaaaaatttcatttacattaacaccaaaaataaaatacttagtgataaacttagtaaaagaagcacatgacttatccaggaaaaactacaaaacatcattgaaaaaaagtgaaaaaaaaagtataaatagttgaaaagaaatcctgtgtttatgaatcagatgatttactattgctaagatagcaatatttcccacattgatctgcatacatattcaacacaatcccagtcaaaatctcagctggctccttcactgaaattgatcatctgatcctaaaatttatatggaaatataagggacccagaatagccaaaattttgaaagcaaagaataaagatggagtattcacatttcctcattttaaaacttattacaaagaatgtcataatcaagacaacatagtacaggcataataataaacaaattagtggcatagactagagagtccagaaataaacctcatacacatttataatataaacgtgtatgttcacgttatttttgacaagatacaaagaaaattcaataaagaattttttttttcaaaaaatgatgccaaaataactggatatccatatgcaaaataatgaagttatacacctacctcacactgtatataaaaattaactcaaaaaggatccaagacacaatgcaacaactaaaacttaaaaactcatagaagaaaacaggagtaaatctctgtgaccttgtgttaggcagtgttttttagacatgacaccaaaagcagaagcaacaacaacaaaaaaaataaattgcacttcatctatgttaaataattgtgtgggtcaagagacaccaccaagattgttagaagacaacccacaggataggcaaaaatatgttcaagtcattattatctctaataagggatttgtatccagaatatattttttaaaaactgttaaaattcaacagttaaaagaccaataatccaattacaaatgagccaataaattgaatagacatgtcccaaagaagatatacaaattgtcaatagtgcatgaaaatatacctaacattattagctatcagggaaatctaaatcaaaaccagtgcaccaactaggactattataataaaaaataaagacaatagcaagtgttgataaagatgtggatgaagacatttggaattctttgcattgctgtggcaatgtaaaatggtactgtagctttggaaaatttgacaattccttagaaagctaaacatagggttttgatatgacctagcaattccacttctaggtatataccaaagatagttaaaaacatatgttcccacaaaaatttgtgtataaatgttcataacaggattattcataataccccccaaaaccagaaacaacccaaatgaccagtaactgatgaaaggataaaaaatgtggtatatctatattacttagcaatcaaaaggaatagtgtattgacacctactacaaaatggatggaccttgaaaacattacactaagaaatgaaagcagctaatcacaaaatactaatattgcatgtttttattttatatataacatccagaataggcaaatccattgaattccaggagctagggggaaggaaatagagaatgaccactaaagggtatgggatttcttggatgatgatgaaaatgaactaaacttagatattggtgatggatgtgcaacactgtgaatatacgaagaaccactgaattgcatactttgaaagagatcatttttggcgtgtaagttatctctataaagctgttatttaaaaaatgtggagactatttaagtagatattttcaagtggttttaagactcagtcctataatgctgtacaaaaacatagtccatgcccattttgtttaaggcacaaagttcaatgtgagaattcaacaagaccaagacatggttcttgccctccagacacaacgtagatggggagagaaaaaaacaaaggccaatcacagctcacagtgagtctcccttacagaaggatgaggaaatggaactgctagaggagcacacagcaggaccacgaagcccagggttcatggatgtgcagacagcagtctggaggttgcacaggagacaaggcacagaagaggagctcaacagcacatcaggcaaaaaacaaaattactaatatatagtttcaaaaagccttgacaaactggaggaactaaaagtattaagaatagcaggaaggtagataaaagcagtggatggagtagcaagaaacaggccaggaaagagggtacatgtgagatcatgaagggccttgtgagccattgagaggagtttggatgccatcctgaaggtagttgggatcttccatagggatatagccaggataaagatgatgagtcacgttttagaatctctggactgtagcgtagaaagaagactgcaggagtccaagactagagagaagtcaatcacgctgaggctgttgcggaattccagatgaaagatgatgacaggaatctgaggaatggcaatggccatgggaaaaatgtgagtattctatcagctgcttcttcaaggaccatctaaatttgttagatacagattatcaggtacaaaggtacatacaagaaagattcctggagctaagagctacttgagatcgtagcattctaatcactaaatacttcgttagtgctaaggaattctgttatgggttgaattgtgtacctcccaaaattcatatgttgaagtcttatccctcaatatctcagaatgtgactgtatttggagacagaatctttaaagaggtaattaaagtaaaataagattactagggtgggacattatccaatataactgatgtttttacaagaagacagaattaggacacaggcatgaatagagggaaggccatggaatggcacaaggagaaaaccatctaaaagtcaaggagagaggcctcagagaaaaacaactatgccaacatcttggacttctggcctccagaactatgagaaaataaatttctgttatttaagccacccagtctgtggtactttgttatggcaaccctagaaaactaatttaggctctaaagggtcggcatttgtattactaaagcatagtcaaaagatacctcatttgtcagctaataaacgtggatttttactagggactgtacatacagaaaggaataaaacagtttcttctttcatagaatcacagtccagggaacagaaagtcaattaatcagtaatgattataaaaattacaagtgatgttaaagagtcatgcaaaggatactaggggaacatagagctggggcacttcagcatcagcacaggggtaaaaagtttctcaggggaggtgagactgccttgaaagataaaatggaactggagaagacaaagaaaggcatttcaggttggatgaatcctataagcaaatgtacactgtaatcactgtaagcaatatggcatgattagaacatggtgtgtatcaatacaagacagtcagtgaccatataacgaagggctttgtaagcagcatctagtttccagactttattctttaaagctgtggtgagtaattaaaggacttttaggcaaatatatgacatgatagtattattttttaattttagagaaatcactgtggtgacagatcagagggaggatggcagagaagcaagaatatgaattagagaaatattgccataatgtcaggcaaagcaagactttgtgaattatgtctaagtggtggtgatgaagaagataggatagatttgagatacagtaaagacaacagagatcatggtagagtaagggcaaaagatgaatgaaaagatgggatctagttttctgatttgacatccatccttagtgtttcacttctttccactgcatacataaatccaataaaccagcctacatggacatctatgcatgatcttgtccctgtctaactcccaggcaatgcgcaaccatcatttagcaatcctccttagtccttttagtgttcttccatggacttttacagtacatgattatgtatttgtttgattttatttttattttaaaaagtgggctttaaattttaggttatattcctaagaatcacttaagggtttacttaaaatgcatatttctcgttcttagagattacaactcataggtttgagaaagaaccctatgttggcatgtttaaaagaatccctccttcctctagtgattctgacacatgcaagtaatgaactgtactttgctaagccactaattaaaagtttattttcctaagaagagtagaagtcaggtctgattttccaccactgtgttccagatcctaacatcatgactaagacctaataggcatcaataactatttttgaatgaatgaagaaagactaaaatgccatgtgaataggtagtggtatccttcactgaaaaggggcgtacaagggaatgactggttttgaaaggccgatcatgacttagttcatgggtttgtgagccaagtgtgcctagaggtaaagatttcaaaggcacaggtatatgcaaggcaattgaggtcatgaatatttatgagagagctctctcccacagacatgatgaaaaatacaaagagaagatggcacaaatggatcactggaaagagtcaatttaagaagcacactcaggaagaccagtggaaaacgatgtaaaaacatgatcaaatggtaactagggaagaatctagtccacagtgcaagaggccaatcaaatagttaatttcaggaatgatgaagtagttggcaatgtatgaagacagtaatatttcataaccataggatttgaaaatttaggggccttggttaccttcatgagataagttttctgtgaagtctctcttatctactttgctccagacaggtagatatgttcctcctctgtatttcatcctcctccaagacatatttttattgtaacactttggcattatatggtgattatctgttgatgtgtttatttccccaccagactgacagcacattaatctcaaggaccacccaacccctatataagacttaggacttagtaggagttccatgtttgataaatatataacttgattaataaatagaacatgtgataaactagtctatgactagaaatgtataacttctctctatttagtgttttgagtaggcctggctttaggcagtaggcagatgggagtactaaacttatcgtttcctaaatctgtgtggtctctagattatgtcatccgcagcttcagagaagctaattttgaggagactaagtaccctgaccgcatacctcacaaggatgtttggaagacctaacaaattaatattttgaaagtttatttattattattattattattttgagacagagtctcactctgttgcccaggctggaatgaggtgacacgatctcagctcactgcaacctccgcctcccgggttcagacgattctcctgcctcagcctcccgagtagctgggactaaggtgcacgccaccacgccctgctaatttttgtatttttagtagagacggggtttcaccatattggtcaggctggtctcaaactcctgacctcatgatccgcccgcctcggcctcccaaagtgctgggattacagacatgagccaccgcacctggccttcaaagtattttatgaacagatgatgtggaagacagaaactctgcaggttcctttattaggactgagaggagcactggagaaaagatatccacgctctacccatcattaaatacagctggtctgtctaaaaattatatcagaagcaaaaagtcaaaagccaccatctctggatttcatccagatctgctattacttgtttttatcgtccgacaatctcagctcttaataatggtttctgatatttgttacatgaagtgccccatctttcactcaagttctatgcagaaaaagccacgtaaaagagtgccttctccccttaactctgagtccacggatggtggcatcttgagtgtgcatgttggcgtatgtattgtggatgcggtggtttaagggaagggtgcaggaagtcagacctgtaatattttgggtaaatgggatgtaataaccttattataaggcttcaccccaacacagtgcatatgcaaatatgcagggcacatatggtatttgttgcaagactattgaagtagaataatcttttcccttaaattttaacttatgataattctaatttggatatcacagagtgaccatttttaattgaagccattgagttatgtttttgttactatgttcatgtttatattatagatggccaaatttagagtttcaaataatttccttcaaaaaaatattttcaggtaggattacttcatctgaatgtttaccataaaaattactattttagctattttaatgtgatatttttgtgaatagtatttaaaagtactatagtattcatgtttttaaacttaaaagtcagctaaattttaaaatatgacttaaatgttatacataaataattacattgaatctatatggtcagtactttataataactaaatctaattaaattgatccttcattgctaataagtagaagttaataatactaaaatgagctcagaactagtactccctaatggcaattctgcaaattttcagaatatttcatttaattatgtacatttcttttttccatgtactaatttgattcctgcatgcagaaactaagataattcattttaaattattctgtgatattttgaacaacataggagatgttctgttcagtgcaaaacacttacccatttcagtgttagcccatatgactcaacgttcatttaatgcaatctatagagggttacaggaacacgtgtcttcagaatgttaaagatagccaaagaggtttggaatgaatattttcagtggcaagctattttatattagtaaacaaacaaaacataaagatgataataatagtaataataataacatttattgaggacatactatgtgtcagattgttctaatcacttaacatttagtgcttataacaaccccgtgagttaagtattttcctcatattttgtttaaagaaatacagaacagtagttgatatgcatcacatcacacagctattaaatgatgtccaatagattcgagtccagggtgactactgaatcacattttactgtctctcctcaatgctcccggggcagtgcatgaccaataataggtagccaaaatgttttgaaaaccaactctattaggaacatcccatccagaaaagggagcagaggagataggagacagtgaagtcagcataaggcatttaaaataatcgtccaagtgaagggaatatggccctagtcaggggaggccttagacaggagcaggggatgaatgagtcaggccaggcaatcagttcactgagaatagaaaagaaagggtaagtttaaaacagatttagaaagaagcagcaaaataatttggtagtaatttatttaaaggattggttctcacaggacacttagaataaggtaaatgtttgtttcatggtttgagaatgctacatcctagtgattccttttccctcataatcattacagtaagatactctctccagctaggattattctagtcattacattccatatgaggcatcataatcattttggtatgaatttagcatgttttagtcaaagtaaccctaaatggaactcttgctacaaagtaaatcaaggggttttttggatgcaaggcacctggcacagttggtactgggataccatcgtgaaattagttttaccaagtaaaaatctgaatcctgagttttgagttttccagttcttttttcccacctaggtcatggaatactattagccagccttacacaattaacaagggatctgaagattcatctttgggaatttttagatttagcaacataaaagatcaaaatgttatgatattaggtgatttttcaatgaagttctctgtcaacagactcatccaagtgcaaagagttttaaatcagcgttatagtgcacccttacatataaatggaagtccaaagatcactgggcatttaaagaaattttctgccatgcaaaatcaacattaaacaaatagagagaaaagtaatttggggaaaatagtctttttccccaatgcatggagagggaggcatctaaagttattataactccagagatttttttaaaaatagatgcatgaaataggaaatttctattaaaaaattcagaaagcataaaagaataaattaactataattattatgtttaataatatatctgatacattatcattcattattattcataataaattataattctggataataattataattgattataatctcagaaatgaagactcaatagaataatttgaaggtaaagctgagataatctcccagaaatttaagcaaaaagacatacagaaataaatgaagcaaaaaagttaattaaagataatttcagcatgcccaataattataagaagaattcatggaaaagcaaatagggagttggaatcattaaacaaaaatatcaaaatttttccagaatgaaagtatatgaaattctagattaaaacattctactgagattccagcacaacatataaaaatatacaaacattagtttatatcttgcagaaatgtcagaatcccgagaacaaatagatcataaaagattctggagaacgaaagaaacaaaatgaaaaaaaaaacctagttgatgtgctgaacctaaataagaaaataagtgaaggaagagggggagttggctacaggaaataggagatacgccacaaaaaagatgtgaatccaccacaaaaagatgcgaagaatatcctcagaacggcagtcaagggagatcctaggatgcaagctgtgctgtccacctagacaggtaccagtctaaattggagaagccggagagactctctaagaacatgaactttaacatcacacactggggcctgtcgtggggtggagggatgaggagggatagcattaggagaaatgcctaatgtagatggcgagttgatgggtgaagcaaaccaacatggcacatgtatacatatgtaacaaacctgcacattgtgcacatgtaacctagaacttaaagtataataataaaaaaaaaaaggacataaactggttaactatccaaatatcctctggtagaaagtttgggagaaatcgtccttaagtatataaaaaacaaactttaattatataaaaaccaaaacagaaacactaagtatttaaacagataactttaaaaattacggttactagctataaggacaacaaaaaaaatttccaagaaaataaaagtaatcaaagcataacaggtgacacagttatgagcagcatctatatgcccatgataatgtaaggtatggtgtagctacattgggaagatgataggagaggaagtgtaaataacagggttaaaatagatataaaggagataattcctcatttcctatggtgagaagtcaatataaacaaacatagcagaaaagtaagaagtagaaagtgtgagcaagttattcaggagagaagagtaaaacacatcaaggacccattaatttaaaaatttgactgtagttgactttgggcatctgaaactaggggcagaagtactaggggctgccatcttcgaaacgagcttagtgggaccaatggactttcaaaatcataagtataaataaatttaataagcattttaaagaagagcaagttgaaatgaaaagttaagaaacctaactgaaaaggaagacagataagaaacaaagtagggagagctaaaagtgaaatgtcaaatttaaatccacatagaaaacaatgaagtacagggtagagtttgtataaaatcaaatcattaatgtagaaaccacataaagcttcttcctcaaaccactgaagaaaacaatacagacatggaaaatataatggaaaatatggaagaaaagagaagacagaggctattgagagaattatagatgattaacatttctgatggggaaatccaaacagctgttatagaaaaataaaatcaaagatatgaggaaagattttttttttctgaagaaacatctgtgcaaatagattgaaagtcaaaatcaatggaaagaactgacaaaacataagattattttggtggggaattacaagttaaagaaaagcccaataaaattcaagcaaggacccccacccctgacaaaatcatctagtaaaaatcttttaaaaagatagtctcaagttttgatgcagccttctcattatcttttacttctaaatggtcctgattgcacttttgacgtgacttactgaaaagttattatttaatttctaaatggttgtagtttatgtttatacatatatttctagttattctgccacaatacaaatgcagaataaaaagaagcgtaatactttttaggagaaactcttatgatcacataattaataatatgacaaggtttattttacatttgaggactagagagaaactctcagatatacaatcattcagaaaatataacatttaaagacactttactgggaaaaattacctgaatatgtaatgcaataaactacaaattcaaacttgagaagtccaataaaggagccataatgtaaaagaaatgactgtgattgctgaaacatgtgagaaacctacaaaaatgtgagtaaagttcattataaaacaggattacattatcaacaatagttatgaaggatatataatgtaaatgtaagaatataataagaataatctagatccaagcacccaggtctcaatgaaaatataacttgcatgttgttttatgggcaacaaagcaaacagcaataaaaaaaaaactgttagaaaaatgacaaattgacaagttccagagtagagtgaaaatgttttttgtttttttgtttttttgtttttttttccgagacggtctccctctgtccccaggctggagtgcagtggagtgatctcggttcactgcaacctctgcctcccgggttcaagcaattctcctgcctcagtcccccgagcaactgggactacaggcacacgccaccacgcctggctaatttttgtatttttagtagagatgggtctcaccatgttggccaggatggtctcaatctcttgacctcatgatccacccgcctcagcctcccaaagtgctgggattacaggcataagccaccgcacccggccgaaaaagtatttttaaaaatgaatcataaatttcttaatagattaaaagtttttttaaagaaaactttgtttaggccacattttctgataactttgtagaaaaactagaaataaataaaattataaacatataatgcaaccacttagaaattaaacaataactctttccaattagtcaggtcaaaagtgcaattaagaccatttagaaataaaagataatgagaaagctgcatcaaaactcaagtgttacacacaaatctgtacttataacaaaaatttgtattattcaatgttttattttaaaatagaaaataataaaaataaatgaacttagtattaattatagagggtaggcacaaatgatacataatactataagaagtagagggaataattaataataaaagacttagaaacagaataatggtgaattaattaaaaagaaaatccaagaacagtttctatggaatagccagttgaaattacagatacctggcaagtctaattgagggagaaaaaaaagagaggaaaaaactcaaatacacagcctggactctgacatacagatgtaattataaatacaaaaaaggaaaataataaaataccatatttattaaataaaataataatataacataatataatattgctgtattgctttttaaacatccctggtctcccatgccttgaaaataccatctgtgacatagttgtattctttaactgctgcattctttttctttcttcaccatacctttagaagcaatgttttatgtcccctgtaccatcttccccatgcaaaatagcttttacaatctattcattttaaaggctcacgagaaaggtatcagcattcaaatctaatggcctcttttctatctacctcttttttgaagccctccttacttgagatctgaacactatcactattatttctctcttgtcatgaatgctggttcactattcttgttgatagttcccctatgactgcccatggttttatccttaatattttttgacttgtctttgtcagaggtcccaactattccttggccttaaacatcattgctgtacttcaatcctgatcttgttacttatgaactagaacatttccaatgtcctgctgaccaagcgctgtgagatagaactaaagtatgagacataaagctcatcatgtctacaaatggattcaccatttggcctaaacattttcttcttgattctccaatttttttcagctcagttttatgccctgtattggcaaccatacgtaatttttttttttatccatccatggttttttctggccctgctggaaccatttatcataatgccattccttgactaccacaaagggaacgtagctagctttctttctcttctaatccatcttgcacatagaaatcggggacagataaaaatactcttaacattctctttgtttacttgtttacttctctaatgaaaatttacaacttctcacaggttacaaagcaaaataaacattagtaacctgactttatgccctcaaacactctttcccaatctaccttttgagcatcacataaaatgcccatatgaaaattatatgcttcactcaatttttgtattcatcttcttttacatgtctctatttactcttgttttgcctctgctttgaagaccattcttccattcctagctgtcaacacactactatttcttcaagaattatttcaaatgcctcgtccgttaatttgtccccgatcacttgaatcataagtggtccatccctcctctcacatcatgcaattttgttggtatcatttgtatgataatttcattatgctcctatattataatgaactcctctattagttttaactattctttaagtcaggaaccatgcctaatatgtaccttaaaaatgccttatactttggctccatattattttacttaagctagcatttgcacaaaaaaggtgctaataatatttttaatgtatgtacaatcttgagataatataatccaactttcaatttttgtaagtattaggaaataatagcataaacataataaagcaaatatgtgctatcattctttgggcacttttgagaattatacaatacaagctaatactccaaaatccatttctatatactttctcttcattgtacaaactttccaggattgaatatccagttaacctaactctgaaatataaaatagaatgtataatggcaaaattcctaagtatttactatgtgttatttgttggccaaagcattttagctaattacatttatttaaaatggttatacatgttattggtctggtttatctttaaataggaaaatctatcttttgtcattataaatttccagtttccaatgataaaatcattctacataacttgaaagccatattgacaaggcactttgaaaattttcatctttaaataaacattaggttttcaaattaggtcaggatttaagtctcttatttataacttactaaatgtatttccctgagcctcaatttccccatctgagaaaataaatcagtaaaaccttacttcaaatgatttttcagtattgaatggatgaatccatataaagaacctagaacagggtaggcataatagtcatagttagcaataatcatcatcatcaacaaccaccaccaatccctcctcctgttcactcacctacttattctgcctaacaccatagctgctgctattcttcttcctaaaataaatgtgatgtatcccctacttcctgcttaaattggatagagattctattttctatttcccattttaacatctctataataaacaacagataaattatttttaaaaaatcccaaatgtactcttctttgtataaaatttattccagaaaatgtacagctctggtgtaccattgctataatttcattaccatgtaactgatacatttcatgtgacatattctgttgggttattttaattaaataagcacaatgttgaagctctaatttttttcacttttaaaatggaatgaaatattaaaatgccagctttgtgaccttgtcttctccaaaacaatattttgtttgaccaaaagtagttctgaaaggtgaattcgtcacatgaatgaataaaactcaatgtaatactctgcttggggtggattataacctgtctccgtctcccaatgcataacatgaaccctctagtacatctaatacatctagttttgaatatattaagaatatcacatggtagtaatctgaacttagactcagatattgaatgcttagaggctaacctaatacccaattgtattgattacaatacaaaatatggtttcactgcactcatctcaagagatttgttaggtgatgatgtttgtaaaaatggatatacagctggaaagcaattcaatgatagcttatcaatcaaaatataagcgtacacttaaacataagaggaaagctgaaggcattttggatttccagtggcagggcagttagtttcattactcaccaaattgcaaaagatacaaaatgggatttgctcccaatgttcatggtactcttttgtactttattttatttttcattttcaatgcctatcttctgcaagtacatatttaataatgtatcattgtttcatatttggaaaaatatattccaatcttttctcaaagaaatgaaatttaaaatgaattaagtgcttcctaaaattgtttaagctattagtttcagtgtaaaggaacagaaaatggcacatctttaattactaaatgtgtaaatacagacataagatttttttaaattgtagataaaaataaaaacaaaaagataagttttagagaaaccaactcaataataaatcaagcaaaagggtaataagggaggccaggtgcagtggctcatgcctgtaatcccagcactttgggaggctgaggtgggcagacagcttgagctaagaagtttgagaccagccaagataacatagcaagacccaatttctacaaataataataataataataataataattagcctgatgtggtagcacatgcctgtagttccagctactcaggaagctgaggtggaaggattgcttgagcccaggaggttgaggctgcagtgagttatgatcgtgccactgcactccagcctgagtgacagaatgaaaccctatttcaaaaaaactaaaattaaaaagagtcacaaggaagaaaagaacaaaaggcaaagcacatggtatataacaaaaactagaaatagtctgcttagaggaagaaatgagatagaaagtatagttaaacaaaattatttttataaaagttttcagaaatagtttttcttaaattttctgtttttgtttccagtctttctttttattgtcatatatgttatttttagggcactaaattacataactttgtttctaatatattactaacatcatatggttaagatttatcattcttaaagaacttcctgttttgtttggcaaataataggataaatgtaagaagaaaagagtaagttggaatttgagattccaatttgtggcacagaaattcctctttttagaatggaaatgatggatgtgttgcctataactcaaaatgaaaatgtgagagcagtaagaataaattatgatgttaaaactcaaagaaacacttaaaaacaaaacaaagaacataaataaaattatttagaacagaaacaccaatagaacaaaacagacgcaatttatctttttgatagattcatagaaagcttaatctggtgcatgtgaataggggagagtaaggtacaatttatagtcgatcccatgacacggtactaagttaggttgcagagtgctcatagctggatgtgaagaagcaaactacgtaaatgatgaaaggagattcctattaattgctcaggccaagagactatcttcatagcctgggctaaggggtaggcagaataaccaacagtgtatggttaaatttatcttgcgtcactaccagacaatgctaagaacagctataaactagaatccctgtcttgtcacacagaaatatgatccaaacataaatcagatccattaattattggaaatgaacaattaccacaaatacctgcatttactatatttgttatatttcatattcttattaatttgtccagttattgtttataattgttcttatatcaaattatttttaaagcaaaacaatttattacgagggtttctgctatttgacacttcagatcagtaaatgaagcacctactagcagtttgttactgttgttcaaactttatagctctgtttagctcagttttctattcagtgtttgtttacttgtacagatgcaaatgctcactttattcttcctaaaatatgtgtggaatacaaatgctctcagattgaatccctctttgaaccacacatttgaatattttctgcttaatatttgctaatgcccatgaaaagaaatttgattgactgtaaaaggacatatcaaggaaaactcatatctcagaatactaaaatgaagtacaatgactatctctacaaagcaccaaaaacatccagttgaaatgtgaacatattcccaactctgaaaaaccaaaagcagcttgagcactttcttacccttacttccccaaataataaattatcttggggttggatacatatagttgaagaattatccccttgtttaaagttacttgaatgagagacaaaatacttcgtatccatgaaatgaaataactcatgaaagcagctgcatgtttgaataatttcagttctcaaagtcagtcaagcctttaaaactagttattgttttgtgtttttcatattagtacctactattgtaaatcctcaaaccaaggctcagggatgacactactagagtgacaatggagaagcagttctcctctttaaaaaaaaaaaaaaaaaaaaaaaagtgggccaggtgtggtagctcatgtctgcaatctcagcactttgggaggccgaggtgggtggatcacctgaggtcaggagttcaagaccagcctggccaacatggtgaaaccccgtctctactaaaaatacaaaaattagccaggtgtggtggcagacgcctgtaatcacagctactcgggaggctgaggcaggagaattgcttgaacgcaggaggcagaggttgcagtgagctgagattgcaccactgcacttcagcctgggtgacagagcaagactccgtcttgaaaaaaagaaaaaaatgtgtccacaattttgattagaaaactttcctctttttcacgagagaacctccagtcttgtaaatgtcagtcatggttcagattatttattttaaaaagatgtaatcaaaagactccaaatgtatgtatttttgttccaaaaatgcattttgcctctaaagagaatgtcagttctattccattgtctttagtttctttccctaatcagatataaatgaaagacttattcattggtgtccattggtgtctttagttttatttgtaattcataaaactacttgaaagaaatatggatatactattaagtattgttttcaagtaaagggccaaggaacagcacaaagaagaaacagaaagaaaaagataagatagagccctattcttgctctgaaaaatgagctgcctgtggggaagctgctcccctaaagaagggatcagggatatcttcctgtgatattcactggaatactgtctcccaacagacactggcaagtgcagaagacctcacactgccttgctggcgattttctcctcaatagagtatatttaagaagaaaactttgaaatcttaaaagagagcaaaggcagcggtattagggtaagactggataatgctctggatccattaccataaggatagcaaataacaaagaaaagtaaaatgtatctgacagagacgggctcaggtgctcagttaccaccttggaatcactcttggtccatccttactgtctctgtacatttttctcgcacaccagcacagggcacttctttgctgcttctgtttccatcttgccaggatccatcttcacttttgtgacaatcttcctttcagttttagtaaaacaaccacaagtggcgatcgtaagaaatttctggaaattccccattgttgctgtacaacacttcctattataaaattcactgtgagtaaagaattaaaatatgaaattctagctaataccaatgtaatgagtagctctaaaaaagttttaatgttttcttagtaagatctttttattcattcattgtcatatcttattcatctttgcatgctcagaatttgggcaaactgtaaaaatagaaatatggcaacatatgtgtatgacaaagtacgtatatatgtatgtgtatattgacaaagtatgtgtatatgtatgtatattatatatatacactatatatatgtgcttgctaggcacatggtgaataccaaaaagtaatataaagatgtactttaagtttgttttaaactataaattataaaggaattctggtttcacaaaataataaatcagaagagaataatttttagaattaaaattaacataaattcatactaacatatggcatctgttactggatttgaagaattttcacagatcacatttataaggtacatttcaacaaatttataattcactgtcataaagcaacttgagtaagctcagggttaaaaaggtggaagggtaggatcaaaattctaggtagcatttatgatttgtggtaggttagcagagagttaagtacatgtaagtaccacagtgaagagcaaaaatggctaatagcttacaactgtgtaccaagtatagttcagagttctttttatgtatttctttattaatcttaaaacatccctattgatatcataattgtacaattgaagaaaattacacaaagtgagaaaatctaatttgccaagggccatgtgtatatacatgtatatatacacataaagtaagtggcaaagctgtcctcaatctaggtagcttaaccacaaagccaccctctcaacctctgtatgcctctgtatgctgtttccaggaccttccagatgccaaaatccatggattctgaagtcttttatataagatggtgtaatatttgcttataacctacatgcatcctactgtatacttgaaatcatctctaggttaattacaatgcctcatacaatgtaaattctacgaagatagtttttatactgcattttttagggaataatgatgagaaaaaaaagtctttacatgtttagcacagacacaaccattccttttttttctgaatattttcaacctgtggttgactgaatccacagatgtggaacctgcagataccaagggctgactgtacctaaatggcctgtacaaagagcaataagtcatcattcaatatcaaaagtggtaaggaatcaggaaaacaaagatacattgcaaagaccaaagtagtgaatctaaccaaagaccaggaatagtttaggaatcaggaattcaagaatcaagctaggtggagcaatagcagctacaattagtgaagagagagacgggtactgatgcaaagcaccctcacatgtgtttttccagagcaaatcatggcttataagtggtgtgagtaatgtgcatagggaaatgggctccagatggctggaaagtcagaacaagtttgatactgatcttgaaggaagtgtcagctactggtaatcttttgcttttttttttttttttttttaaggcagacctttgctctacggcccaggctggagtgcagtggtgcgatctcggctcactgcaacctccgcctcctgggttcaagtgattctcatgcctcagcctcattctcatcccagcctgtaatctaggagctgggattacaggcatgtaccaccacaccaggccaatttttgcatttttagtagagacagggtttcatcatgttactccgactggtctcaaactactgacctcaagtgatccacccacctcggcctctcaaagtgctgggattacaggcatacgccaccacactgagccagctactggtaattttgacactagttggtaagctgttagcgctctccaactttaacaaacagattcaaacctcgtctcaattactgttgtgctggataattcttgaatagatcacattgtcttgtgcaacagttccttctaaaacacctttgagatggcttaacaacttatactgggaaaaaagtggtggacagtgtgtttagaatcagaactaaaaaatgctcaattgattctgtaagtccttccacctgtaaatctgagtatgaattggaactttcaggaatccacctggtatgaatgtaaactattactttaaattggaactgaaaatttcaattgtaggctcgatgtaagaatagtgagtttactgcctttgaaactcacccatgtctccatttgcaactggatatattttctctttgaaattctcttcaatcactctccagtcctgaatagcagcatcagtaattgtgtcaacagacatgatcattttatgatctgagaaagctggactgacaaatgcatcgccacttgaaatctaacctaaagatagaaacctgcattgtagagcagaaggctaagctgtacttacataacagcagcaacacttacaacctgtgctgcctttgctttattttttaaaggcatgaccgattttctatttcagatgacagaatattaaaatgttgggcagtgatgttttcaaatccacataatttttagtctatatcagtgataatataagtcactgattttttaaccggaagtcaggttagcagcaagatttctaattataactcattgctaatatttcatatggcttataaaacctatgaataacattgatttatgtaatggaaactcagaaaagaatagagaaaattatataaaaattactgtattcttggatcagaaattctagaaagatgtttgtttatattttgagatttcaagcagcaggggggaatgcttttagtcagccttctattgttatctataaaagagtgaataaataaataaaaatctctgcatagagatgaaatgaaccagcaaaataccaaaggaaactaacaccacagataagatttactgatcaaaattcactgtttttgtgtaggaacacagcatggtaaataggccttatataataaatacattattttctataacagatttctccaagaagacccaaaatgctataaagcagcactgcaataattctataaatatcattttgaagtactagcattccaatttcaagaaataattaaacaattctgaagttgatgacatttaggaatgggataaggacagtattgctattcaatagaaatgaatcaaatgcatatttatcaagttggctaaataggaatgctaagaaaatatacacataaatgataatcctttaagtaatttcattattatagcagcccatgaaatcatgtgagctttttcaatcctctctttaatttgaacttattgtaaacatttgacgttcaatactagaaatcagatcttttatctaagacttgattagtcagctttacttccttgtgacagacacactacatggtctactaatcctatcagctgtccacacattgaaatatatattcctgctcaaatctttatttcactcaggttaaccataattgccattattggcaccttttgtcttgtacttcctcagaaaaaacagctacgaaagtagtaaaataggccaggcgcagtggctcacacctgtagtcccagcactttgggaggccaaggtgggcggatcacgaggtcaggagtttgagaccagcctggccaatatggtgaaaccgcatctccactaaaaatataaaaattagccgggcgtggtggctcgtgcctgtggtcctagctacttaggaggctgaggcagaagaattgcttgaacccagggcggaggttgcagtgagtcaagatcatgccaccacactccagcctgggcaacagagtgagactctgtttcaaaaaaaaaaggtagtaaaataaaaaccaatccaggatgctataccatattattaccaaaacaataacacaatggtctgatcaacagcagcagctatagattctccctcatttaaacttgaattatcttttattttatttatttttttattatttatttatttaattattattatactttaagttttagggtacatgtgcacaacgtgcaggtttgttacatatgtatacatgtgccatgttggtgtgctgcacccattaactggtcatttagcattaggtatatctcctaatgttatccctcccccctccccccaccccacaacagtccccagtgtgtgatgttccccttcctgtgtccatgtgttctcattgttcaattcccacctatgagtgagaacatgcggtgtttggtttttttgtccttgcgatagttcgctgagaatgagttcatgtcctttgtagagacatggatgaaactggaaaccattttatttatttaaaaattatatttattcatttctttcattttaagatgggaatgtgaatatagggcattttcttttaagattaataaataacatctaattgacacagtcttagaaaacattattcccctataccctgatatctgaaaatataattcagagggtgaatataaaaaattagacatgataaaaccataaactgctaagctggatgggtcattaaaaagagtgaactaaagtggagagagataaagtgtcttgctgtccaaagctttatgtaggagtatttggggaaaacactagataaagataaatcacaaaagatttacttgcatcaaaggcatcaccaaaaccttgtaattttctgtgataataggaatgtgtacactcccagtttatttcaaactgtttggtatgggtaacagaatggctggttggcttcccagttagtttttgagtcttaattaacaagggagtcctgggatcaggaatgtctattatattgaggttcaaagaaatgcaatactaagtgtttattgttgaagaaatgctcagttaatgtaaattaaataagaagtttcaatgtggaatataatctaagaatctaaatttaaacatgaaattcaggtacaatttattttaaaaataagcgaaggttgcccggcgtggtggctcacgcctgtaatcccagcactttgggaggccaaagggggcagatcacctgaggttgggagttcgagaccagcctgaccaacatggagaaaccctgttgctactgaaacatacaaaaaagttagccggtgtggtggcatatgcctgtaatcccagctacttgggaggctgaggcaggagaaccgcttgaacccaggaggcagatattgcggtgagccgagaccataccactgcactccagcctgggcaacaagagcaaaactccatctcaaataaataaataagcaaaggttttaaataaacaagctctaaatgtcaaaaagatgacccaaagatttactaaagaaatatatggttaactaattattataacaaatgtatccaagctgtttccgtactgcccattgtacaatatgtggatatgatgtttgaaagcttagaagcctgttataatgaacgtagtaatcgcatgccccttagcacttacgtgtgcttcctcatgttacactgcacttaggcatctggccttgtataatacacaggcataacattctacccctcggtgatttacggcatcaacagtaattttaaattcttgatattttgaaacattcttcttaagttctcttttataatatcaaaacttctacttgccctgtggtttttttttaaaaaaaaaacatatttaatcaaaaatattcattatttctcatgtcaacagtgcaaatactaagaaattgtagtgtaacagaatgttgagtaggatttttcctttacctggaaatccaggtaaatcctaaagctgaaaggtctgggaagagcttcccaaaaactacctttactttacattctaagaggagtcagagagccatcctgaaggccaaccaagacatgccagaggcagccctacttgagcaagttcccatccactcttcctcttaaatctcattttttagggagaaaactgagagggaagggctcaagggcatcaagctgtggcttgtcagcctctgggaaagagccatgtttaggggagtggctttggctctttccctcaaaaggacagttctccaactgaaccacttgtggagactgctggtagctgcataaaaagatatcctaggtggatatttgctgaccaacaaaacctacaggtatacttggggctaccacaacagagaaggatggtaagatagtttattttagaacttcctgatgcatgaaatttattgatttctcacatgtgtgaaagtgtacattaacagagaaagtgcttatcgctagaaatttctaaaggctgcagaatttctggagaactctaaaccagtggtataaaaattataatagagtttcatcaggtccaaggcaaaaagttagggtgatggttatggttatatttaggtctagtagatggctaccagaaccctttggagatgaggaagagaaattagcagtttgggtggtcccacctccatgtgaaaaagaaatgaaagtcagatgatgggcaggtgccctagtcttttctagcagccactgggcaatgagacatctttcctagcaaaagtgttttaattgggggttttgatcaatagcaagggccaagagatgataggcctgctgttttctgaagggctcctcatcaaagaagatgctagttgaagctgaactcaactcaaggaagcaaagcacactactgatttggaaaccacctgtcagccatggttaccagcatatggaaccagactgaaccagagtgaagtcaaagatatttccccattgcaactgatgccaatgaaataaaataaattataagagattgctaaaagcaattatattcagataaaccagataatctaaaagaaatggaaaaaaaacactagaaaaaacttaccaagactgaatcattaagaaatatgaagtctgaacatacctttaattagtgtggagattaaaccagtaataaaaaatgtccctacaaagaaaagtgcaggaccagatggcttaactgctgaattacaccaaatatttaaagatttaatgccaacccttctcaaactattccaaaaaaactgaagaggagagaacacttccaaactaattttttgaggccagcattaccctcataccaaagccaaatacaacaaaggaaaagaaagctaaaagccaatattcctgatgagtatagaagcaaaattctcaacaaaatacaagcaaatcaaatccaatagcacattaaaaggatcatacaccatggccaattgggatttatccctgagttgcaaggatggcaacatatgaaaatcaattaatcattaataaaggataaaaattccataatcatccaaatagaagcagaaaggcatttgatgaaattcaaccacaattccatataaaaactgacaagaaactaggactagaaggaaaatacctcaacataataaagaccacatatgaaaagcctacaggtaacatcacactcagtggtgaaaagttgaaagatcgggacaaaggcaaggatgcctactcttagcacttctattcaacgtggtaatggaagtcccagccagggcaattagacaagaaaagaaagtaaaaggtatccaaattggaaagaagcaaaattgtccctgtttgcagatgacatcattttatgtatagaaaactctaaagactcaattattaaaaaaacaaaacaaaacactgttagaacaaacaaattcaatagagttaaatgatacaaaatcaacataaaaatcaattgtattgctatgtattaatgacaaactatctgaaaaaattgggaaaacagtctcacttacaatagcatcacaaataataaaaatacctagaaataagcctaaggagatgaaagacttatatactgaaaattaaagaatattgatgaaagaaattaaagacacaaacaaatggaaagacatcctgtatttatggattagaaggcttaatattgtgaaaatgccagactactcaaagtgatctacagattctatgcaatccctatcaaaatcccaaagaaatttcatagaagtagaaaaaatcctaaaatttatattaaactataaaagaacccaaatagcaaagcaattttgagcaagaagaacacagcaggaggcatctcccttcctgatttcaaaatatattacaaagctacaaaaatcaaaatgataaggtactggtataaatacagacatataagccaatagaacagaatagagaccccagaaataaatctgtgaatatttggtcaaatgatcttcagtgaggatgccaagaatatacaatggggaaaggacagtcttttcaacaaatagtgttgggaaaactagatatccacatgcacaggaataaaactggcacttttattattgccatatgcaaaaatcaagtcaaaatggattaaagaactaaatgtaagacctgaaattataatattgctagaaaaaaataggagaaaatctccatgacattcatctaggcaatgatttgatgaatttgacatccaaagcattggcgaagaaaacaaaaataaacaagaggcactacatcaaccaaaaatcttctgcagagcaaagaaagcagtaaaatgacaatctatgaaatcagaaaacatacttgaaagtgatatatctgagaatgagttagttttcaaaattggtaagaaacttctacaactcaatagcaaaaaaactaacccaacttaaaatataggcagaatagttgaatacacatttatccaaagaagatctacaaatggacaatagctatgagaacaaatgctcaacattatttcctgatgatttgcataatcaggaaaatgcaaatcaaaatcacaatgaggtatcacctcacacctgtcagaatgactattatcaaaaaaacaaccaatgttggcaagcatatggagaaactggaacccttgcacactgttggtggaaatgaggaatggtgtagtcgctatggaatacagcatggaggttcctcaaaaggtaaaaatagaactaccccatgacccagcagtctcccttctgagtatttatccaaaagaattgaaatcagggtctcaaagagatattagtattcctatcttcaccacagtactgttcacaagagtcaagatgtggaaacaatctaaatgtttattggcagatgaacggaaaagaaaatgagatgcataaataccatgaaatattatttatcttttttaaagaggaaattccgcaatatgtgacaacataaacaaaccttaaggatattagctaaaggaaataagccagtaacagaaagacaaatactgcatgatctcactcctatgtggaatctaaagaagttggtctcatagaagttaagtttagaatggtggttaccacttatatgagtcgaatcatataataatcaaattcatagaatgagagtgggatggatgttgccagggaatgggggcaggaataaatgagaaattactcatcaacattttaaagtttcaattgagcaagatgaataagctctagagacctactggacaacattgtagctatagtcaacaataatgtattgtgcacttaaaaatttgttaaggggataaaaaatgatgagttcatgtcctttgtagggacatagatgaagctggaaaccatcattctcagcaaactatcacaaggacaaaaaaaccaaacaccgcattttctcactcataggtgggaattgaacaatgagaacacatggacacaggaaggggaacatcacacaccggggactgttgtggggtagggggaggggggagggatagcattaggagatatacctaatgtaaatgataagttaatgggtgcagcacacaaacatggcacatgcatacatatgtaacaaacctgcacgttgtgcacatgtaccctaaaacttaaataataaaaaatttgttaagagggtagatttcatgttaagtgtttttaattataatacaacagttttttaattgtgtatgcttttagtggtaaataaattagctctctggtgcaaaaaataaaataaaataaaaagatatttccccattactgataagcctccggttaggtaagaacttggtctcatgtataaatcctcattgctcccacccagctataaagagacaaaaataagatgttatatccagaaagagactatcaaccctggacccaccatcatccttgcccatgagtcctcattcatactttgattggacaaaataacatctctagtttacagtggaggatgtaaggggtaagcttcagagaggatatgaggattgctgtcctaaatgatggtgaattaattttaatagccaaaaattatcagaaagctatggaatctgcactcaactcttctacaggacagaaaaggaagaaataatatcttgtttatatctccaacaaattaaaattatttggtaaactagttaaaattataaaaagaaaagacatttgcctactgttttatattagttttagtgaggggctcaaagttggaaagaaaaacagaacagagataatgaggcaaagaaggaaggaagcttcaggagtgtgtatgtgcctcctctttacttagaccttcccaacatgaattcaatattctgtttaaagtgaacattcaagatatcaaacatatccatagttacgttaacagaaagaaaaatatatattccaaaactaaaatatttccacataagccattactttcatattttaaaactctattaacacaggtaattcggaactgatgtaagtctttaaaactaagttatttagggttacctgattagcatacaaaacatctgggtttctaggttacatttctccaagaaaactgcagagctcctccctctctctccctctgtctctcacctctgcagactattatttaaacttcatataattgggagttgagaagattttttaaatgactgactttgaagtaaatgattattcctaaatttatatgcagatcattaaactgataaaaagtactacaaaaatttatgttgtccttcattttcattataaatgaccacattaaagtttaaaaatattgatcaagctacaaaataaagggaatgattcttccataagattttgataatcttaaaattaaatcaaaacaaagggtgctgctagagcctatttggtgacttcagcattgtgacaattgtttgtagctctttaataagttggaaatcatttcaaagggatttgggatctagccaagatgaaacgtactgagcaactataaaatcactatcaaggttgatactactgcaaggaaaatcaaaaagaaaaaacaatcaggatacataatcctgaataaataaaccagagaagaacaatgcctttgtcaatcacctgctaaacagcagtgattcagccccatactctgaagacttttcaaaattccactctattatacttcttcaaattgttttctttccatttatgccccaaagtttagctgctccaatgaacacacaaaagatccacaactatctaacaagaaaaattttgtttctcctctcaaatcagtgggccatctaaagactgggtagtttcttactctagttttgttttgtattttacataatgtagtcacaagccaatgtttctctaatttgttccttaaaatgaagctggcaaaagtgccacataactattgtttgcacagaggtactttccaacctgggtatttaatgaccatgacaggctccatgtatccacatgtttgttcccccaagacatactgaacttcttcaaaaagaaacaaaaatgctgaaagtgaattttatttttaattatattctactacaggaagaaaacgacactttgtgtccacatcagagctgccagtcaaatactgacacaccagtaattctctagcagtgttagcacagagtcactaaaattggaatgaaaccacatggagaactcagggaggaagcgttctgtaggaactgttcatcagttttgctgtgacaatagaaggggccaagtggtttctctcagtaatgtgtggtaaagcgtgtcttttcccacatcctgccagcaatataaattatccaaaaatgcagtctcatccatttagaaagaaaatctactctattatcagctgcaaggtgttagaactctaagctgaatacagaaaggcaaattacaggcacctaagtcaatcctaggtctgccagtttttcacatctaaacaatatcattcttagacatcatcctttttaaattccagtccttaaaaatgcttggagttatcaacgagggcttgaagaacaacttatccccataagatgtaattttctttctccatagtcacctgaattgagtctattatttatccacatggatttcatgaccagaacattctgattttcactgtaactcttccctggctccagattacatcaagttttctaatttccttgattcttaaactaacttgatattttcttttgttgtctattgcctttttcttttccctagctacttccttctcatcttgtttattttcaatcaatactttgccctatgcccactctctatattacatattcatatgttctggccttctgtaatttcatttgtaatttcagttcacctgtacttccccactgggagacagtgtagaacagtgttggatgaaaaatccttgcataagtgagcatgaagtgggatatgggtcctagacatctgtcaggtaggatacttcttaaattataactttagggctcaaagcattaagccactccagctgcaatagcctacttcattgtatgaatataaaataaactagacattagaaattcaaaatatctcctgtactcctagacagcaatccacccactgacaagaagtctctaaagaagtttttataagtggtaacaatgaataattttgcactagtcccatcacccatttattggaaggttgaagacttattgaaaaacatcttcctttacctgtatgccactgacactaaattataaaactactaaaaatttcaggagcattctctggcattccccccattacccctacccataggaattaccatgacacttcccctggctactccagctcaggaaaaccagacttgggaaagagcaacaacacaatccaagactctttctgaaaataggtgtctagttgattcacatcttctttcataaataccccaaaaagttgagatccccaaaccttggcttttcagaacatatattcagaatgtcagcagaatgagttgtgatgatattcaaataccatttctgtgatgtttgtcactttttttctaaatctaattgtctgcataaccaacaggcaactaccctcttcataaatgaggcaacattgcatgaggtcactttcaaaccacactgacacagctggcctaggacctggctcatgacttgctgttcatcgctccagagcccttctcagtctaagtatgcaagagagaataaagtcattagagatcatgtaattatacaaaatgtaaaggaaatcattactaatacaagaaatttttaataaatatcagaaatataaagtagaagtccataggttgatagataaaaataagtagaaaattcacaaactgaaatatactgcaagacagcttcaattacaatctattttcccaaagggaaccccatggagacacagcacacagagataggaagtaatttagattttatgagatttaaatgagattaaatactgtactgaaaataaagagtctaactacagagccattgatgatctatatacaggacaaggatgggagacccatcccactcaactggcatttacccctgggcaagaaaccagagggctcttctttaagaaaatgaacaaaattctgggaatagtaagatttctagtgtgtgtgctggcccttcccataggaacaaatatcctctttgcctgccaacaagtatttcccactctcctttgatctgcatagagtctgaatccctgggctgccttccccttcagatcagaaatctagggcaaaaacaagtcaatcgtttttcatagcagcagaggagaccaattccaaatatacaggattttttttttttttttgagatggagtctcaccctgtcacccaggctggaatgcaatggcatgatctcggctcactgcaacctctgcctcctgggtaaaagtgatactcctgcctcagcctcccgagtagctgggattacagatgcatgccaccatgcctggttaattttttctatctttagtacagatggggtttcaccatgttgggccaggctggtctcgaactcctgacctcgtgatcctcctgcctcgacctcccaaagtgctgggattacaggcataagccaccacacctggccccaggaatgtcttaaaccatgtaccaccacatagcaggagaggacagaagataaaacgaaactctctggtcttggaagacactgaattattccaaagaaggaaaatgaacttttaaaagttataagtaatatagagactagagaggaaaatacaaccatacatacaaacataaaggataaaattgagaacatgtagaatgcataaagcaaaaagataaatatgagagacagtgttagcaagataaaggatcatcccacagagtattatttggttaagagaattccaaaaaataaagaccagagaagatttgtatggtataatatctataaaataatacaaagaaatattccaatgctgatagatagacatgaatgtctacatgacaacatccgatggctgctctgcacagggaatgctggaggatgccaagttacccctagtttcctacaaaggtatttgacttattattgacaatactaggtactaaaaataacaaagtaatacctttaaagttctgatggaaaattttctattattgtttccaaatccaacaaaactatcaattgaaatgtaagccagaataaagctatctataagacattttctgaggtaacttccttcctttgcacctatcctgggaatttcttttaggatgcactccaaacatgcagaagtaaactaagaaggaggaaaacctggaatccatgaaatgatattccatcccagaatggtagagaaaggagagaaagagggtagtttcatggtaaactaaaaagcaaccagcaaagctgaaaacaaggagacacagaggtacagaagtgacatcctaagggggttgaatgaagacccacaaagataatgaagacagagaaagacacagagagaatgcataaccacaaacggtgcaagaaaaactaaaagaatgatgattggaaacaacattaaaattttttaaatctaaatataaagcaagtaaaaatgcattagaacgttaagcgatagactgaatataagagaagacaattcaggtgaccttgatgccagcaacatcctcttttaaatggccccaggtttatggtgtcagatattttgaagtgggaaatggaatcttagtccagaacttaaataatgtttacacagtcatcataatgtaaatgtttgttttctcctattagagtcaacccaggaacaaagaaaaagaaaattttattattctcacaggatagaatgccagtgttcacaatgggatgatgtaaaagtgtggctcaaaacaaacaaacaaaaaataagttgtatatgtgagaagaaatagtagagcaaagtatatatattttagcattttttaatgaaacagggagtcaagatatatgtcaaaaagctgtaaccaaaaatagaggattaagtatacttttctggggccacaaaatttactagaagaaaaatcagaatctcaaaaatatacaaagcaagctttggggagggaagagggtataaaagacagcaaaagtaaacaaattcttacctttatttcattttatttattttttaattttttttttttgagacagagtctcactctatcactgagactagaattcagtggcattatctcggctcattgcaacgtccgcctcccgggttcaagtgattctccttcctcagcctctcaagtagcttggactacagggagtgtgccaccatgcctggctaatttttgaatttttagtagagacagggtttcaccatgttgctcaggctggtctcaaactcctgagagtcaggtgatccatccaccttggcttcccaaagtgctgggattacaggcatgagccaccatgcccatcctcaaattccaacctttcttatcacattctcagaaaataacctaatagatgaagaagttgaggtataatacttgtagttattaacaaaaatactgcaaacaattcaaaaaggttgcctctctaaggaggtccaaaggtctggagaagtgaaatcagatattcttgcttttgacttaaagcaatcttctaaaataaaaacttcaaaagaaattaagaagtaaaacttaaaacaccattttaaatgacactgttaccatcacccacctaccctggagaagaaatgcacatttctggcttcagccaatgaggcttgttcaatgttccaacactgaaccatagctattggtttaataaatataccattacatcaaaaccattactatagttactggcagaacattgaactcctcatcaatgtgggagataagcaactccactgattttggctggaatataatacagctcttagataaccttagagagttccagcatgactgactgcaggcttggcaagcagtccagtaagtctgtaaacagagactaaagggatattaaaaaagaatgtgatgaatttggaaaaccatgtattcatcataacacattccaatgctggatgtgtcatctctaaggagttagggattttcccacctattatacggtcagtgatgaagctacatcttcaggactgaggtttgaaatcttactacctgaatcttcagatgtgttttccaactctctcttcactttgctttttttctacagagttaagtctttgagtgctttgtgatctgaaatcccccaaggcaactaacattccacttctttttcattttctttttaattagacactcacagaatacactgtactattttttttagaaacaggctccttttaattttttttagactgttttgcagactggccccaagactacatctactatctgataccattgatcgacctgactgttaaggtgtggactcagcacttcctgtgaagaggttccctgatgaatactgactctattaggcaagggtagtataacatgactcacagtcttctgtcagccctattgaattccaagctctgtctcagaactggctcgaattctctggtgattccttttccctcagttaactttgagcaaccatatactataagggtagacaacagatcctctagggcaggggttcccagcccccaggccatagactggtaccggtttgtggcctgttaggaactgggctgcgtagcaggaggtgagcagcacaagcattactgcctgagttctgcctcctgtcagatcggcacaggcatcagattctcataggagtgtgagccctattgtgaactgagcatgcaagggatctaggatgcatacttgttatgagaatctaatgcctgatgatatgtcactgtctcccatcacccccagatggaactctgtagttgcaggaaaataagctcagggctcccactgattctacattatggtgagttgtataattatttcattatatattacaatgtattataataataatagaaataaagcacataataaatgtaatgcacttaaatcatcctgaaaccatccctctcaccccaagtccatggaaaaactgtcttctatgaaaccagtccctggtcccaaaaatgttggggaccgctgctatagggaataaaataaaatctgctacttgactcatgagttgtatctttgaacttaaggtaagaaaaaaaatttaaccaaaccaacataattgaataatcagatgtcaatgtggaactcagaaacattatccttgtttacatacacactgttttttgaaattgtaagcctgtgatactctcgcatttgtgagatgccaacccctaaaaaaaaattgtatttcctaaggcagtataatgagttttgctttctttcttatatttgtgtctctcttattttgagaacttaacttccaagtgcaatttttggtcttgaacccaaatatatttctctcatcacccaattattagctctcatccactcttctcccagaatggttactaacaagaaacatgatggaggctgatggaggcaaccactgtgtaatgcaaacagctttagtattggtcaaatgctatagctggagagtcatgagtaagccctttctagtctctgagctttggtttcctcatctgtaaatatgtttaacatctgcaaagtcaatgccccatgtagacagggcccagcattatgtaatatttaaaaactaaattctcaccaacattttgagaagtgattaaaatatttcttgatgtcactcacaaatggcaaaagaagactcaattcacagcacagagcaaacaaaaagtcattttccccaactttttgtattgttctgttttggttttttgttttgttttttgaggcagggtctcactctgtcacccaggttggagtgcagcgatgtgatctccacccactgcaacctccacctcctggcctcaagtgatcctcccacctcagtcccccaagtaactggaactacatgcacaagccaccatgcccagataatttttgtattttttgtagagacagggtttcaccatgttgcccagtctgatctcaaactcctgaggtgaagcgattcatccatctcggcctcccaaagtgcttggattagaggcataaaccaccacacccggcccccagcttttaatatctctaatacttgcaactatccttaaatctctttcttctgttaaacctctacagaaatcctctatcagcccacactgactgactctcatctctttttctctcttcccacctttttggtattttcattttctattccttaaaatgtcagtgaggatcctgagctcctgagttttattcctcaaaatgtcaatgagctccagtctgactgcaaaggtgggtatttctctcttcactatcaaagtctaattataaaccagacttacacttacagcccccattgactctgttgtatcctttctaggtcagtgaggtggtcttcttgtcttcttcaaaagcacaggttgtgcaagcttttgactccaggaaaacatcctaaagccaaaccatgtaatcattcatttcactaccaacccaatggctccaaagcttatcgtagctgtcctgtttcagtgggaaattttatccataactcacagtcctatttttccaaacttggccatcaattccttaaattcttaggagtactggtggtttctaagtctaaccataggataaaaccacagtcaggagagcagaggtttaggttatcacccaatctaggcatgggtgccacatctccttcctccatcctgaatggtatctcgtttcttaacatagctgacatcttgggagataaagttgaaaagccaatttccaatctgcagttacctaaaggaacttcctagaagtcttgatttagtgtaatcatttaacactaactttaaaaataatccatttagtaatccaataccaaatagtagattatcaccccaaagggctactcttaatctcagagtagtaacaaaatttccctctaactttagtataatatttcaaggacaacgaaatacaaatttctgtgaaatttccaaagtgtaaaacactatgaagttctactctaatatatgtcctagatgatgatttactccaaaaaaaaaaagtagatgtgacattttacattccagtactgtaaccacagaaaactcagctgcctcatggaactataacataatgtctaaacatcaaaaactaattcgaaagcaacttaagtattaattgaaatttctcagcaatgccaaaagataaatctctatgtaacccaatgcaatttcttaaaagcctttttgtaccctcttgagcatgctttctccgtggaaggcctctcaattcaaagcattttttttctctctctctcctcgcctcttttaatgtgtatctttctcattttgcagctgccccaaagactctctttcttctttcataactcttaaaatctcccaccaaacccaacccatgcttctttctctattccctccttttcatctcctaatctattcatttccttctcttatgtttttagtgtaaatcaatcaaactgatttcaatgattcctgactctccctctcattcatcagtctgattatgggcagcaaagatgtttctttttaaagagaagactaaagtgagaaactcttactagtcttatatccatatttttcctgttacatataaaaagcaatacccatcataatgggttgattggaaactctatgaaattatgtatttacatatatttctgacatgtaggttttttaaagaatttttggttaaagtaataaaaatagtaagatggaaaacaggatacaatttgtcctctctggatacagctgttcagtctccctatcccatttccacttagcatcctaaagatcgaatggaaataacagaaaagagaaggataaaagatggcagaaaggagattagtagtttatgtgaggaaggagcaagtggtgtggagaagaatacagtttgacttagtgtgtctgctagctccatgagctgagctgtgcatttgccaggtggtgaggagggcagaggcagccacaaagctcccgaacagctgttcctttctcttcttccactcaacatttagagagtctgggcagtttaggggcagccactaagggagcagcagcagatggctgtcatgctgcagaggtgtactctagaaggatgaggggctccagttacaaaaagcagctatcttttatgtgctttaaagatatgtgctaaagtctacttgaaggctgtataaaggcacattaataaaaatcaccatttttaatttggtctttaattcagttctctaattttagtagtattttacattagatattagctatcggacaattattaaacttaaagaggaaaaaaaaagaacttaaaaaagacctatttttctcttcccatcctggcctcatccatttgaagcaagggtgacaaccttgttgtcataaccctacaaggaaatttttcacatttaacccacatttactgagaatctactctgtgtgccagtaatagtaccagactttttcatggccattatcttacgtaaagtaggtatgaaatggtatttttctaagtagaggtaaaggattctactcctcccactaaaaatacaaaataaaagaaaaagaaagacacaaaagttagagaaaacaaaatattagaagtttggttctgtttaaatgtatgcaaatccaattaggactaaatttacacttcaaaatatgtcaaaaattctctaacaggaaaaaaggacaaagttgaattttgttttctgttcttttcatgtgactttttgtgactggtattctttatacaaaatgactatggctcccataaataataaccaacaattctatagtattttgaagttttcaaagtattttcacataaaaaaattcttttgatctttaaaaactttctataaactaagaatctctatataataggaactttcgattcacatatgaggaaagatttcagtgcagtaacatgctgactggaatcagcctcaacactggaatagtgacatttaataagtccatggcaggcaatagacctgacaagtaggctttgctctgatgcaggcagaacatgtcatcattgtccaactagttttataaagtttttatgagaagggaaaaagtagttggtattctaggaaaaggaatttttacttgcctttcttctagatcgcaccaggagtgtccataatttgtcaactgaaataaagctcagccccagtgtcttctaaatttgtccactaactcattcacctatgcaaaattgtggcatttaaggaattagtaaaaactaattaacttaaataagatatttatttaatactctgttaatcaatgttatagaaaaggttactaagtaaattttgaaatgatatatctcccttaaaaggtccctaaattccttaaaatgagatcagataaatattaaggaaatattacagaataaatcaggatatttggtaaaaagaaaacgtgcttatcccatatgaaaaaaaaaagttgtggttagaacaaattagtatttttaaatttttttcagtaagttataaattaaatacatgcctattcactaataattcaaatggccaaagagcactgttaaatgatggttttctctgagggccatctttttatagacattgatacagttaatcttcctaatgtccagctggcatcaggttatttccttagagtagtgactgataatagttatcggataaaagccatgttccaagttgaaatccaaactccaaaattttctttttaaataggacttctatgatttctcttcttagtccctctgtttttcatgaaaattccaagactccctctttttgcctttgtgcaatccattctctacccctggtatttcctatcttcatgtcccttgtccagaatagtctagatccatctagcttaaatgtgatcttcttcttaaggctttcttctttttcctaaaatctctttcttctgcattctcgtctacttaagattgatcatgagctccaccatctcctggtctcccatatccaatcagtcatcaacttctgcctgatttccatttatcggtattcctgaaagcacgaacattggcatcagatatatatgcttttgaattttagctatgtctccactagctgaatgaacttaaataagcaacttattgttaatcatagtttcctcttctataaaatggtcattcaaagagtacctaattcacagaattatagtaaagatcaaacgagttaataaatatgtaattcaacttagatggaaaattcaatggaagccaacatttctcaaagtaggtttaaggaatattggttccataaatattcttcaaataaaaaggaattcgtagttaaaacaacttattaaaaagtatacctaatacccacttctctgtcagtcatgaagtatattagcacattaaagtctccaagaggtcttaaaaaaatagaaaaaaaaacaattatcctaacattccctaaacttatttgaccaggaagcctttttatgcatatatagtagctacttaaaagcctgcagaaccagtgttctgaggaaggctttgagaaaatgcttacctggacaagaaccacagctatcatcttgaaagttatttcagccttaggttttcaatttttagaaaaaaataaaaaataaaaaataaaaacattgtgaaagagaccatctcctaatgttcagagtcattagaaattctcagaaaatgaataaaattctgccctttgggaagatatgcccaaaagggtagcagaatggtattagctttccaaggccaattacttcttaacaatctcttaaaggatatgaaaaagttctatttttcatggaatgcccagtaattgcttatccagctggtagcagatgcaaaacttcatctcaggaggaaagcttaacgtacaaatttgtgaagacctgataaagagtgagaagaactctcaggagtctcaggaaatgaataagttcatgcctgtgatgaagacagaattgagacgtgatcactatacctgaggtctaatacatctaccttcaaacataaaactgtttactctatacaaataaaagggcaatacaggtacacctcacattacggtgcttttttttattgtacttcactgatagcatgtttttttgcaagttgaatgccgagcaagtctctcagcaccatttttcaaacagcatgtacccacttcatgtctctgtgtcacattttggtaattcttatatttcaagctttttcattattattatatctgttttggtgatctgtggtccgtgatctgttttgttactattgtaattgttttggagtgcaacagaactacacctatataagtcaacacagataactgataaatgttgtgtgttctgactgctcaatgaaccccctgttcccccatctctatacctctctttgggccttgatattccctaagaaacagtaatattgaaattaggccaactaccaacactacaatggcttctaattgttcaagtgaaagacatatctaactttaaatcacaagctagaaatgataatatttagtgaggaaggtatatcaaaagctgagacagataaaaattaggcctcttccaccaaatagttaaccaagttgtaaatgcaaagaaaagttattgaagaaaataaaaagttctactccagggaacacataaataataagaaagtaaaacagccttattgctgatatggagaaagttttagtggtctggatagaagaacaaaccatccacaacattcccttaaaccaaagcctaatccaaagcaaggtcctaattcttttaagtctatgaaagctggcagaggtgaagaagctgcataagaaaagctcgaagacagcagaggtttgttcatgagatttaaggaacaaagcaacctctataacataaaagggcaaggtgatgtagcaagtactcatatgggagctaaagcaagttatccaggcaatctagataagataatgaatgaaggtgtctacaacaatcaatagattttaaatggagaagaaacagccttctattggaagaaggggccatctaagacttccattgctagaaagaagtcaatgcctggcttcaagcttcaaaggagaatctgactctcttattagggcctaatgaagcaggtgactttaaatcgaatccaatgctcattgaacattctgaaaaacctagggccctttagaattatgctaaatctagttggcctgtgttgcataaatggaagtacaaagcctgttacccaggttctcactcaggctttgtagtttcatgtatgttggtttacaacatggtttactgaatattttaaacatatcattgggatgaacttctcataaaaaaagattccctttaaaatattactggtctttgacaaggtacttagtcaccccaaagctccagtggagatatatagagagatcaatgttgttttcatgcctgaatatacaacatccaatctgtaggccaaatatcaaggagtaatattgaatttcatgtcttattacttaagaaatgcacttcttgccaggagtggtggctcatgcctgtagtcccagcactttgggaggctaaggcgggtggatgacctgaggtcaggagtttgagaccagcctggccaacatggtgaaaccccatctctactaaaaatacaaaaattagctgagtgtggtcatgcgcgcctgtagtcccagctacttggaaggctgaggcaggaaaattgcttgaacccgggaaaggaggttgcagcaagccaagattgtaccattgcactcccagcccgggtgacaggagtgaaactctgtctcacacacacacacataaaataataaaaataaaaaaataagaaagaaaagaaaagtaatacatttcttaatgctgtagctgccatactgattcctctgacaggtctggagaaaatacattgaaaacttcctggaaaggcttcaccattctagatgccattgagaacattcaagattcattaaaagaggtcaaaatataaatattaacaagagtttggaagaagttgattccactctcatggatgactttgaggtgtttaatcttcagtggaggaagtaactgtagaagtgatagaaataccaagagaactagattagaattggagcctgaagatgtgactgaattgctacaatctcatgataaaacttgaacagatgagtaactgcttcctatgaatgagcaaaaaaagtggtttcttgagacagaatctactcctgctgacgatttggtgaacattgttgaaatgacaacaaaggatttcaaatattacataaacacagttgataaagcagcaatacagtttgagattcattccaatttcaaagtaagttctacagtaggtaaaatgttaccaaacagtatcatatgctgcagataaatctttcacgaaagagtccatttatatggcaaactcaatgttgtcttattttttaaaattgccacagcctccccaaccttcagcaactgtcaccctaattattagcagccatcaacacagaggcaagaccctctaccaacaaaaagattatgactcagtgaagactcagataattagcactttttaacaattattatttcaaaattaagatacgtgtttttttagatatattgccatggcacacttaatagactagagtatactgtaaagataactttttttttattttttgagacagagtctcacaccataacccaggctggagtgcagtggtgcaatctgggctcattgcaactccatctcctgggttcaagccattctcctgcctcagcctcctgagtacctagaattacaggcacacgccaccatgcccgactaattttggtatttttagtggagacagggactcaccttaatgtgcatgtctgacactaacctgtaatatctctgaggtatgcctataaatgtttgttgaccgattgtctcaatgttacaagctgaatgtaaccaaattttagatggcacagcagaaattccgaaatcatttaattttcttttcatgagaagcaaaataagactaccttacatttatagctcatttgtggtctgctcttctataaaccataaaaactcctaactttacaaacatagaacttaactcttctttcatcttcatcaaaaagtgcttttcaaacaattagcatttcccaaataacgtttgtcgtttccgcttaggcctgttttagtctacctaatagaataaatttagcttccctgtagcagagccctatttttaaaagcatcttttaatacatgctgctgtgagagcaaaaaaaaaaatcatagtcattttgaataatttttacatgtttattaaaacaatggtaagcaaaataagtggttattatatgctctcatgttagtcttagtattcataagctaaaagcactcatccttctttaaaataaataacccaattgaaaataaaatgttattaatcatataaagaagatctctgaattcttaaacactgtgaattcttaaacactgtgagtatagcatcgcttctatttatacaaataaatgaaaccacaaacttattagagtaccttttaactataaaaataaatagataagcagaaaaatacattctaacctaattttcaatatctgaaataaataattagagaatatataaggaagaaattttggtgaataactgtagcaaattcctaattctatgaatatggaaattgaggcactacatattaaacaataaggcataaacccatctgagtattagtgagaattaaaaacacatctcctaatttccagttatgcttttcgtatcatcacaatcttcataaggtttgtccattaagttcatttgtgccttaaacaacacgaaatccacccgttacacattttatggatactatttataaaaatcagccaattcttcaataaactaacattagaaacaggataattagttgcctgagtttaaaaaattgaacgcaaatcaataaacataatcccgcatataaacagaatcaacaacaaaaaccacatgattatctcaatagacacagaaaatgcctttgaaaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactccttttcaacatagtgttggaagttatggccagggtaatcaggcaggagaaagaaataaagggtattcaattaggaaaagaggaagtcaaattgtccctgtttgtagatgacatgattgtgtatttagaaaaccccattgtctcagcccaaaatctccttaagctgataagcaacctcagcaaagtctcaggatacaaaatcaatgtgcaaaaatcacaagcattctcatataccaataacagacaaacagagagccaaatcatgaatggactcccattcacaactgcttcaaagagaataaaatacctaggaatccaacttacaagggatgtgaaggaactcttcaaggagaactacaaaccactgctcaacgaaaaaaaagtggatacaaacaaatggaagaacattccatgctcatggataggaaaaatcaatatcatgaaaatggccatactgcccaaggtaatttatagatttaatgccatctccatcaagctaccaatgactttcttcacagaattggaaaaaatactttaaagttcatatgaaccaaaaaagagcctgcattgccaagacaatcctaagccaaaagaacaaagctggaggcatcatgctacctgacttcaaactatactacaaggctatagtaaccaaaacagcatggtactggtaccaaaacagagatacagaccaatggaacagaacagagccctcagaaataataaccacacatctacaaccatctgatctttgacaaacctgacaaaaacaagaaatggggaaaggattccctatttaataaatggtgctgggaaaactggatagccatatgtagaaagctcaaactggatcccttccttataccttatacaaaaattaaatcaagatggattaaaggttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagggcttctgcacagcaaaagaaactaccatcagagtgaacaggcaacctacagaataggagaaaatttttgcaatctactcatctgacaaagggctaatatccagaatctacaaagaactcaaacaaatttacaaaaaaaaaccaagcccatcaaaaactgggtgaaggatatgaacagatacatctcaaaagaacacatttatgcagcccacagacacaggaaaaaatgctcatcatcactggtcatcagagaaatgcaaatcaaaaccacaatgagataccatctcacaccagttagaaaggcaatcattaaaaagtcaggaaacaacaggtgatggagaggatgtggagaaataggaacacctttacactgttggtgggactgtaaactagttcaaccattgtggaagtcagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaatccaaatgtccatcaatgatagactggattaagaaaatgtggcacatatacaccatggaatactatgcagccataaaaaaggatgagttcatgttctttgtagggacagggatgaagctggaaaccatcattttcagcaaactatcgcagggacaaaaaaaccaaacaccgcatattctcactcataggtgggaattgaacaatgagaacacttggacacaggaaggggaacatgacacaccgggcctgtcatgggatgggcggggggagggatagccttaggagatatacctaatgtaaatgacgagttaatgggtgcagcacaccaacatggcacatgtatacatatataacaaacctgcatgttgtgcacatgtgccctagaacttaaagtatcataaaaaaaagaaaaaaaagtaatgtgaagtatgaaaaataatatctgaagagtttactaaatttatgtaattaaaaatcccaagattaaaaaaaaaaaaagaaaaagaaagaacagtcactaagtttaaagtatgttcttagtaggggatttatatagcatatgacaactgcggtctcctctgattcccttcagaaaaatctcacaaagatgttgggtcagcagtctcaaggacaatgtaatggcttcatctagaactcatatctgatttttgaatctaatgaaataacctgaatgtaaaaaaacatatgtacccatggctctgacagctagaaaagcagtcaaatgagaactagttacaggcaagtctagaagagtattagaataacttaagaaagacagagcagagacaattttaatgaagtcttggatactcagtaagagtttggttctagtgccatagacagtataatgttgatagaaagttgaaaagtgttttgatttgcctttctctgatgattacctgttggtgggggtataaattatttcacccagtgtgaaaagcagtttgcagaattctcaaagaactaagagttgaactaccattcgacccagcaatctcattactggacatatgcccaaaggaaaataaatcattctaccaaaaagacatatgcactcatatgcatatcacagagctattcacaaaagcaaagacgtgacatcaacccagatgcccatcagtggtgaactggataaagaaaatgtgacacataggatttatgggggaaaatggcagatgggaggcaggactaaattgcagctcccactcagacaggcagagcagcatgtggagatacatcatgaacttttcctgaaagaactactggaggaacataccaggaaagccaaaagaatccacagaccctttgaaggaagcagattgctcctgcaggacccaggagacagcccaaatactatgagtgcccaaagtatgaaagtgggaaagggtgaacacacaccctcactggggaactcgaaggtccaggttatgggagaaggatttgaccctacctagaactgagacaatttagagagccaagtgaaatacaggagtagaggaagtgccagaagagccctgtgggctctctcggtccccagggaagccatttctgactttgtctcacagggatccttggggagggttgccagtggaactgggaaaagaccacagataaaaagaaacctcaagctgaactttgtaacaattccaaccaaacatgcaaaatttcttggacagaacttgggggagagagtgaatccagagtgcagacacaggcaggcaaggaggtatgaaacctgaaagtcctgcttgctttctcagctgggaggctggtagcctggggcaagttcttagccctgcttgcccactgcctaaaaacaaactcagtgctattgcggggaggcacagtgagagtgagactggccttttggattgcatgggagccgggtgaggcctgtaactgtcggctgtcccccacttccctggcaacctacatgacacagcagaggcagccataatcctactggtaacgtaactccattgacccgggaaccacaaacccatcccccacagcagctgcagcaagccctgcccaaggagaatcagctcagacatgtctaaccctgccccaacttgatggtatttctctacccaccctggtagctgaagacaaagatcagattctcttgggagttctagggctccagccactgcctgatcttccctatactaccacggctcatgctctcttgaaagtgccacctcctggcaagaggccaatcagcacaaaactagtgcaataaacaacaataatacaactacgggccctcacagaatgcatttcactcccctgccacctccactggagcaggtgctgctatccatgactaagagacagaaagatggttcacatcacagaactctgtgcagacaccccctagtaggtaagtactacatcaagggagcaccccatgggacaaaacagtctgaacagaagcccttgagccccagatcttccctctgacatagcctacacaaatgtaaaagaaccagaaaatcacttctggtaatgacaaaacaaggttgtttagcaccctcaaaatatcacactagctcaccagtaatggatccaaagcatgaagaaagtcttgatatgccagaaaaagaattcagaaggccaattattaagctaattaaggaggcagcagagaaaggtgaagtccaatttcatgaaataaaaaaaaaaaatgatagacggtataagggaaaaatcttcagtgaaattgatagcataaataaaaatatcacaatttctggaaatcaaggacacatttatagaaaagcaaaatgcactgaaagtctcagcaatagaattgaacaagcagaagaaagaacttcagagctcaaagacaaggtttttgaaataatccaattcaacaaagacaaagaaaaaaagaatttaaaaaaatgaacaaagcctgcaagaagtttgggattatgttaaatgaccaaacctaagaataattggtattcctgaagaaatctaaaggtttggaaaacatatatgggagaataatcgaggaaaacttccccagtcttgatagagatctagacattcaaatacaagaagctcaaagaacacctgggaaattcatcataaaaagattatcacctatacacattgtcatcaggttgtctacagttaagatgaaggaagaatcttaaaagctgtgaggcaaaagtgccatgtaacctgtaaaggaaaacctatcagattaacagcagttttctcagcagaaaccctccacactagaagagattggggccctatcttcagcctacttaaacaaaacaattatcagccaataattttgtatccagtgaaactaagcttaataaataaaggaaagatacaatatttttcaacaaacaaatgctgagagaatataccactaccaagccagcactgtaagaactactaaaaggtgctctaaatcttgaaacaaatccttgaaattcatcaaaacagaacatccttaaagcataaatttcacaggaccaataaaacaacaacaccataaattttttttttaaaaaaaggtatttaggcaacaaatagcacaatgaatagcacctcacatctcaataccaacattgaatgtaaatgacttaaaaactccacttaagagatacagaatggcagaatggataataattcaccaactaagtatctgctgccttcaagagactcacctaaaacataagaactcacataagcttaagataaagaggtggaaaaagacattccatgtaaatggaaaccaaaagagagcagatagtcattcttacatcagacaaaacaaactttaaagcaacagcagttaaaaaagacaaagagggacataatacaatgataagaggccttgtataacagaaaagtatcacaatcctaaatatatatacacctaacactggagcttccaaatttataaaatgattactactagacctaagaaatgagatagacagcaacacattaatagtgggggacttcaatactccactgacagcattagagaggtcatcaagacagaaagtcaacaaagaaacaatggatttaaactataccctagaacaaatggacttaacagatatttacagaacattcaaagataaatttaaaaatttcttgagacaaacaaaaatgaacatacaacatacccaaacctgtgggatacaacagaaacagttccaagaggaaagttcatagcaataaatgcttgcatcaaaaaagaccagtctaaggtaaacaacctaactttgtaccttaaggaactagaaaaataagaacaaactaagctcaaagttagtagaaggaaggaaaaaaaaaagatcatcacagaaataaataaaatagatattagaaactcactagaaaagatcaacaaaactaagagttggtttctggaaaagattaacaaatttgacaaaacttaaagagacacagataaataaaatcataaatgaaaaaggagacattacaactgatacatcagaaacacaaaagattgtgagggtacaatgaacaattacgtgcaaacaaatagaaaaactcagaaaaaaatgggtaaattccttgatgtatacaacttaccaagaccagactattaaaaaatagaaaatcttagcagaccaataatgaataaacacataaacagaccaataatgagtaaggagattgaatcaataatataaagtctcccatcaaaaaaaaaaaagcccagaacctgatggcttcattgctgaattctatcaaaaacttaaagaatgactcatatcaattatttaaaaccttaaaaaattgaagagggaatacttccaaattcattttacaagatcagcatcaccctgataccaaagccagataaaaacactacaaaaaaaaagaaaaacctcaagccaatatccctgatgaacactgatgtaaaacatcttcaacaaaatattggcaaacagaattcaaaggcacgtgaaaaagatcttcagcattatcaaatgggattcatcttagggatacaaggatggttcaacatatgtaaattaataaatgtgatacatcacattaactgaagggagaacaaaaaacgtatgatcatttcaatagatgcagataaaaaatatttgacaacattcaacatactttcatgataaaaactctcaacaattaggtataaaaactctcaacaattaggtataaaaagcatgtacatcaacataataaaggccatatatgacaaacccgtagctaacatcaaactcactggggaaaagttggacgctttttctctaagatctagaagaagacaagagtggccactcttgccacttcttctattcagtacatactggaggtcatagtcaaagcaataggcaagagaaagcaaatgaatctaaattagaaaagaagagataaattgtccttgtttgtagatgacatgctgttatttataacaaacactaaaaaactactagaactaatatccaaattcagtaatgttacattacacacaatcaacatacaaaaatcagagaacaatctgaaaaagtcaagaaagtgatcccctttatataactacaaaaaataaaacatttgtgaataaacttaacgaggagttagaagatctatacattgaaaattatgaaatactggtgaaaaaatttgaaaggatagaaataaatgaaaagatatcctgtgttcacagattgaaaaagttgatattgttaaaatgtccatactacaccaagcaatctacaattcaatgcaatccctatcaaaatgcaagtgccattcttcacagaactagaaaaaacaattttaaaatttgtatgaaactacaacagactttgaatagccaacacaatctggagtgaaaagaacaaagctgcatcatgttacctaactttaaaatgtacaacaaagctatagttactacaacagcatagtactgacatgaaaacaaatgtaccaatggaacagaatagagagccctgaaataaatccatacatttacagcaaactgattcaacaaaggtaccaagaacatacaatggggaaatcacagtcttttcaataactgatgttgggaaaactggatatctaccatgcagaagaataaatttaggtaattttctcacatcatatgaaaattaacttaaaatggattaaatacttaaatataagacccaaaactatgaaactgctataagaaaacataggtgaaaatctccatgacataggtctaagtaatgactttttggatgtgactccaaaagcacagaaaacaaaagcaaaaataaatgaggggactatacaaaactaaaaagcttctgcacagtaaaggaaacaatcaacaagagtgaagagacatcctacagaatgggagaaaatatctgtacattatacatctggctaaaggttttatccaaaatatatgatactcaaacagctcattagcaagaaaacaaataacctggtaaaaattgggcaaaggacctgaatagatgcttttcaaaagaagacatacaaatagacaataggtatatgaaaaaacgcccaacatcacaaatcattaggaaaatgcaaattaaaaccataatgaggtatcacttcacacatgataggatggctgttatcaaaaagagaaaaagtattagtgaggatatggagaaaatggaattttgcaagctgttggtgggaatgtaaattagtgcagccattatggaaaataatatgaagattcctcaaaaaattaaaaatagaaataccatatgatctggccatctcctactcgatatatatccaggggaagtgaaatcagtatgttgaagatatatctgtgctatcatgttcattgtagcattattcatgatagtcaagatgtagaatcaacctaagtgtccatcagtggatgaatggataaggaaaatgtggtgtatatacataatggaatactgtttatccataaaaataatgaaatactgtcatctgtgaaaacttgcatgaagctagaggacattatgttgagtaaaataagccaggtacagaaagataaataccatattatctcactcatatatggaatctagaaagatgcagagagtagaatcatggttaacaagggcttgggtcattgaaggatggcagaatttgtgagatattgggcaaaagatacaaaatttcacttaggaggaatatgttcaagagatctattgtacagcatagtgactatagataataatatattgtattcattaaaaatgctaaaagagtggatataaagtgttcttatcacaaaaatcatgactatgtgaggtaatgcttatgttagctagatttaagcattccacaacgtatatatacttcaaaacatcatgttgtacataataaatacataaattttatctgtccattaagaaatgatttagttcagttctgagacaagacatcactctaccctgctgttctctaaatacaattcaataaatgctcatggcaggtttcttcataactattttacaggtgtcctttaaagggtgggtggttaaacaaaccttggtacattcatcattagagtactagtcaacaataaaaagcaatgcagcaacttggatgaaattaaaaaaaaatatgctcagtaaaaaaagctaaatccaaaggcttacatactgtgtgatttgtttacacagctttgatgaaaattttatattactttatttttacttttattttaggttcagaggtacatgtgaagtttggtttgtggatttttgtttttttggtttttgttctttttgtttttgtttttgagaaaggatctcactgtgttacccaggttagagtgcagtgacatgatcgcagttcacggcaacctccccttccccagtagctgggactacaggcacacaccaccaccccagctaattctggtattttattttattttattttattttattttattttattttattttattttattttattattttattatttattttgtagagatggggttttgtcatgttgcccgggctggtctcaaactcccggactcaagtaatcagcctgtctgggcctcccaaagtgctaggattataggtgtgagccactgcacctggtccaggtttgttatacaggtaaagggtatgtcacaggggtttggtgtacatattattttgacaccaaggtaagaagcatagtacttaatagggtacccatgtttctgcaaaggacatgatctccttttttatatggccatgtagtattccatgatgtatacgtaccacattttctttattcagtctactgttgatgggcatttaggatgattccatgtctttcctattgtgaacagtgctgcagttaacatgaacatgcgtgtgtctttatgatagaatgatttatagtccggctggtcgcagtagctcatgcctgtaatcccaacatttgggcagccaaagcagccagatcatttcagctcacgagtttgagaccagcctggacaatatggtgaaaccatgtctttactaaagatacaaatatcagatgggtgtggtggcacaggctactcaggaggctgagccacaagaatcgcttgaacccaggaggcagaggttgcagtgagctgagatagcaccactgctctccagagtgggtaacagagtgagactctgaatcaaacaaaaaccccaaaaaccaaaactatattcctttgggtatatacgccagtaatgggattgctggggtgaatggtaatcctgttttaagttctttgagaaatctccaaactgatttccacaatggctaaactaatttacttttgcaccagcagtgtataaacattcccattttctccataacctcaccagcacctgctttttttgactttttaataatagctattctgactgatgtgaaatggcatctgattgtggttttgatctgcatttctctaatgattagtaaagttgaacgttttttcatatacttgttggctacatgtatgccttcttttgagaaatgtcttttcatgtcctttgcccacttattgatggggttgtataacattctagaaatgacaaaattatgtaaatagagaacacattagtggttgtcaggcattggggagtgaggcatatgggagagaaatcaatatggatataacaagacaacataaggaatccttgcgataacagaaatgttctgtatgtttactgtggtagcacatacgcagatataaatggttaacaaaatagcagagagctaaatacatagtataagcatatgcactcacacacacagaggaatacaagtaaaactagggagatctgaataagattgatagattatataaatgtcaatatcctagttgcgatactgtacaataattttgcaaaatgttatcattggaaaaaactatgtaaaagggacatggaatcttaattatttcctacaactgcaaatgtatctgcaattatctcacaataacatcaataaaaatgattttataacaaatgaaagcaatcaaatactagtaaaatttagtacatttctatgtccttgttgtatatttcatcatttaaatatacaacaaagcgaaataatctaaaaagaaaacattattttatacctcaaacccctgagattatacacaattgcatatttctgtaacttcatttgaaaatatggcatccataaccatattaacatactacggggagtttaggaggatcctagcttttggctctcctccctcagttaattattggaagctttgaggaaaggtgtcacgagaaatttttgattcagtcaataaacattaatttttcttttgtcttgcttttataaatcactggcctatctacaatgggaggctacatcttttaattaatatacaatacttttcagttcttagttgtaattatcttgtatgttttagatttcacataacgctgatgaaacccactgaacttttaaaagtactctaggatacaggattcacatgtaaatctaccacaataaaatgactttttaccagttattcctccatcccagagcttcattttatgtttataaccttattttaaccttatttattctacttgttatgttaaaattgtacttattttactcctcccaaggttaaaataaggattaaaatatcatttattttcatttttattactttattatctccataaaagtctagagtcactagcttcttttatccatctttggtgctggtataaaaacacatttcttgcttcacgttatgtctttaagcagcatcactttctttgattttccttttccaattaaaccactatctttgaactttttaattttcatggatacataatagttgtgcatatctgtggggtacatatgacattttgatacatgcacacaatatgtaatgataaaatcaggggatttaggatctccttcaaacatttatcatttctttgtgttgggaacattctgaatcttctcttccagctattttcaattatacaataaagtattgttaactatcatcatcctatagtgctattgaacactagaactccttccttctagctgactatatttttgtacccactacctagccttcttaattcccctcccccactcctccctgcctttgctaaccatcattctattcacaaaatatcacatgttctcagtcatatgtggtctaccttttttgtttcttctctatttctgttattttcagttattatttaaataactaattaaattcttgtggttttttcctattttttttataatgataggtttttaatgccctatttctccctgacaaacaactagacaccctgaatactagtagattgccctagaaacctgcctccaactggatctaataactgaattcagcttctcaagtcctaatcagattaaatcagatttggtatggcatagttttgtatattcttaaaatagtaacaagattacttcacctactctactgaacagcctagatgaatctatttgttattattattgggaaaatctaagttgagtatgaactaaaattcactaacaccctttattccttcttcctaatgtcctcacttatttatttgtcctactgtgataaatgtatcttagtaaggcctttcgaaatattttatgaattaaggctggaacaaagtagataaataggcaagagagaatctatcagaaaattaagtaaaatagaaaaaaaaaatcttaattacggctttgacttagctcacggactacctcttctccagctaatctgcactttgctgccaaagacattctcctgaagcttaaatgtgagcatctctctattgaaaaactcagtgtagctcaaaaatatcttaaaatgttctcatggtatatgaggtcttatagaatttaagttcaagctatctctcttcattccccacaatgttctctgataagatggtcctctgttctgggagctcagaatcatactcagtcccgtaaagaaactgagcctttatctaggtatgaaaacctagacaacgtcctcatctgtattattgtacttaacaacctgcattatgaagtccttgtgtaagcagaacagatctgcccattcaatggcagatgctcctcaaagacagttatcagaagtcactcagtaactctaaggccgtcttcagtatttgtaggtctgcaaatggcatgggcaagaataaaagccagtggtaatagtaacaacgtgccccacagaattttatctgggtcacatacatgcactcctcttgctcctgtgtgtaactttggactttccctcagattctatctggcctgattgcaaggatcttttaacgtgattatccattctggagtttgtccttgattaccttgacaatggctcctagctctacccttactacagtgtgctcctcggttatacattatctcagttatcatagggtcagctcacctttttggccttgtaaagataacagtgctttaaatttttggtttattaatttattcatgaacatttagtaagtcccatattatactaatcattgaagacataaagccaagtagaacaggttccttgcctccaattatcttgcttctctgagaacggaaggtaagagtcaggctgcatctatcaggcatctaactactatggtctttttgacccatttgtactgaaatgttttaaaccagatacaccaacacagttctctagttcctcagcctccagaccaagagagaatatgtttccttgtgaatgctgatcatactttgctaataatgaatgtgtgtttaaagttaaaaaagaataaaggaacacagctggatgtattagtatgggctcatgaaagagacatatccttggatgctgaacccgcatagtcctgttacttcatggatgacacaatgaactgaatctaagacacttctaaaccatcccagcctgcactagagcattggcaaactggaggtgctgttttacaaaatgaatatatgaatggatgaatggtggatggacgaatggatgctttttcaatggcctatatgttcttccaaatattttgaccattaaaagaatttaaagtctagtttgaatttcatctatgtcaagaaactatccagtgtccctagtttaaggtgatcattgattccttgaattcacattcaaaccactgaattcaaatagtttattatttaatctgtacctgtataattatgcaattattgtagttatgagtatatggttgctttaataaattagaaatccgttgatatctggaaatacagttgacccttggacaacatgggtttggagtgtatgggtctacttctacattggtttttttcaatcgaacacagacagaaaatattgtattggcagatgtgaaacctgcctataagaaggcctgatttttcatatgcatggcttctgactaggggaaatgatcatgcatagattttggtatatgtggggtcctgaaaccaattccccatatctacatagggatgactgtatatcttatactgatgccctgccatggactatcatcctgcctggcagggaacagtcactgaataaataatctgtacatgagtgtacttcctaatagataatcttggatcatccatctatgttcagtcaatatgtagaaaagatcagcatattattcatgacatattaaatacacacttattgagtacttattctgggcttggcaaggatgtggttaaaatttaatcaccttaacacttgctcaatgtgtgaataatatgactctaccaaatcatattgttatcttttatcttgttattttataaacagagatataagtaatgacctcaaaatgactttttgaaagaataaattagcatctaataaacaaatacacagctttaaaaatcatcttgttgcaaggaaaggaaacagaacaaagtattttcataatcaagtacaaagttaagaactagagtggcattttttttttattatactttaagttttagggtacatgtgcacattgtgcaggttagttacatatgtatacatgtgccatgctggtgcgctgcacccactaactcgtcatctagcattaggtatatctcccaatgctatccctctcccctccccccaccccaccacagtccccagagtgtgatattccccttcctgtgtccatgtgatctcattgttcaattcccacctatgagtgagaatatgcggtgtttggttttttgtacttgcgatagtttactgagaatgatgatttccaatttcatccatgtccctacaaacgacatgaactcatcattttttatggctgcatagtattccgtggtgtatatgcgccatattttcttaatccagtctatcgttgttggacatttgggttggttccaagtctttgctatggtgaataatgccgcaataaacatacgtgtgcatgtgtctttatagcagcatgatttatagtcatttgggtatatacccagtaatgggatggctgggtcaaatggtacttctagttctaaatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgcatattagccctttgtcagatgagtaggttgtgaaaattttctcccattttgtgggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtagcagtaccatgctgttttggttactgtagccttgtagtatagtttgaagtcaggtagcgtgatgcctccagctttgttcttttggcttaggattgacttggcgatgcgggctctttttcggttccatatgaactttaaagtagttttttccaattctgtgaagaaagtcattggtagcttgatggggatggcattgaatctgtaaattaccttgggcagtatggccattttcaccgtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagttggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctctataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtcactgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaatagagtggcatttaaagttctaacagaatatagagaaagggcccagggaattgactcacacttatgctatgtaggaaaaggagtgcatcatataatacttatttcatagggtgaatatgtgtgtgtacatatatatatgtatgtatgtatgtgtttgtgtatatatgtatcataggaaagagcattttcacatgtaagcaactttgcaaacagggaaacagaggcaaacagaaaatgcatgtttcctaactgtcaaagcaagcaaaggtcaagtcttctctcaaaccctgtttcaactctattcagtccattgttacttcaaaaccattttaatatttttcattatataaaagctgttcctctatgaaattaatgaaagtaatgatttttgcattaaaaaaaaacagttgtttatccagaataaaaacaaaatccctgagacaaatggggagactcaggaattttccctttttttaatccaagcaagccaaggaagccccagtatacatacatatagcatgtatatatttaactgatcatctataggaaaatacatacattcaattaaaataaatactatactataggtatgtggtaaagaccaatttaatggagcaaaattccatcagaaagtttgctcaagttttagtttttcccaaagcatttgaatcacagaggctacttttttaaatatcaaaacaaatactttgggcttattgtgtagacagacaagttatcatggtgcatatacctctctttacagctactccctattcagaacatcagaataaagacagaaagaagactgcaaatacagcttcagtttgatttcatactgaaatacccactataggtcctctatagtaggctggttgtactggcaaaacaaaacaaaaattattattatcacattcgttcaatacttaatatgtaccagtcaatgttctaggatttttgtacatgcaatttccttgatgatctcagaactctatcaagttggtagataaagaacctgagtctaagtcacatgcccaaggctggctatacagctcatgaatgaaaggtcagaattcaaacatcttctgtttgactttgagatctttttcttgatcaccatattacaatgcatctactattcataataatatctattatcccacttagatgagaaaactgaggctcaaagctcagtatcctgtcagaagtttttcttctatggagtcatccactgaaaattaaatcaggttcaaaattattaattcagtttctccttcaaatcacccttccaaattacactctgccactaataattgggcagattgggacacccttgtgaagtcactattctttgttatttatcatttatattcaacttatttccttgattataaaaagaataatatgttgaaaccaataaaaacatatgtttcattcctacagtaatcaagaaaaagtggatctggttggaaaaagcattaaaaaaagccccgagttatttttggcccatacagcatccccagtacacgttctccctgtggacacagagcagcatatggctgttcttttcacagttcaggctcttctgtttactctgaacctctaggttacaatatgttttgtaatcactaataaggaccacctgtctcttgagagattctgcctaataaaatagagagactcattgttcaaatccactctcaggtagacaatacatgcctcatgtgtgggccgagattactgagtagaaaacttaaacaaattatgctgattgtaattgccaaattaagaacatatgttagtttcataaaaagaaaaaagaaacagtaatgtttggaacaataaagataatgcttttgaggaaatgaaatacctaatatattttccaggaaaaagaaaaagaataatctacttatttaaaaaattcgttcaatccactaagagatattcaaggcaaatttactgcattccaatatgcctaaccatataccctctttgtacaaatttatactatggttgaattcagccagaaaaactggctctttgaaaacaagcagagttcaatccaataactgactgataaatgcttaccactgagaatgtgaaagctatcataaatctggtttaatagaacaagaagagatacagtatatggataagagtaaatcctcctgtcagtatcctcctttggccacagtgacaattcccaccagaggtcaggccagattagcaacctctctctaggctgccattgcaaacccatatatatataccttcatcagtgcacctgctccattgcgctagagtggttggtccgagtgtttgtctctccttctaatctgtgagttccctgagaacagggttcacatattcactatagtctcaacaccttttaacagagtatgagcacagactgaatttcccaaatctattcaaaaaataactgcctaggtgatgatatctattcacatggtagcacaggaaaataaatttatctcatataaagtttgttttttgagtgcagagggattttccaagtattaaggccaatgtcaaagacaggcagaaaggactggctgtggggacagtcagcattttaaatgcagagactgtctctgaactttctcacacaaactcaagtccctcttctaatgggaccttcgctttgcccagtagactcattatctatcaggtgtctcactgaccacatagaatattgagatactgaattaatcataagtaacatttatagatctcaggtgtaccaaacactgggcaaagggctttgttgtattacttcatttaatgcttattacaaccatataaggtgggtgctactgttttcattttagacatgataaaactgaggcaaataatttgtttagtgctttgccatagatctaagcaaaacattaacaagttggtagcttgccaagcactctactactccaccttcaagcaggtgactaatccaactcctaaggataaaagtcatttgatttgtcctgataatcctcagaattcaattcttaatttataacctctctccacagtgcaatttattgttttttcttctaagagatgcattttccatttcggtaaaacccgcaacgctatctagttataaatgatcataatcatgcatgagaaataattctcacaaattgttttgatacattttatgaacgataatacagtcataaacataaaactttcatgcactgttaaatgtacataaaagagcagcttgagattcaataggaagtttataactacattatgcgtatatggcgagatgtgtatatatgtgtacttgtgtgtaaaattatgttatgtaatggtgttgtatgttagtgtatatatttctcaaacactggattttgctgtgtaaatccctaatcatcagaatatattaatgataggcagtccgacattaataaaagtcagataaaaagctttcctatcttagaccttgtcaaaacatttctgtcttatttcatttcctataggtcctctttcaaaagggcttctgtcaaaaagctattgattatcaataacctgtggcattatcaaagttgtgtttcaataaatgtcaatatggattgcagaacaatggataagatttcatgaagcacctagaagtagtaaagtattgatatgtggccttacgtatcactacaatagttagaaacataagctgtctgtgcattattaaatgcatagctgcaataattatgaggaagaaaataaatcataatctccctagttttgtaatttctcatcgtctaattttctgagaacttgggtgactggtgctgcatagacatatcactttgggggacatatttggaaatacaaaacaaaaaaaaattgattaaaaatatcaaattgatgtcttctgattaggttcaaacatgagaaagcatgtatacactctcacagtattatggtagctctgagaatcaagaagaggagatgttttttgctagaggaaagagtgaattacacattaaaacaacagaacagaagaagaatattttcctagtttatttgaagcattttaaaaacatcctactgtctaccgttctttttttatgtatttttattattattattatactttaagttttagggtacatgtgcacaatgtgaaggttagttacatatgtatacacgtgccatgctagtgcgctgcacccactaactcgtcatctagcattaggtatatcacccaatgctatccctcccccctccccccaccccacaacagtccccagactgtgatgttccccttcctgtgtccatgtctactgttcttgtagttatttcctggccaccaaatttctgtgaaaagtcctacttttctgtggaagagatgctggatgaatgaactctaaacctcgactgagactacagaacgtgctccatacttctctatacttaaaaaagccagtgtgcactaatatggggcaaagggctgttaaaatgtgaaataattcttcacctggtggtaagtagatgctgccctccttgccctccccaccccagcatccacagccctgtgcactgatttcctgggcctcccttatccatcaagttcagaattggtttcctgttccagagccccttaggactgaagagtgatggtacctagcagctctccccaaatcccccaaagacctctgccctaagagagctcctctgagggagtgcccaccagcctgagacacctgatgaagttcctcctccgtactgccatccccacgtgctaaccccactgggtacccatcagactccagccgaaagaaacagaactctgggtgatggtgcggcacctggcaggcaaatgcccaggtgcttttgggcaccaatcccaggccttgggaacttgcttccggctgggctcttcaagtcgccctcacatggccacttgtggaaactgcagaattaatggacactggacctgaagagtgcctgcggtagacaaaaatagcaggtagctctaaaggctgttaagtaatctgaacatcacccttagatacatcaaccttccctggtgttgcaactgaaagaggcaatataaacacagagtatgattcacttctatcaaccagatatagccagaaggtctccccttgtgatgtggcaaaagtgatgtgccctttttttttttttttttttcttgagacggagtctcgctctgacgcccaggctagagtgcagtggcgcgacctcggctcactgcaagctccgcctcccgggttcacgccattctcctgcctcagcctcccaaatagctgggactacaagcacccaccaccacccctggctaattttttttgtatttttagtagagatggggtttcaccttgttagccagatgtgacctttttttaagcccaaatttataaatgagggcatattcagtcgattccacaccacctccaacacacagacatacaaaaaatgtacaaagattacaacaaatgactctttcataaaagggcaaaatttatctaagggtatagtcaactgcaggaaaaaaatcagatcattcattaaattcttacagatatcaggagatttctctaaagaggctgaagaatgtccataacatttttaaattgaagagagaatcaagtcatacattttctaagagtttatttatggggaaaacctattctagcaaaagttatacacttaaaaataaagcatccctcctggagagctatatacattaatatatgtttatgacgatacttgcttttagatgaagctgattggtccagtggccgatgactttgtactctgtgcttttgttggttatttgatactggaagatatcataacgtccaggagcatctccgttttcattaaaagtgacaggagtgccagcactgcctataaagatttagaaaacaatgttaataaagttttagtaagatagcccactgggtttatttttcttttagaaggaatggtagataaaaatatattgtgtgaagtaagtgatgcaaagattgcaatccatacaaggtcattcttgatagcataatatcttttacatgaaaaagaagcccagacatacacacacgagtaagacgtgctttattgtacatattagaaagtaaatgatgagtatccaagttaagcaatgcacataacagctaaataaataaaagttgataggctgaatattcaatactggctacatagtatgatagttaatagagaaaaatgtaaatgttttgaagcatgacagctattgtacaatacgaactacaaacagcaattcaaaatatggcaggagaactttctggccagaatcctgagttttgctttttccaaactctctaaagcagttagagagcaccgttcctgtgcctctgctacctctgcccaagagtatatcaatgtggtctactgttgggaacctctcaatgggtgaggcattgatctatgggaagtcccaactctgcccagatcatgattgttctcccccttcacagtgacaggtctaacagtggcagagcagcagggtgcaagaactgtagtcttttctaaactccattcctctcggaagttttcatcttttctcttaatagtttctgctcacttttattttccctcttattaacttttatgtaattacaggggaagagtagaaatggatcaccaccccaatgtcttcttgttccatctagcttcactatctatacagactttccttttctctaacagcttttaggcttctctacatttttttattattattattctttcctgtcttgaaaaattcacctgacaccaatcccttttcttggtgtctgtcttccctctgcaggccttttatctgactctcttctcacaggatattggatttaatttctaaactgtgctagagggtttccccttcttgttatctctgtctcatactgtattctccaaaagtatacataactaatagttatatacgtcaactgtacatattcccatcttataatgagcttcttattctatctgtagagttgtttacctaattaccagccatcacaaaattgtaaaatatttaacttatcaaacaaatcgatgactttatcaaaaaaacacagtaacctgtaaataaatgtaatcagagtcacataacaacaatgtgaatacttttccagtaattaatggacagatgtctaatattctgttttcttgattcttcctaaaaatctaaacatggtgtaagttctctgatgagactacagacatctggtatcatcaggaactgctgaggctgcaagagatggcaccgcatggaagaaagagctctgctcccggaactggaagttccatgtccaggctcactccattccccattgatttccacaacttgtgtatgtcccttttccttcacttaccacacagacttaacaataaatatgaataaattttgaagtcctaaaagagctgtaaatatgtacattattattactattattattaattcacatgagaaatgactttatatataaattgatagatgtacattactcagggaataaaataagagctctccaatcaagcagtactatcttagctactccttatatatggaagtagaacctatttgccaaacctgaccaaaacctttctcagctcctagtgacctcgagcaggttaacctcttaaatcctcagtttcttcacctgtaaaatgggagtaataatgatacttttctcatagagttgttgtgagaattaaataatcaacacttgtcaagtgcttagaacagtgcatggggataaattattcactgcacatttactttcagtacacaccaacacatagtaatagaaaggatgttgaaagttctctaagtgatggctagacaaaagattattgaaattcaaatgaggaagatatttctggctggaaaaacacgtatgttgagaatttcacattaacatgatcaacttctgacatttatatatcactttgaaatattttaattacatattctctcctcaataaagggatacttaattttctctacttaaaatctcccaagttgtcaactccttgactcaatgactccttatcttctacaacagcagttcccaatcttttttacaataacagtacctaagatgaaataatgtaatttgtataacacattaccatgaatataccctaagttatacataattcctaatgtgttagctgtttctatatccaagtcaagaaagcctctcaagagagctcattagagagccacattgtcacaaaatataataatttccaacttagatactttgaatatcattattaaaatcaagttacactaaatttgacattgtattaaggtgcaatattctaaagcagttataagtgtgggttctggagacagatcattgggttcaaacgcccctctgtcacttattgatgtggtgtcttgaatgcatttcttaatttccctatatctcacatttctcagttatatagtgggctaatagcaattcccacctcagagggatatataaggattaaatgaatcaatatatataaaacatttagtacatcatattacgtattaactataatttcttttgttgttttgtggaaatgttgtgtttgagagccactgtctatatgagaacatataaactcagtgagcgtataagttttcctgatgtcactctcactaatctctgatctctttcaacacaatgccacctatacctaaaattccggtccctaaattcattatgctctgtctcaccattctgtctttgctcaggctattttctctaatttcccattctctttcctccttacccctctctatataattccttcaagatgaggctcaagggtcatgcacttacagaagcttaatcttactccaaccctggggaaggtgcccaaccacctctttatgtcctaacatgcaatatcgaagcactcgcaacattccacagacttactatccattctgtacctgaccaaacatttattgcacagatacttttttagagcctattatgtgctcaacactgggtggaccctctgcaatcttcacaaaactatggtcttcttaagaaaggcaaaagtatctattatctttgtaagcactgcagcaaagacagtgttcagtactgagcaagtaatcaataaattataggaaagcatgaaagaggcatcccctaatgatcccaagcaaatccatgcttccctcttcatgacattatgaacttcatgtatattttctgtcatcttttatattcacaaacggagagaccaaataaatcctctcactttgttattaatgtgacattagaaaccacggggaaactttgacatatctgtgaatgggctctgagttaatcaccagtagctgaagtggtttttattactgatgacccttgcatcttgttttcctaatgcgatttctagtcttaaattaggcttgcagttgaattacttcaaccctttttcaggaagaactgattccattacatattgactcatttcaaatgactgccatggaactctggtcaatgtagaaagagcatcgttgagtagccataaggaactaactcattagctgtttaataattcctacaagtttgccatcttttaaaaatgtcattgtttgtactgaaactggccactctgagaaacagaattaagtggcgaattttttttttgtccacaaaaaaatttcaaatgacaaatgtctgttaatatagtcattaatttatcaaggtttaataacaacacaggtaagaaatataactttgacagagtggggttccaagatggccaaataagaacagctccagtctacagctcccagtgtgagcgacgcagaagacgggtgatttctgcatttccaactgaggtaccaggttcatctcactggggcttgtcggacagtgtggacaggacagtgggtgcagcccaccgagtgtgagccaaagcagggcgaggcatcgcctcacccggaaagtgcaaggggtcagggaattccctttcctagccaagggaatgggtgacagacggcacctggaaaatcaggtcactcccaccttaatactgcgcttttccaacggtcttagcaaacggcacaccaggagattatatcccacacctggctcagagggtcccatgcccacggagcctcactcattgctagcacagcagactgagatccaactgcaaggcagcagcgaggctgggggaggggcacacgccattgctgaggcttgagtaggtaaacaaagcagcccggattccctcaaactgggtggaacctactgcagctcaaggaggtctgcctgcctctgtagactccacctctgggggcagggcatagccaaacaaaaggcagcagacctctgcagacttaaatgtccctgtctgacagctttgaagagagtagtggttctcccagcacggagtttgagatctgagaacggacagactgccttctcaagtaggtccctgacctccaagtagcctaactgggaggcacctcccagtaggggcagactaacacctcacacggccgggtacccttctgagacgaaacttccagaggaacggtcaggcagcatcgtttgctgttcagcaatattcactactctgcagcctccactgctgatacccaagcaaacagggtctggagtggacctccagcaaactccaacagacctgcagctgagggtcctgactgttagaaggaaactaacagacagaaaggacatccacaccaaaaccacatctgtacatcaccatcatcaaagaccaaaggcagataaaaaccacaaagatggggaaaaaacagagctgaaaagctgaaaattctaaaaatcagagcacctctccccctccaaaggaacgcagctcctcaccagcaatggaacaaagctggatggagaatgactttgacaagctgagagaaggcttcagatgatcaaacttctctgagctaaaggaggaagttcgaacccaatgcaaagaagttaaaaaccttgaaaaaagattagacaaatggctaactagaataaccagtgtagagaagtccttaaatgacctgatggagctgaaaactatggcacgagaaatacgtgatgaatgcacaagcttcagtagctgatttgatcaactggaagaaagggtatcagtgattgaagatcaaatgaatgcaatgaagcgagaacagaagtttagagaaaaaagagtaaaaaggaaagaacaaagcctctaagaaatacgggactatgtgaaaagaccaaatctacgtctgattggtgtacctgaaagtgacagggagaatggaaccaagttggaaaacactctgcaggatattatccaggagaacttccccaacctagcaaggcaggacaacattcaaattcaggaaatacagagaacaccacaaagatactcctcgagaagagcaactccaagacacataattgtcagattcaccaaagttgaaatgagggaaaaaatgttaagggcagccagagagaaatgtagggttacccacaaagggaaaccaattagactaatagcagatctctcggcagaaactctacaagccagaagagagtgggggccaatattcaacattcttaaagaaaagaattttcaacccagaatttcatatccagccaaactaagcttcataagtgaaggagaaataaaatcctttagagacaagcaaatgctgagagattttgtcaccaccaggcctgccctacaagagctcctgaaggaagcactaaacatggaaaggaacaaccagtaccagccactgcaaaaacatgccaaattgtaaagaccatcaaggctaggaagaaacagcatcaactattaagcaaaataaccagctaacatcataatgacaggatcaaattcacatataacaatattaaccttaaatataaatgggctaaatgctccaattaaaagacacagactggcaaattggataaagagtcaagactgatcagagtgctgtattcaggagacccatctcacgtgcagagacacacataggctcaaaataaagggatggaggaagatctaccaagcaaatggaaaacaaaaaaaggcgggggttgcaatcctagtctctgatgaaacagactttaaaccaacaaagatcaaaagagacaaagaaggccattacataatggtaaagggatcaattcaacaagaagagctaactatcttaaatatatatgcacccaatacaggagcacccagattcataaagcaagtacttagagacctacaaagagacttagactcccacacaataataatgggagactttaacaccccactgtcaacattagacagatcaacgagacagaaagttaacaaggatatccaggaattgaactcagctctgcacaaagcagacctaatagacatctacagaactctccaccccaaatcaacagaatatacattcttctcagcaccacatcacacttattccaaaattgaccacatacttggaagtaaagcactcctcagcaaatgtaaaagaacagaaattataacaaactatctctcagaccacagtgcaatcaaactacaactcaggattaagaatctcactcaaaactgctcaactacatggaaactgaacaacctgctcctgaatgactactgggtacataacgaaatgaagtcagaaataaagacgttctttgaaaccaatgagaacaaagacacaacataacagaatctctgggacacatttaaagcagtgtgtagagggaaatttatagcacgaaatgcccacaagagaaagcaggacagatctaaaatcgacaccctaacatcacaattaaaagaactagagaagcaagagcaaacacattcaaaagctagcagaaggcaagaaataactaagatcagagcagaactgaaggagatagagacacaaaaaaactcttcaaaaaatcaatgaatccaggagctggtttttgaaaagatcaacaaaattgatagaccgctagcaagactaataaagaagaaaagagggaagaatcaaataaacgcaataaaaaatgataaaggggatatcaccaccaatcccacagaaatacaaactaccatcagagaatactataaacaccactgcggaaataaactagaaaatctagaagaaatggaaaaattcctcgacacatacaccctcccaagactaaaccaagaagaacttgaatccctgaacagaccaataacaggctctgaaattgaggcaataattaatagcctaccaaccaaaaaaagtccaggaccagacggattcagagccaaattctaccagaggtacaatgaggagctggtaccattccttctgaaaatattccaatcaatagaaaaagagggaatcctccctaactcattttatgaggccagcattatcctgataccaaagcctggcagagacacaaccaaaaaagacaattttagaccaatatccctgatgaacatcgctgtgaaaattctcaataaaatactggcaaaccaaatccagaagcacatcaaaaagtttatccaccatgatcaagttggcttcatcccagggatgcaaggctggttcaacatacgaaaatcaataaacgtaatccagcatataaacagaaccaaagacaaaagccacatgattatctcaatagatgaagaaaaggcctttgacaaaattcatctgcctttcatgctaaaaactctcagtaaattaggtattgatgggatgtatctcaaaataataagagctatttatgacaaacccacagccaatatcatactgaatgggcaaaaactggaagcattccctttgaaaactggcacaagacagagatgccctctctcaccactcctatgcaacatagtgttggaagttctggccagggcaatcaggcaggagaaagaaataaagggtattcaattaggaaaagaggaagtcaaattgtccctgtttgcagatgacatgattgtatatttagaaaaccccactgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccatttacaattgcttcaaagagaataaaatacctaggaatccaacttacaagggatgtgaaggaactcttcaaggagaactacaaaccactgctcaacaaaataaaagaggatacaaacaaatggaagaacattccatcctcatggatgggaagaaaatatcatgaaaatggccatactgcccaaggtaatttatagattcaatgccatccccatcaagctaccaatgactttcttcacagaattggaaaaaactactttaaggttaatatggaaccaaaaatagagccctcattgccaagacaatcctaagccaaaagaacaaagctggaggcatcacgctacctgacttcaaattatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctcaaactggatcccttccttacaccttatacaaaaattaattcaagatggattaaagacttaaatgttagacctaaaaccataaaaaccctagaagaaaacctgggcaataccattcacgacataggcatgggcatggacttcatgtctaaaacaccaaaagcaatggcaacaaaagtcaaaattgacaaatgggatctaattaaactaaggagcttctacacagcgaaagaaactaccatcagagtgaacaggcaacctacagaaggggagaaaatttttaccatctactcatctgacaaagggctaatatccacaatctacaaagaactcaaacaaatttacaagaaaaaaacaaccccatcaacaagtgcgcaaaggatatgaacagacacttctcaaaagaagacatttatgcagccaacagacacatgaaaaaatgctcatcatcactggccatcagagaaatgcaaatcaaaaccacaatgagataccatctgacaccagttagaatggcgatcattaaaaagtcaggaaacaacaggtgatggagaggatgtggagaaacaggaacacttttacactgttgttgggactgtaaactagttcaaccattgtggaagacagtgtggtgattcctcaaggatctagaactagaaacaccatttgacccagccatcccattactgggtatatacccaaaggattataaattatgctgctataaaggcacttgcacacgtatgtttattgcggcactattcacagtagcaaagacttggaactaacccaaatgtccatcagtgatagactggattaagaaaatgtggcacatatacaccacggagtactatgcagtcataaaaaatgatgagttcatgtcctttgtagggacatggatgaagctggaaatcatcgttctcagcaaactaccccaagaacaaaaaaccaaacaccgcatgttctcactcacaggtgggaattgaacagtgagaacacatggacacaggaaggggaacatcacacactggggcctgttgtggggtgagggaagtggggagggaaagcattaagagatataccgacaagttaatgggtacagcacaccaacatggcacatgtatacacatgtaacaaacctgcacgttgtgcacatgtaccctagaacttaaagtataataagaaaaaaggaaaaaaaagaaatgctatttacattaaaaaaagaaatataacaaatatatttgattaagcaatattcacacatattttacatgataaattatgctcacattttcctgttttatttctctccatcctatacgttaggtatttcagaaattttgatgtgtattaattttgtttttgaggagggtggtggaaagggtctccctctgtcactcaggctggaactcggtggtgtcatcttggctcactgcaacatctgcctcctaggatcgagggatcctccaaccttggcctcctgagtagctgggatcacaggcctgtgccaccatgcccagctaatttttgtaatttttggtagacatagggttttgcatgctgcccaggctggtcttgaactcctggggtcaagcaatcctccctccttggcctcccaaaatgccagaattacaggcatgaataaatgtgcccagccaaaagtggattaattttttaaaatggttttcacactgggtgcagtggctcatactttgggaatctgaggtaggaggatctcttcaggccaggagttcaagaccagcctgggcaacacagtgagacccccatctctaccaaaagataaattagccaggcatggtggcatgcacctgtactcctcattactcaggaggctggggtagaaacatcgcttgagaccaggagcttgaggttacagtgaactagaattgcgctactgcactccaactccaggtgacagagcaagatgctgtcttaaaacaaacttttccatccacatgtgctagtgcagaaatggaaacaaacaacatggagttgtgaggtaatgtttactcatcaggtgctacccttagatgtcacacatctccttgaatattttctgttcaataagaaatgtgtgaaaaagtatatttttattcgtaggcatctcaagcactccaacatggttttgtagggaaaatgatatattcaatgaaggttttttttttcaaatgttggctcttttgaatattgcgcaggggaagaatatgggcttgggatgcagggactagagtctgctttctggctctaccaattatccgtgtgatctgagtaagttaccctccttaagcctgttttctcatctgccaagcaggcataataaccccaaccttcctaaactgttgcatgagatgacagtgtatatgactggtacacaatagatgtgcaatgaacgcaaacactcatcatcttccattcctttggctgcacttatgcccccttagtatacattttcttgtttacaccatgcaaaacacaatgtaaaaataatgcattcacctttatgtgcaaaaattatacatctctttgttagtgcaatcctctcagttttttgtcaagtttattcttccctgctcccctcatgctaccaaaaccttattttcctgatcatcactgcctaaactattggaaaagcaggaaaaaaataagaaagctagaaatgaaatgggttaatttagtaatttttagcacccttaaataaagaataaatatgtgagatttgtcattgaccaaaatgccataggaagtagcaattttcaacagtgtctcaattattcatgctctctttccttatccaatttactttactaagtatttattacacttaaatagattcacatatttgaattaaaatcatatagttttattatttaggaacttgattactcttacatgtatcaattactcaccccagttctctgaagcctttagcatgtgacttactgtattctcctccaaccacatttctgttatctctttggtggtagtataatttactcaacactcaacatcctggctgcagagttagacttacttatttccaattaccttttttgtttgtttgtttgtctgtttgtttgatttgagatgaagtcttgtctctgtcctccaggctggagtgaagtggctccatctcggctcactgcaacctccgcctcccaggttcaagtgattctcctgtctaagcttcctgagtagctgggattacaggcatgtgccaccatgcctggccaatttttgtagttttagtagagacagggtttcaccatgttggcaaggctggtctttaactcctgacctcaggtgatccacccacctctgcctcccaaagtgctgggattacaggtgtgagacatcatgcctggccccaatcaccatttaaaaaaaaaaaatcattcacgcatcttgacacatactatcatagtcactctctggaaattgtcttgtctagtaaccatatcatctccaaaagtttcctctttggacaccaccttccatcctcactgcaacaattctatgatttcctacacttcccaattcattaatcaccctgttttgtcacactgcttcgctcccatgatagtgactcttctctcctattcctagacatgttctatgatctttctagggaataccctctattctcttgcgcttctctctgtccagtgaattgctctatcaaaatcacagtcattgtacaattaaattcaattgtacatcttctttgcctgcacccaagaagctgaacattgtttaataaaatgataaaattttattgtctgacaagaccaggactaggctgaggcaaatgagatgcccagggcatgactccgagagggaatctatctccctgaattttgcatgctaggtgcctcacttcctttaccttgtccctgctgtctggtcttactttaaattcataccctcagatttcacatggacaatcagcattgctctgcaatcctatcacactttcccagttggcccatttccccctcgcttctaggtaatatttgactgtttcatgacttattctcatccctcacatatccaacaccttccttcccctgtcattccggcttgcttcatacgtttccactgagaaaagacagcaatacaaaaacttcctcatcattccaccacaaaatctaccgcctacctgtatccacactcatattctcccatccctcctgatgcaacacatatcccaggtccaatcaaaggaatgtcctcccttggtgctggggccccatcactctcaccttccatgcactttcagttcagttatcttttctttcttttacataaacaaatttagacttttggcagaagtatccccatcaatttacaaatcagttctaatagctctcaagaagaaagcaactaaaatccgttactctatccccacagactcattcagctactgcttcatttttcactcccttcatggtaaaattgtgttcattttctccactttcttatttctcttttactctttgacacattttaagttaaaatttaacctcattcctccactgatgagtctcaaatttatatgtctagccctgaatgcagacttttccaattatctgtatctccacgttattgtttgataattatctcagacacaatgcttgattcttacatatttccaaacatgttcttcagacagtcatctccgcttagtaagcagcttactgtccaaccattcaatcaattcaaaacctaatttaatacccacatctatagcaacacacaggactaaatcttaatgtaaactaagttaataatgatgtatcatactgatccattagctttcatacatgtaccacattcatacaagatgttaacggttgggggagctatgtgtgtgtggaggggtgtaatatagaaattgtgctctatgttcagattttttgtaaatgtaaattattttcttaaaaagtctaaatttttttaatggtgacattaattttaatatactttatgtaaactaacatatgaaaaatatcacatcaaaatataatcaatatagaaatattgaggtactttatgcacttatttcctaagtcttcaaaatcttatgtatactttatactacagcttatcacaattcagattagccctgtttcaactgctcaacacccacatggttagtgctgaccagattaaaacaacacaggtctaaaaggcagataatttcagcagccactgctccctcgctccaacactccattcactggggatgaaggcccactgctgagcctttctcatctggcctcctcttcaactggactgaaccccccttcaatcatttcttccctaaatgtatgtggaccaaccaaagactgacgtatggctcagtggatgccagatctggagaccagatcctaaaataaaatctaaacttctccagaggtaaaaataaacaaggcccatatctaggccaggcatggtggcatacacctgtaattccagccacttaagaggctgagttgggaggatggcttgagcccgggaggtggaagctgcagtgagctgtgatagcaccactgcactccagcctgggtgacagagagagaacctgtccccaccccctgctcaaaaaagcttacatctaatgcatggacaggttctatcttcagaacgtatctagaatttgcccattctttttaccccctcttgcattaaccttgtcttggctactataacctctccctgaactcttagcaggtatcctgcattcacactgaacaacaacaatccactctctaccctacagtcagaatgtcaatgaaacacaaatcaaataatatccctcttcttgatatccttcaatggcttcccatttcacttagaataaaactcaaaggcttatcatggcctttaagtctcttatttatctgatcttgctcattttctgtactccttccaacctggtcttctttctgtttgcaagcacatgaaggttgctctctctcagggattttctgttttctcttcccagtgttcttcccgacttgatcttctgactggcttctttcattactcgtatcccacccaaaatatcaagagaggcttgtcggatcaccatatctaatttagcctgatttctatccctgtcattcactattacacacattattgccttcatagtacttttaaatatctaaaaatatttggtttgtttaactgatcgatataaatcgctggatgatatgcctgtgattgtggaaaatatttctatcacattctccaccatatatatagctcagactattggatgaggatccaaataaatattatctttttcctgggcacatagctaggctacccttttccagtcttccttgcacttaggcatggccaaattattagttcagacaatcaattgtgagcacacgtgatatgcactacataggagggcattaaaaccccctaagtggtcttctatggtcttttctcttcctagctggctagaatgaaaatgttatgctggacactttgagcatctgcatgttaaaaacgacagaacttacattaggctggattccagcgtgagtgcatgaatatccgtgctactaacctgttaatccaccattcctttagcataattgtgtgagtataaaacaaacttctattctgtttgagtcattacaggttgtcagtctatttcttccagcagacacccataacatccaaatatctagtgagttctcaatgaatagttattaaatgaataagtgaaatcatattaagtctggaaataaatgtttcacttcatgtcacattataaagcttcaagaatagtgtagagtgagtatcagacactggcatggattaataacttgtttcagattgtccttaagagttaatactcattacttcaatgtggatatatataatataaggtggacttgagaaagtgtaatcattcttcagaattgcactggataagtatccatgtttatttaccttggctaaaatacacaattcgtttccataaaaaccaaatatagaagtattaaaaatgtgtgcccaattttaggttgaaaatggctttaactgttttggtgtgttaaaaaaaaaaagacacgacaagaaatgtagttgaatagcatttctaattctctgaaccaactcttcttcttgatctatcaaaaaactgagataacagtaatttctcctgtggaaatgtcttcatgatccttggataaaatgtgctttaaggttgcaaagtgtcattgtcattaatgaatagcactatttgagaaacagaaatagaccctataattgcatttatagtactcaaataagctgattcaacttttaaaataggaaaagacccattattctgtgatatgcatctcagggaagcagatgaattaggaggtttaaataaaatctcttgtaagaaaagtaaccacagagactattaaaatatcaaatgtttggctaaaggaaataaataaaaaagaacatataataattaggcaagattaggtaatatatcttaaaatgaatgtgagaacaaaccaaaatacgttacaataccctgaatctaatatattttcattctgtaacagaaatcctcttttcatcttatgtacttgaagccctttattattttttctggggtacattaaatactttacatataaaaatgtgtatatatgacttccattataaaaaggactttgctttattaatcattgtatctctaatagtgatgattacatatatgagagaagtgtgtgtgtgtgtgtgtgtgtgtgtgtgtacatatggtccaaccttttcaaatttgctgtactaggaaaaggtctttcatcaactagtccattgtgttggtggaaaaagaaagattctctttccatctggatttacaagagtcacatttatcagtctttataatgatgctctcatggcttgtataagaatctcttttgtacccccaagtctaaaagttattagtttacattttttactaagagtttttaaattatgctgttgatattttcatttaatatacctgtagttgacatccctaccatagtaggtaagggatatgaggtagaaatacaatttcactttttttctatattggtagccattttttcagttctttttgttgaataataccctatttcctactggctggagcaatgcttctattttatatctaagatctgtaaatggatcttgttctggcctatcctgttgcattcaccatttgtccatccttgacacaataccaatggtcaatataaattactaaagttttataataagacaaagcagtatgacaagtttcctatttttctttcttagaagtgttctaccttctctttgctttatacttctccatataaaatgtagaacaatctggctggcatgttggctcatgcctgtaatcctagcatttggggaggctcaggcaggaggatcgcttgaccccaggagtttgaaaccagcctgggcaacaaagtgagaccttgtctcaattaaaatatttttaaaatgtagaaccgtcttaataatttccatgaacaacactgtatagattatcactggagaatttataaaatctgtaaatcaattgggaaagatttaatatctttatattgtcttcctaaccatgtgtattgcttgcttccattatttagaccttctcttataagtcttaaaacagttatataattttcttttcatagcacctaaccatttttgtacatttattcctagataatattatctgatactattgttaatgtttcttaaactacattatctattactttgctgttagtatacaaaatgcagctaactttttctgtatcagtcttatagctagctcagtggttgaggtgattttgtccctcacaggatatttggcacaatgtctggagatatttttgataatcccaactgggaaggtgatgttattggcaactagtggaagaggtcaaagatgctactaaacatcccacaaggcacaggacagtgtcctacagcagtaaattatccaaaatgtcagtagtttcatgtttcagaaaccgttgcaaattcttttattatacctaataattgatctctagattttttatttctatggaaagcatcaagttttctgcaaatatttatatttttatgtctcccttaacagttcttgtagcttaaatatttttttcttcttttcttattgtactatctaggaccttcagtacaatgctaataagaagtggcaatagtgaacacctttgcattttttttaactttaaaagaatgcctcccatattccccagttagtatcatattcatttaggccttttatgtgcacttttcatcagtttaagaaagtccctcatattctaaatgaactaatatttttattatgaatatattttaaatgttagcaatcttttttcctttaatctgttaccataatgaattatatttctatatttctaaatgttgcattatggaaacatggagtgaacacaacttgatttcaataatttgcatttttattcactattggattcgatctgctaatgttttgtttagaatgtttacattcatacttatgagtgagaaggatctgtaatttttgtttcttataatgttcttcttgtttgggtatcaggttatactgacctcaaagaataaatgggaaagtagtccctctttttcttttctttttttttgttcgagacacagcctcgctctgtcgcccaggctggagtgcagtggcgtgatctcagctcactgcgacctccacctcccaggtagttcaagagattctcctgcctcagcctcctgagtagctgggattacaggcgtgtgccaccatgcccagctaatttttgtatttttagtagagacagggtttcactgtgttgccaggatggtctcgatctcctgatctcgtgaaccgcctacctcagcctcccaaagtgctaggattacaggcgtgagccactgtgcccagcctagtccctcttttcctattgcctgcaaatgtttgagtaaacttgtaataatatctttcttgaaagttttgtatagctcaactggaattgccctaaatgcccacaggatagtgaacaaatcaatcatggtatatggtaaattcatacaatggaatattatactgcagtcaaaatggatgaactacagagatggccacaaatatagataaatctcagcaatatattaaatgaaaaaagtaagtatacaaaatacattttataaatgtgtaacaattacttaaaattttttcattcattttgagaaagatgcaagacaaatgtattttaaaaggcaaaggagtgttgttagttattcaggaggaatgagaatgggttggtaatttaaatacatgtttaaatatagctttttgtcaaaatactagcttttggggacataagagtgttttcatagatgcatattacatttttaaataactaactaaataaatgaaagtcactttgcatggatcaatgataactatgtgtcataagccaaacagccaataaatagaggaaaaaaaagcagaagagggaggaggaggaaaaaaggagaggaagggataatgaaagagtgagggaaggaaatgaaaggtagaaataataaatcaaataacaaacattaaaaaaatggggaaaatccacactaaaactatggaaaagaaaggtatactaaacaacaattctttaactttcgtgtaactctgtgaattaactgactgctacttaggcttgctattgtgcccatggagaatatgaatcctccccggaggtcaatgaacccagacaaaataggtcacatacagaattgcctttacccaattctctaaagcagcttttctgcacatttttagattttacatcagtcaaccttctgtctgttatttccggtttataaactataactgtgtgggattagaatcgcattacatttttaagccaaaaagcttaattcattttttttcactttgtacactttttaaagagtaaaatcaggcagaaagtcacctcttcccagttgagtcattatttcacttcttgttaagtttcaaattgttcttttatcttgggttatgcatgcctttgtaataatttattgtttgaataaggtatagtctttcaatgcatttaacaattaatattttcttaatgtttgcagaattacagtgagccaatcaaatacacaggactttataggaacagatgcctaagtgtctaaagaaataaaaaaaatatcaaactaggagagatctactcatctctgacaataatttatggatttaacttaaaaagatagcagataatttatttataatggacctgattttctgtaattacatgaactgtcaatgaatattaggccactgtgatagatgtgaattgtctatgttactatggtgatttgaggtgtttctattctacactgcacgcataacaatgtggagcataattaaaagacatagtgaaatatattttaaaattgctgtcaattaaaaagcaaaacatagtctgactttagcataatcctttcagaagctggcctatcaaactgatgaaaacaataattattagttaatatattgtcttttcaaatgtatctaaaacatttacaaaaatgattattttctgccaaaatgaaatgctagcaatcatgattttgaaatcttagttcatattctctgaccattatgtgataaaacatgaaattcttaacaaaagccttaaaaaattaaaaagttaacacaacaccaaataagaaaaaaacaatagcctccaaagatttagaacaaaaaactaagcacttattttaattaattagtcaaagaaaaaattaaaattaaaatcatagagtgctatttaacagataacaatatatcaaaatacctaaagaatgtgaccaaggctgtcatcagaggaaaatttagagaataaaaagttttattgaccaggaagaaattgaatccctgactagaccaataacaagtctgaaactgaggcagtaataaataggctaccaaccacaaaaagtccaggaccagacatattagcaactgaattggtatctaccagaggtacaaagaagagctggtaccattcctactgacactattccaaaaaattgaaaaggttggattcctctctaagtcgttaaatgaggccagcatcttcctaataccaaaacctagcagagatacaacaacaaaaaacttcaggccaatatccttgatgaacatcaatggaaaaacgctcaacaaaatactagcaaactgaatccagcagcacacacaaaagtttatccaggatgatcaagtagacttcatccccgagatgcaagggtggttcaacatatacaagtcaacaaatgtgattcatcatgtacacagaactaaagataaaaatcatatgattatctcaatggatgcagaaaaggcctttgataaaattcaacatccttcatgttaaaaactctcaataaactaggtattgaaggaacatgcctcaaaataataagagccatagactacaaacccacacagccaatatcatattgaatgggcaaaagctgaaagcattccccttgaaagctggcacaagacaaggatgccctctcttaccattcctactcaacacagtattagaagttctagccagggcaatcaggcaaaataaaaaaataaagggtattcaaataggaagagaggaagtcaaattatctttgtttgtagatgacatgatcctatatctagcatagaaaaccctataatctgtctaaaagattcttatgttgataaaccactactgcaaagtctcatgatacaaaatcaatgtgcaaaaatcactagcatttctatacaccaacaggcaagccaagagccaaatcatgtatgaactccctttcacaactgccacaaaaataataaaacacctaggaatatagctaacaagggaagtgaaggacctcttcaaggagaactacaaaccactgcccaaagaaatcagagatgacacaaacaaacggaaactcatttcataatcatggataggaagaatcaatatcgtaaaaatggccatactgcccaaagcaatttatagattcaatgctattcccattaaactaccaatgatattcttcacagaatcagaaaaaaactatcttaaaattgatattaaaaacaaaaaaaaactcgcataggcaagacaatcgtaagaaaaaggaacaaacctggaggcatcatgcaacctgacttcaaactatactacaaggctacagtaaccagatagcacggtactggtacaaaaacaggcacgtagaccaatataacgaatagagactcagaaataaaaccacacatttacaaccatcttatctttgacaaacctgacaaaaacaagcaatggcagaaggactcccgatttaataaatggtgctgggagaactggctagccatatgcagaaaattgaaactggatcccttttttacaccttatacaaaaattaactcaagatggattaaagacttaaatgtaaaacccaaaactataaatccctagaagaaaatctaggcaataccattcaggacataggcatgggcaaagattttgtgatgaaatcatcaaaagcaattgcaacaaaaggaaaaattgacaaattggatctaattatactaaagagcttctgcacagcaaacaaaactatcatcagagcaaacagacaacccacagaatgggagaaaatttttgcaatctatccatctgacaaaggtctgatagccagaatctacaagaaacttaagcaaatttataagaaaaaaacaaacaagtccattaataagtgggcaaagaatagaaacagatacttctaaagaaaagacctatgtgcagccaacaaacatatgaaagaaagctcaacatcactgatcattagagaaatgcaaatcaaaaccacaatgagataccacctcatgccagtcagaatggcgactattaaaaagtcaagaaacaacagatgcttgtgaggttgtggaggaacaggaacacttttacactgttggtgggaatgtaaattaatttacccactgtggaagacagtttggcaattcctcaaagatttaaaaccagaaataccatttgacccagcaatcctattattcagtatatacccaaaggaatataaattattctattacaaagatacctgcacacatatgttcactgcaacactattcacaataaaaaagtcatgcaatcaacctaagtacccatcaataagagactggataaagaaaatgtggtacatatacaccatggaatactatgcagccctaaaaaggaacaagataatgtcccttgcagggacatggatggagctggaagccattatcctcagcaaactaatgcaggaacagaatatcaaatactgcatgttcttacttataggtaggagctgaatgatgggcacctatggagacatgggggaacaacacacactggggcctgtcagatggtagaggataggaggagcgagagcatgatatagagacacgtttttttaaagttaagcaccaaaattagattatttttgttagtaaagtgtaaactaatctaatttttcctctttattattttatttcctgtaataatcattttatttttattaaaaatacattaaaaatatttgctttgaatataggaaatatggaagacctggaagaataaaataagaaaagttatattttggtaaacaatacacatcgtatcaatggctaatatatgcaaattttagcagatagaagtagctctcagaatctgctgaccacaatgctttcccccataaagtggagaagaaatgtggaagagcctagttccattaccctggttctgtaaaaaacaaacaaacaaacaaaaaacaaattacagttcaccagtgagtccagttcaagttggccagacttgaactgagaagaacactaataatattcatgtagtttcatctaaaagatgttagtaccagaaaataaaaaggaaatgtgtgtgttcaacaattgatgagcgctagcatcaatgctcctgaagatcttgatgttattcgctcttggtctgtgtctatagatagatataagctacttggagcacttggatgacaaaatctttttgattaaaatgaaaacaattgttgtgctaaaacaaatgatcgaaacagttttcatgacactgatattcttatatcatttaatcttaaatgttgaagacctttaaatagttaaaaacatatctgtttttttgaaaagcactaggaattaaatccatgtccaaaaatacaattttttgtatgttaaaataacctctttcactaaataactatttggtacatatagaatgttcatattaatctatttatatgtaccatataaatattatatgtaccatataaataactatttggtacatatagaatgtaaaaattgaaagaatttaagtccctattttataattaattccatttagttttaatgctaattaagagagaacactctatttctcatatttttagtatatcacaagtatatgaaaaaatgcctattttatcttaaaacagctatgctttcaatgtaattttatagattttattagtatattagttatcttttacagaagataaactacatagaatttagtttaaattaggaataaatttcttggcttcatttaaaaggagaaggaggttattattcatgatcattagaggaaatatcctattgccattttaaagttcttttatatggaaacacactgaattaaaaagtgaaggaattaagattgattagaagtgttttaaagtggcttttagatgtatctgcaaaaataaaaagtcagttctatcccaggccattatcagctgtcttgttaagtgcccctagcattctcatattgaagtcctgcagtgccacataaaataagtcctggggaagatctgaccccaccttgtgaatttctctgggctttgccttatttccccttctcattcatcaactgaatgggtttcctgaccccacaggcaagtgaaacttggtttctcactttccttgtttcctttgcatttcaaaacttagctctagactattcaatctcaatgttatcttaaacccctatagtatctggggtttgctcatattttctactggctgcaagctcaaaattggtgtaccagagcgctttctaacatagcccagtcctccaacacacctagaaacacacctgcctaccttctccccctggccttcctgccttccttcctccccccacctttcagggagattgtacattttcatcatctccactgaaatgattactaatattatcaaatgattattgggtccttatttgcagacgttatgagtatatggaaatataagtctagcctttacttaagacaatacctgagattttagtgattttatctccaaagcagtgatgttaatgtttacttttaatgatgaaatgttaaataatctccatgagggtcatgactagacaaccatccaaagagagaagggtctagcagtagaaagagcagaggctttagactcaaacctgccatcactgtgagatcctgagacaccatccctgtgcgtgttccctcctcttacgggggtgaaagtcacccacatcatagactgggctggagaattaaatgactaaacatttacaaaagtgctatatgttgtcaataattgttagtctccctccctcagtgccatgtctatgaaagtagaataagtcaataattttgttcagcccaataactaattaattcaaaaagctaattttatctttccttgcccattgatttgatcaagagtataaaaaataaacaagttgacatttcattttcttcaacatgaattcccgtttgaaaagagttaatgccttatagctatttatgctcatattggtgactaatatcaactttctgtatttcccactatatttggctaattgaaaaatttatcaactgaatccaactaactctaaaaatatatattaattaagaacattaaactcatacgaccctttactttgagtattgttgccttctgttgaggcctaactttatagagttttaatgcagttatttgttcctgagaataaaattaaaatttgggtacatcacaaaatgtattctttcagaaatataatttttacaccacatgctctgaggagtttttttttaatttctgttatgagtctcatatttttgaactacctctccctaagaactctggtacattactggaattagcatcagtaggcaaaattccctatccaaatgcataacacaggtggcatacctgttctttatcttacttgggagaggaaacctgatcccttgctttgtgctgactgctactcagatcacagacacacttgttaaaggactataatgtgattcagctcaaccattaatttatgagataataaatttaccactttattcaaacaatattagatttcctaaatacacacaagcatttacacatcataaattcaccactaaaaccacaaacattcttgtactagaaagttgatattacaggtaaatggggctggcatttcacatatatgtattttttcaattcataaggggatgttttacacattccaaaatgtctgaaaagaaaataaaaatattctttagaatttttatgaagctatatttttcttcctttgaaattgctaaatgctttatgcattctgatttaaatgccttttggaattgggatttctgaagtttatagatgcatttacctttatgactaaaaatctctcagaaacttatataaaatacatattttgtatttttaaattatgagaacagcataggagaatagtgtatataatatgtaaagttattccctggggtccagagaggcttggtttctaggcctcccatggataccaaaatccaaggacactcaagttcccgatataaaatggcatataacctatgtacatcctcctgtatattttaaattaactctaaattacttatacctaatacaaggtaaatattatgtaaatagctgttccactgtattgtataggtaataatgacaataaaaaagtctgtacatgttcaatacaaatgcaattttttaaaaaatattttccatccatggttttttgaatctacagatgcagaatccatggataccaacgatacaaaagaagattctgcaacccccttttatctgaaggaaaaacaaaatcagagaccatacttctagtttttttttctgtcatctgaaagcttgtaggaattcatctaagtctgtaggttatctcattagttaatttgttcttataccctaactaaattcaaacacaaaataggaatttttataaaaataacaaaagcacagtaattgaaagtgcctttaataaactggatgccttgtgacattttatctttcaataatatacaacttatttatatttatttaggttcttttttcattttatttaacttttgttgcatggatttctaaagttcttcatcatctcaatagcaatgatgttattaaaatagctacgccacatttaaggataatttgtaatgttaccttataagaacaaatgatcaaattatctcattggagaggaggaaaaaaataacactttattggcccattgtcaagttcattgattgtatatcaacaaaagaaaactattatctgagggccaatatccaattaaatatgctagcatgcatgtgaaaatgcattatccaggagagaataattaattcaaagctcgaaggagtcatgacaccagaaatctatttttgaaatagtcatacaatttgggtgcgagggaaggatatgataagcaaaaaaagaaaataaaagaaaaccatattgctttaactgtacagaatcatataaataaaaatgactaaggaacaaaaataaggactcttgttctggagatgagtagtagtgatggttgttcaacaaggtgaatgcacttcacatcacgaaactcaaaaataattaaaatgacatattctgttatgtatattttactgtaatttaaaaaaaagaagttaaataaataaataaataatggttctggatatttccagataacaaaccaccaaaaagcaaatacaaaaatggcttagacatcgttgctctgttgaaagatacttatttctccttgcacaaaatattacagtgtagaacattaatgtctccctgaaacatgtggctagaaaagaagcattagcctgttgtgtaggccaaatttaatttgagtaattatgttcttgctacctcgaagtcccttgaagtctctcataatctgtgtcccttctatgcttaatctatttacagcagtctgtggcctttcgagtaatcattaccatctgcccctaaggtagctgcatttcagcagaagggatcatgatttctgtattttagaagtacccaacatgaacaattattcccctgaaggtagatgatacaaatatatacgagatcacctgtgaaataaatgaaaaatcttcataaaaatgggtcatttttagtagtgataatattaatttcccattcctcctatctcctgaagtttgtttaaactgacacttttccatgatgaaggtatatttcgaaaataaataaataaataaaagcattatataccacacttttctgtaacatgggtgtgatatgatttttttaaataatacatttatatttttaaaataaacttttatcaggtgctaaaatatattttttgtttagttttgtaaactgggttgcctaagtaccactgattaattttaataacacttcttctttccctcattgtgtttctagaaagagccaactctatccacaaaaagaaggggagcatcttgtatgacatagaagcctccagataccttcctactgctctggcacaaggcagagaaattcccactattagcataactatttggattaaccacaagattatgtgtaaaatgcaaaagaattattgctttgggaagttaacccactaatttgttcatatattagcacagacaactttatctgttaaataactcaatgcaggattctgatgggatggggcatatagacaagtaggtttatttagaaaggcagcctagagtactggaaggggatgctgggtggacatgtattgtaggtcagccagaagtcactagagaatggaatggagtaccatagagagggccagcaggataaaaagcaattgtcaagtataaatcactaggatgtacctaagataacattcgcctgtgatgtaacttagtctatcttgcttcttaggtgtatttatagaaggtagggcactacagaacaagtcagaaacatcccagtctagacaccctggagccactcattctctccctgaatatactataccaggttcttcaccaagtaatttctgtaagttgtcccatgtatctttcctttgactgtgggcccagtttcactggccttctgggcaccccactgccacttctgtactctacttcaacctcactgcattttccacctcacgtgccactgaatctcaccacacaatctactctagccacgtggtccactggagctacacgctggcttccccagggacatccactctcccaaaattgctcaagcacttcaaacaacctaaaatgcgtatctgtcttttcttctgctatgaaactctgaatcttctttcaagtgcttgtccagatgccacttccttggcatgctcttttcctgccattcggaagtaactttaacactttgcttgcatctctctttagggcatctattttattttgcatggaagtgcatctactgaccacatagtacatatgaggtcacaaattgtaagaggtaaggatgtatcctcccatcccctggcatagtgccttacccaaagcagatgcttaacaaccatttattaaatttatttccagcagtgtggggtccaaaggcccaaagggggagttatttgagagtgcaaaggggcaaatagaagggacatgaagacaattccataggcttatctctcggcttctttgtacctttctgatagttttcttaattttcagtctcattacattagtaggggtcataacagtgctggaagccagtctccagcaggactagctcattctggagtcacagccaagcaagaagaggcaaagttaggacatttcttccctgcaagcctaggaagggtattgtttcaaaaagcaaaaagtgaaattacactaaactaaagtagcatgacaaagattaaaataggggacaacaatattgggattaatactgatcacgattaaatgaataatgtagcaatacctggattttcattagccagttctggcagtaataattttgtgttcagcagactcagaagctgtggtgtgaatgagactaacaactaagcactctctagttggatgatgtgaagaatcatttaccacatcttgctgaagaacattacaggttataaaaatgtcatctagaccatgcagacaagcccatctgtatttaaggctgaattcctttgaaataaaagcactccatgtggttcaaatgggtctgtgatttcaaatgtcagaaaactcttaacacataaccagaacacacagaccataatagggcaatcgaaggaatgtgagatatgaaatctttccaatagtctcacttagagcctaactcatcaaaagagtccattttatacataaagataaaagagaatgttttaagaattttataacatatcaatataattaatcagaacctatgatagcctttagtgcaattaatggctggagttctagttcatgaggtgttaagaaggagaggtcaagatatttatgattgtcattggataccatatgccacgtgtgggagagagggaggtggagtgttttatgagaataaactagaataactaaggataaaatattatttcaaactgagggaaaacaaagctagtttattttctagaattatatcaatgagctagattgatgtttgagatgaaatcaactactttaatacctatgcatattgatttatgtataaaactatgcatttatatattgatttatgtataaaagtatgcatttatattatcaatctctctctctgtcagtatggacaaagaatatatattagggtgggtgcatatatattttctgcagtttttgagcctagaggaaatcaggagtaaagctgtctggttggatttcttgacaacgtatgtctactcccctccttccatccctgtcattttctgaaactagagtagttgttctggaccttccccccctcctacccaatcttccttcttcctttctgctctctccctgtctcctgatttcactttctttatttcaggtgtatacaggtgggaaagctcatgagaagagcgtccctatctgaattatattttgctacccttcttgccatatcaaacccaaaataactgaaagaacatactgctcggtaatatgtcattaaaaagtgaattacctctaaccaagagggtgtttaattatctagtgtgaatcaatatattctactattattagcactttttaaagaaaattggtataaatgcaccataaaatgtcataatcacttgctttatacactactactttggtcactgacaaaagcctgcatagttaacatcagcttatatttcattttgaatcatattcttcaagagctctgttagcaatgggaatactttactttttaaaagtttctcttgcctatatttatgtgctctctttgtccccagtgcaatggtctgtgactattcaataaaatcttttaaactgaccatctactgttctgaacccaaaacaaagaaaaagtctgcaaatctgtgggataaatttaggttggcttaagctctagaataacacatacttttagtccaataaaaagaaactcactatgagtaagcgtcagtgacttcaagaagcttacctttatttggtaagaaagacacaaatactattaatcaaaataaagaaaaaaatagtatgtgacatggagtaagcatggtgcagagtggcccttgggggagaaagagcaagatcatttctgctgagcacatgagaaagcttctttgagaaactattcactgttttgttccagctaccatatggagaagctttcttacattattccatttaatcctcacatccctgacaagtagggagttttactatttcatgatgagaaaaataaagcttagaaaaattcattaatttagtgaaaaaaattacccatggccactaatccacaggcctctttctacaccactacatgatcttgcagcagagactggagggtgggtgggatttggaaaggtaaaatgggcagagtagacaacatcagctgaggcacaaaggtatgaggatccaaagcacatgtctcttgtggcaaaattgttcttttttatctgaaaaaaagaaaacttctccacactttaacctcctgtcttccagttacacctcattggcaagactgtcatgggagctcctctaactagaacttgggtgggcacactgctatcccaaagtaaattagactgtattcagccatacaaaatgagtagatattgggtaggcactagcatcgtctgtcataaagggtcagccacataggaagcactgaataaatggtagctcttcattattgttactatatctcattagtctaaagaacacatttcctacacacaaacatttcttaatgagtatatattttacagtggttgtgaggagcacattgcacaactcggctttgtgctgaaggtatttgatgctcatccctgtgtcactttcactggaagcaccacacatcattagactttacatttttatttctaattgtgatttaaaatgtcatcaaaaaagatgatactgtaggccaggggcggtggttcacgcctgtaatcccagcactttgggaggctgaggcgggcagatcacaaggtcaggagatcaagaccatcctggctaacacggtgaaaccccatctctactaaaaataccaaaaacattagccgggagtgctggcggacgcctgtagtcccagctacttgggaggctaaggcgggagaatagtgtgaacctgggaggcagatcttgcagtgagccgagatcatgccactgccctccagcctgggtgacagagcgagactccatctaaaaaaaataataataataacaataataataataatgctgtaatacaacattcaagcaaagggttgttacaccaaatacgatagagatagagttgaagaaagcagatttcctttaagaggcagtgttgctagtggtcaaaaacacacttgctggaatcagaagcttccgatctagttcttccactcaagagccaggtgattctggggaagttactttctctcctgtttcttatccataaaatgggggtgacaatagggtaagtgtaaggattacatgagttaatattaatgagtgccaacaattgtgtttggcacataggaagtgcttaataaatgttaactatcattgttagtaataatgttggaagcaggccaggtgcagtggctcaagcctataatcccagcatgttgggagggtgaggagggtggattgtttgagcataggaatttgagaccagcctgggcaacatggcaagacccgtctctaccaaaatacaaaaaaatggctgggcatggtgaagcatgcctgtggtcccagctacttgggaggctgaggtagaaagatggcttgagccccatggggcagaagtttcagtgagctgagattgtgccactgtactccagcatgggtgacagagtgagaacttgtctcaaaaaaaaaaaaaaaaaaaaaaaaaaaaaatatatatatatatatatatatatatatatatatatagtttgaagcaatgatcactgtaggtaaaaaaaaaaaatgtgtattatcatgttataaatccaacatcaagtggtttccaatttttaagaaagaatatatacacatataattaaaaccttgtgtatatttatatgtgtgtatatgtccatgtatatgtatagctattaaatttaaaaaatcacctaatatgcatgcgaaaggataattaaaagcaacagaatttgtcaaatatcctggaatatcataggattttaaaaactacgagaagttccagagatccactgtgtttaattaaagactaaaactcaattactgtcaaaaacttccagctgatgttcaagaaaaactgtttaatatccagcagtatctacttctattatggaaaatttaaaactaggaattcaacaaaataggaaatgccaacaaaacctggtattcttccctatgcttcaacattattctgtcaaagctaaggcaagtgaagaggtcaagatcagaagcacaggctttggaaagtcactcaacagtgggtcaccgaaggtcgtgcagaatgcacagactatatatatgataaaggcttagactgaacttttgatcatgatacagaagagtctagtcaaataaaatcatttgaataaatgtatgaaaaagtgggtttggttaaaaggaaatcatgtacatttaatgtagagtttcgtcttttgcagaaatatgcttctaaagtcgatggtgaatcttacattagatggtatcttggatctatgttgtgattccaaaatttgtccttcagtgctaactgtgaatcaatcagtccaaactttatttgtggaatgaagtttaatattaaaatatatcgtattttcaaatttaaacataaagtttgaatcataaatgcctcatgtcaacagcggcctcatactttactcataaatattccctctttcattataatttggttgggtttttgaaaggaatgtagacaaagtgtgagaactcacatcatcccttggcttttatgctttaagatctaattttcaaggcttaaatatgtctgatgccgtgaccatatggcagtgttttccatggatagaaatgatacatccccaaggacagaagtcatgctgcaaaagaggatggttttcctcctattgaaaattagtctattcaatcaaaatctcatgaaaacattggctagttttctgtgtatagctcgcacttcacttaccagactgttgcctaaatcttccctattctggaagactgtatatacagtgcaagtattatatgatataaccaatttccaaatgctttctaattcccacagtggggaaagaacaactggcaacacagtgaattatttcagtttaacagctgattatcaagacaaataactggatattgtctgcagtgacaaccatgaccagggtccagggaaccacactcagaaaaggtcataatagataaccattttcccaaaaggaagaattattctctgtgaggatactaatgtctccctgttctgagttctgttcagtctacagtccattctctacactctccccagtgttattgaaactgcctttgcaaaatcatgatagcaagagaagtccgacagtgttgacgccatcttacttctgacctctgaggtgtccttggtcattcccgggcataggccaagctaacttttgaaggaatttagtttatagtttaacttgaaagctaggacgatactagtctccccttaaaactaaccctttccttgctcagggaccaaaaaccacctttgttagactaataaaaggccacaagaataggattatgggaggaacctgaactcttctgagatgtaggcatagtttctctaatctcttactgctctggagtcatgtggccagaagtcacaagatctctgacttctccaattgctcctatagataacatcattattgtagaacctaagattggtttttgagtactttttcagatgaatcccaccaaaacttgtgactcatgactcaactggccccatggccccacccagaggaagactcagcacacaaaggctgttttccacacccctatgattttattcccaaccaatcaacagcatcaattccctagccccctgcccaccaaacagtccataaaaaccctagcctccaagctattagggaggttgagtgatagctccagttctcccacatgggctgaactcatgtcagttaaactctatactgcaatagcaccatctcaattgattaattttgtctatgcagtgaacaggaagaacccattgagtgaccacattacaagtttaaaatgtttttctggtgagggaaagagaaataaaacatggcttgtctgattagtactaagtagtacttcaacttcatgatcattagtattcaaaagacttcaacactgcctgggaatctcactagatttcttagccatctggctctctctcactcggctcaacaaatagtgcccctcttctacctcctactaaatctcagtttccatttgccttttgcctcagctgatgaacttaccctatattttaccagggaaaatagaagtcatacaccatagcccctacttttattccacaactgaattttcaaggtcttttactcaccccctccctctctgtctctagagctgaagtagagagaaagtgttacattaagggtcaatcccactgcactctggtcatcatccctccacatgcccaggggcctctattcacaagttattatgtcttactgctttcttaacctcttcttccctgccaacacttaacctatctgcattcaaatgcagattggtttactttaggattaaaggaagaagtgacttcagggtggaagagagagaagaagaaaaggaagagagaaggagggaaagaaggaaggaaggaaggaaggaaggaaggaaggaaggaaggaaagaaggaaggaaggaagaaaggaaggaaggaagttcctttgataccctgatccttcttcagctaccaccgtatctttctacttttcttttcagccaaaggtctcaaaaaagttacctaaaagactatctccactcactaacccatcttccttcatccttcatccctctgtaatttcctccctctctcagcattgaaacttccatttcaaaggctacaaattgtgtccatgttgccaaaccaggagaggcttatcagttcttcctcacaatggcctctcagctgtgtgataccacccacatgcttaagagaaggcattctgcaggcttaggtaagtctgaatccaaggctcaccacacactggatttatctataaacttttaaacctcctcatcaataaaatgaggatagcaattattttcctccattggctttttgtagtgattaaatgatataatccatgtaaagtgcttaatcttgtacttggcacatagcaaagattctacagttgtcagtttttatagctggtaatactcttggtgttattcttctgtaattgttctctcatgttgcatttcattaaacaacactctccagaggaagagagatggttgtcccatttcctgcatacagtggccagggctggtgctatatttactttgagccatcatgattttgcccaggggtggcagcaatgttgtctttctcagatgacttttagggggtgattctagggccttgttcccagtgggtaatgctggaaggtctgcaaacttcacagtatcttttaataaatctcctttaggagccaagcacagtggtgcatgcgtgcagtcccagctactcaggaagtgaggtgggaagattgcttgagccccacagcttaaggccagcctatgcaacacagcaagacccccctaaatcaacaaatgtataagcacatttattgtgaaggatttagggggatcttgctctctacataaatagatggatagatagatagatagatagatagatagatagatagatagatagatagatatagatatagatagatataaatagatatataaatatatctatttatatatctatatatcttacgagttaaatttgccatatttggcttttattgcttgcaatgaaaaattctagtcaaatatctaactcagcctattcccttcttcaaatttcagattcatatattcaactacgcccctgacattccaactcagatatttcatagccatcacaaattaaaaaatgcagaaatgaactatcaagctccctctcctccattccaaaccacttgcctcttagcatatggaaacaccatccagagttgcttacatgaagaatctggagccatcattgaaagctctctctttatacattttccaagtggtcagttttgcctcaaaatacacttcaaatttgtccactcatttctctctgcatttgttaccaccttaagttgaatcaccattatctcacaaatgcaccgaaacatctgcttgtaaaatgtctcacccttttcccatgttgttctcttccaatgcattttcttcatagcaaactaaatttctagaaacaaaatcatgtaattaccttaatcaaaattcttcaatggtgtgccattgtacattggaagaaatccaaagtttttactatcacttccaaaacaatgaacaatttagattctggctagctccttagctgcatcatatgtgccatctcacattcaattctccaggatcctacctcatttcacctccttaaaaccgataggcttttctgttttgggacctttgcacaagctgtttactctgccaggaaggtgctgcccacctgatctgacctcattgcaaacttcagagagacctttttatcctgtcagtgtcaccaaagagtccttattacactctctcaagccatcccctatatacctatcatagttcacagaaatcactgatttttaatgtgattattatctatcctccctatctgtctgattttcattaaaattgtcattttagtaaaaattttctgattttcataagaaatgacaattgttctattttatctatctctagtattttatgcctaatgtagtgccaggtacacagagttgctgttcaaaaatatctgttcaatgtttgaattaattattttcaatcacaacacccatgattcctctgtggtctgtagtagttttctttgtgcagtgtctgtcacagctctaaagagaagggtaagaacaatagaactgtctaacaggacagattcattagctgagattcaaaaccaaaaggcaaatctggctaatttctcagatgactggatgcatttatgcttttggatcagggatgacatttgctgatagataccaacaagttgcatatctagaaactccattatctgaaacatacacacaaactcaaacagaaaaatttactatgatttaaatatctttaaatgaacaaatgctgaacgacactgatattaagacctatttattagagcaatataatccttagatgaagaatatagggaaacaccatattcccaccatatttactggagtagttatctttacttctgtggcatccctacagtgatgatataatttggagacttcatttgccagtcatttacgaaatggctgtgagaagaaagtctcatgatcatagactcacttttagaagctatgttagcttggtgcatttcttagtcaagtacatcacactatcttaatctatgtctaaaaaatgtggatcccaaatgtgaattatctattataaatgtgataacagagacaaaggagggagatccacttaagagggtatgatggttaataccgagtgtcaacttgattggattgaaggatgcaaggtattgactctgggtgggtctgtgagggtgttgccaaaggagattaacattgaatcagtgggctgtgaaaggcagacccacccttaatatgggtggccaccatctaatcagctgccagcacagccagaatataaagcaggcagaaaaacatgaaaagactagactggcttagcctcccagcctacatctttctcccatgctggatgcttcctgtcctcaaatatcggactccaagttcttcagctttgggactcagactggcttccttgcttctcagcttgcagagagcctgttgagggacattgtgattgtgtgagttaatactctttaataaactgtcttttatatatatatctatcctattagttctgtccctccagagaaccttgactaatacagattttggtacctggagtggagtcagtagagacattccttctaaggtgaaggataagttgctgcatttggcccctcctacaaccaagaaagaggcacagcgcctaatgggcctatttgatttggaggcaatacattcctcagttggatgtgttactttggcccatttatcgagtgacccaaaaggctgccagttttgagtggtgtccagaacaggagaaggctctgcaacaggtacaggctgctgtgcaagctgctctgccacttgggccatatgacccaggagatccaatggtgcctgaggtatcaggagaagatacggattgtatttggagcctttggcaggctcccacaggtgaatcacagcagaggcctctaggattttggaacaaggctctgccatctcctgcagataactactctccttttgagagatagctcttgtcccgttactgggctttggtggaaactgaatatttgactatgggtcatcaagtcaccacgtctgcctatcacttgaactgcctatcatgaactgggtgctttctgacccacctactcacaaagtgggtcatgtccacagcattccatcatcaaatggaagtagtatatatgtgattgggtttgagcaggtcctgaagttatatgaggaaatggctcaaatgcccatggtccccagtcctgccaccctgccttctctcacccagcctgcaccaatggcctcatggggagttccctataatcagttgacagaggaagagaagaccagggcctcgttcacagatggttctgcacaatatgcaggcaccacccaaaagaggacagctgtagcattatagcccctttctaggatatccctgaaggacagcagtgaagggaaatcttcccctgtgggcagaacttcaagcagtgcatctggatgtgcactttgcatggaaggagaaatggccagatgtgtgattatatactgattgatgggctgtagccagtggtttggctggatggtcagggacttggaagaagcatgattggaaaattggcaacaaagaaatttggggaagagttatgtgaatagacctctctgagtggtcaaaaactctgaagatatttgtatcccaagtgagcgctcaccaacaggtgacttcagcagaggaggattttaataatcaagtggacaggataacccattcaatggataccactcagcctctttccccagccacccccgtcatcacccaatgggcccataaacaaagtggccattgtggcagggatggaggttacgcatgggctcagcaacatggacttccactcaccaaggctgacctagctacagccactgctgagtgcccgatttgccagaagcagagactgatgctgagccctcaatatggcaccattccttgaggtgatcagccatctacctggtggcaggttgattatattggacctgttccatcacggaaagggcagaggtttgtcctcactggaatagacatgtactccagatatgagtttgcctgtcctgcacacaatgcttctgccaagactaccatccatggactcacagaatgcccggtccactgtcatggtatcccacacagcattgcctctgaccaaggcactcactttgtggccaaagaagtgtggcagtgggctcatgctcatggaattcactggtcttaccatgttccccatcatcctgaagcagctggattgacagaatggcagaatggccttttgaagtcacaattaaaatgccaactaggtgacaatactttgcagggctggggcaaagtcctctggaaggctgtgtatgctctgaatcggcgtcctatatatggtactgtttctcccatagccaagattcactggtccaggaatcaaggggtggaagtcgaagtggcagcactcaccatcacccttagtgatccaccagcaaaatttttgcttcctggtaccgcgacattatgttctgctcgcctagaggtcttagttccagagggaggaatgctgccaccaggaaacacaacaataattccattaaactggatgttaagattgccacctggacactttgggctcctcctacctttaagtcaacaggctaagaagggagttacagtgttagctggggtgactgacccagactatcaagatgaaatcagtctactgctccacaatgaaggtaaagaagagtatgcatggaatacagtagatcaattgcggcgtctcttagtattaccatgccctgtgattcaggtcaatgggaaactacaacagcccaatccaggcaggactacaaatggccaagacccttcaggaatgaaggtttgggtgactccaccaggaaaaaaccatgacctgctggggtgcttgctgaaggcaaagggaatacagaatgggtagaaggtagtcatcaataccagctacgaccatgtgaccagttgcagaaacgaggactgtaattgtcatgagtatttcctccttcttttggtaaaaccatgtttgtgtatgtatacacctgtactaaggaaatatgttcattttatttcctttttcttttaacatgtgacatcagatttacttcatattagcgtttaagtatcgttagctttatgtaatagcatttgggttggggattggtgcatttctggttgtacgaaggatagctgcattatgttacgtgtaattatgaccttattattgtctttatttgaagataatgtgtgatctcagatgcgtatgggttcaagtcgacaaggcgtagacttacaatgattaatactgagtgtcaacttgattggattgaaggatgcaacatattgatactgggtgtgtctgtgagggtgttgccaaaggagactaacatttgagtaagtggactgggaaaggcagacctaccttcatctgggtgacaaagagggtgacaaagaaatcatctggtgggcaccatctaatcagctgccagcatggccagaatataaagcaggcagaaaaatgtgaaaagactagactggcttagcctccaatcctacatctttctcccatgctggatgcttcctgccctcgaacatgagactccaagttcttcagctttggggctcaaactggcttccttgcttctcaacttgcagacagcctattgtgggacctttgattgtgtgagttaattccttaataaactcccctttatatatgtatatatatcctattagttacatcactctaaagaaccctgaccaatacagaaggcttacactctttattctaacaggcttaaggctaactctatatgtctccttcccaatgtcaggaatctctgtagcttagaggaacagttttcctcagtgacatatgtaactcagtgattagtcacaggaacactgacctcatcacaataaaatagggatctccctattttaagatccccctaaggaataaagagctatgcactttagggaaaactctataaaacgtgtgagaatcaaaagagttcaaaaatggccaaaaccagccaggcaagatagtgagaatacatgtctacagaaacattttttaaatagcaaggtgtgttggtacatgcctgtagtcccaactattagggaggctgaggtggaggatcacttgatcccaggagtttgaggctgcagtgagctacgattgccactgcactccatcctgggtgacagagtgagatcctgtctccaaaaaaaaaaaaaaaaggcaaggagagggtgatccttactaaaacaggcaattcaatattcaattagggggattcattcaaaccatttatttcacagaaatggccaaataagtggccttgttaataagaagataaaaccctttcctttttgcattaaaataactgattttgtctcaaattatattaaataaggtaactacaacagaaataagaagaaaattacattgattgtatagacaagaattagtttctgaaagcacataaacctttacagaaaatacgcttactttatcaaagtggttcagttttcagctgcttctatggcttacaacaaaaaagggattctgttacatatggaaacttcaaaaatcacaaagctcaaataaaaataatagtccagggcaattaatctggaacaagaatacccatgaatactctgggtatttgttttaatgcacttcagttcaatagtgttgttttctttctcatcaaagagcaaactatatttctatttatcatcttcagaagtagtaacagagcctatcctggtaatatgcattgtggggaagaagaggatacaattgaacacaaggctatttcaaataatagaaaagatacctttaataattggcaggagatcttataacacaaactataaacaactgctggatttgaaagtcacaaaagcatagtcctagagtccatatcgtgggatcataagacagttacagctttccctagagtcaagaggaaatgtcatccattagaattcaagtgaactctctatatacccatttatagaaataactagacccctaagcagattcaggtacattcttcttattcttctacatctggccctgaattaggtgaggtgacaagtgtgatttttcagaccaactcatggtctttctggcttatggttatactgatcgcccctggtgacttgtgtgtgaacaaacctcagagcattcaaatccctgggttctgctctggctctgctagtatcctgctctgcaaacttaacctctctgggctttcatttctttatcttcaaattgaagaaaaatgtgatactttatccttaaggtcaacctctagttccaaattcttaatcagaaaaattatggcaggcttatggtctacagaattaaaatcaaagagccttgctgaggtaagcgacaacatttgcaaaggacaatgtaaggttcattttcttctagcccgaatgaattgtacccagtatttatgtggacttgaaaactataagtgtttttaataaattaaatctaaaatgaaggcatttaaaattattagcggcttatcagcatgaaacacaaagaacactgaagtgggagatttttccagtgaaactcatcattaaactttcaataacaatgtcatcatttcttttcccttctgtgatcacaccatctcccaggcacaattttaggtttaacagtcttaaaaccaggtaagactagggaagctgagcaggcaaatcaaatgattaagttttaaaaagttttataggtatttaagccttgggaaagcttaattaatgaagaatttaaaacaggagtgaaaattaaagcagtaggaaatattcaagaaaaaaattactatgccattgaaaaaattcaggaagagccacagggaactaatgcaaataatcattgactggaggaaatgtctctggcaaatgcaagaagtgacccaaagaaacagaactgagaaaatttggccagaaaagtaaaaaaagaacatacataaaatggatggtacaacattgcttttatttttcaggaagaaaatgtgattgattctgcgtaaaggtgcttttcataacttttatattgtcataaagacaataataatatccttagctcttcatattcctttgccagtctatcattcactcatgttttcaatgtaatattcagaacccactgtatcagatcatctggttgagttccataccaccatcttctctatccacttatcctatgagatcccagttgcatcccataatctttttaaatataatggaaaatttaaaacatttcatctgatatagtttgactctgtatccccacctaaatctcatctcgaattatcatccccatgtgttgagggagagatctgatgggaggtgattgcattatggtctttctctctctctctctctctctgttgctgtctctctctctcagtctcagtatctttatagcagtgttaaaacggactaataaatcatccttcttggtctcaactactggtcattcatcttaaaccatgcttatctctgatggatactatctagaaataaacacatgagatgacattttcttggatatctcattacaaacatattaggcatctgaatcagtattattgttttaatttatcaaataatgtccaaaattatgatggaaacaaaatagctggtccaaatctaaagaagatattttacttgcttaatcacaaggattatttaaaacatccacatgtggtttaactgactcccaaggtagatacatttccaaagcatgacacaagggaaagatatagcattaaaatcacattccagggtacctatatttatagaaacacacagaaaatgggctaatctttgcactttctcctattgagagaaatagatattctactcaaccctttcttcatagctggtaatgtaacataaataataaaatttatcttaaattgcctaccaatcatcaaattcagggaactgtccactgaacttttagtattggctttccatttgttggggaggggaagagtggggttacaaattatagactagaaataataacaataaaataattccaaggggcattaaatgccagagttctggggatttggagattggggtaagataactagagtaacttgctgactgtgccccacacatcctttccttctggtagtcaaaacagtgagaaatgtgaaggaggggcttaggcaaaagccagccttgacggcctggggcatcttattggcatttgaattggtgagagagctaacagtttccactcctcctcatgttattttggaagcaagacctaccaaacaggccaggcacagtggctcactcctgtaaacctagcactttgggaggccaaggcgggcggatcgcaaggtcaggagatcgagaccaacctgaccaacatggtttctactaaaaatacaaaaattagccaggtttggtggcacgtgcctgtaatcccaagctgctcaggaggctgaggcaggagaatcgcttgaacctgggaggcggaagctgcagtgagccgagattgtgccactgcactctagcctagatgacaaagcaagactctgtctcaaaaataaaaaaataaaaaaacaaaagacctaccaaacagaaccacagccactaaaagaagatcagagttaacagttggacagagaggggttatttctgcatgttggagatgcttgtgttcacagagtagctgtgtttatcattaataataataataataaaaagttatgcctctcatcagtaagcatagcctttaaaagctaggcatattcagggaaacaaattcatccacttctgacatcggttgcagggtcttacctctggcaacagattaatgcattagcaaggaacccaaatgaaaagtgcttatgtagacagcacaatggctgtgatttagtaatgttcgtacagcaatttatatttactgagtgctacaatggtttctattatttattcttcaagagaaatccatgaggtactgtcttcatttttttaggtgaggaaaataaggcatagggaaattaatatggaatcacagagatcaagtcaggttgtgcctgtacacacaaaaataaccttttagaaaggaaaaatgagcttaagttacgagatcaagtcaggttgtgcctgtacacacaaaaataaccttttagaaaggaaaaatgagcttaagttacttgcttgacattaaatattacattggtgcaaaagtaattgtggtttttaattgtggtgaaaaccgcaaatactcttgtaccaacctaatagagcagtggacactgacatattttcttagcagtaaaaacaacccccccccaaaaaagtcacatacaattccaatttacaaacaagataacaattacacagcattagtaaaccaaatataaatttctaacgtttactaattattagggcaatcaatgctttaggaacataaactttgaaatcagagggcatgtataatagttccaagcttctatcactctcagcttctgtgaatttcagaacttctgaactccagagtctgcaggctttaggaagaaagtgtttgcctaaacataacaggtcaaaagtataaattcagtaaaactactttgtttgcataaacctaatgacatagtgtgtatgctgggaatgtacttgaacctttgaattcagttgtttaattagtgagctattgtggtgggggtggagtgagtggggaaacccacagaggaggagcctccgctgagtgatttaaagcgtgcaggaaagaaggcctgtggcctgtgtatgcatagggggagctcctccctaatcctcattatagatttgtgttctctaaagccggaaacgacaaactaaaattaagtaaagagatgctaacggttatattaatttttaaagaagaaacaacagcctgcagctgatgatgtgttggctggaatggcctgagccgctgggaaagaatttaatggaactagagcttttaaaagtcatatgagttcaaaaggggaaacaggaaaaataaataaagagaagtaggcagaaagaacaggtgagattcagctgagtgaagttgatggcataacatatgctgaggccacacatttccaacaacagtccatcagccatgagctgagttatggctcccagagtcatggaaagcagttctgaacagaagctaaatgttggtgaactcaaattccaaaaagaataaagtcatgcttctccagagaccaaagagaagataaagaaaatggcctggccttatacttgagggagaaagcaaaatgatttacaaagaacagaactagtgattggaaccaatgagtaggactggatgagcagagaataggatctaaaactggcagtcttggaaggagcctaagagagcatcgaatccaagaagtttggggatgataaatgtgaggcacatgtatcacctgttatctatgtccacagtccactcaatactgcaacctggtccaagatgaatcctgtggcattgggtttatctgttaacagtttataagaagaccacattctagatcaactggagcaaaatacttcaactttttacaccagggaaccagggatgatgtatgtgctctaaggaactggaatggaggaatatactttatgtaaagaaggaagaccagaaatcccaatattagattggaaaaaaaatcctcttcgtcttctgccgggcccgcccagcagaccctggccaaatgacagatgaaaaaacgtacacagacacaggtgttttgcctggccgcgcggctaggggaccgagccactcacagacatcaaggaggatgccgtaaagagtcacagaggccgcagccttgacaagcggccgctacagtcatttattcagtacagatataaagacaaaggccttgaggcaacacacttgtaggtaattaatatggttgcgccccgccccccgccccgcccccaggttcagaggcctaagtaaactaacttaccttgatcaattctcttacacttccttgttatctactcttagagaattcagctgccttcagcccaatcctttcccaaagcttctgcaaaacctcccagccttccaggaatgtttccatctttctataatttttcccaccaccctgaccgatctcctacaatctccaaaattgtgaaatagaaaatcaagctattacaagtggcagggggaacctacctgtggtggcatttctgttaaataataatgtgtacgtgattgagctttgtaaactaaaaataactagaaaagggaagtgatgctctggagtggctttagatttgagtgtttacttcactatacatacatatttttttcctaaatacaaatatgatacgtccatttagaatatttggaaaacagaagtgaaagattttttaaagagagagagaaatattcaaccataataagccttccacttagaactgatcactgttaacaatttggtgcactacatactagtatttaattcatatgcagatctgtgccttgtttataaataaaagtgagacccttttcctttctttttacttggcaatacattgtgtgctttgccatttcattttattcttaaaacattaaagactgcattaaattctactgcttttcatcaattctctaaagttaaaaacttaggtctttgtatttccactatttcaaataaaagtgtggattgatatccttgattttgtttgcatttatttgtgtgctagtaagactaatcatttttcatgttttgggccatttacacttcttttgtatattggtttcatgttactgtccatttttttcctagagtattaagctttttaaaagacctctttacattaaatatattaatccatcctctgtcatatacatttaaaatatcattgatttgtcttatttcatttaaggtattttcttcaagaggggaggcctttagtttttatgtagctaaattttttccttcatggcttttgtttttggtgacaagttttgaaagatctctgtgctgcaactacatatacatattcagcagtagttccatttagttcttttaacgagcattgtttaaaagcgtggggactggaagccattcctaacactgaccttaatcttatgatctattctgcctccactgatctatgattaatctgatctgtgctttaatttctttatcataaaactaataagtagtactagtatttgcctcacagagcagttaaaagtagtaaactggataatctatataaagtgcaaggcataatatctggcacataataaataataaatgctagggattatttaactccctaatatctacgaacattattttagagactatgatacaaataaatctaagtttaattttctccaaatttgtgccaacactatattttgaataaaacatattgtgtctcactaattttatatgccacttctattatatactaaatgattacaggtgtttggatacatgtctacactttttattgaagtctactgatttccctggctagtaatataagtctactacaatattaaaatcagtatggctgaataatattttaattacttttagtgcaattatccgtccttaattattcttttctcagaaaatacccctgactaatcaggctgccaaaacttctggttaaagttccaagagggaattaacaaaagtatatgaaactgtcattcttataacgagcactacctttaaatattttttgggaaagtccaaggtgaacttttctgcccaaattatatttcacaccaatcacttcctagtttctgtccagtaaagtataaatgtataagggtcagtatcaactgtcaaaacaaatcaggtttttcgactgaactcattgagatagagaatagaaggttaccagagactgggaagggtagtaagagagatggcatggagaggaggtggggatggttaatgggttaaaaaaatagttagaaagaatgaataagacatagtatttgatagcacaacagggtgactatagtcaacaatgacttaatttacattttactaacattttactaaaagagtgtaatcggattgtttgtaacacaaagtgtaaacataaacacttgaacggatggatacatcatttcccatgatgtgattattatgcactgcatgcctgtatcaaaacatctcatgtaccccataagtatatatacctacaatatacctacacaaattaaaacttaaaaaaatctctttattttcttgtaaatgatctttattgaatttgaatttttatatcttctaatataaaacatatgttttaaaaaactcaggtttctaagtgtacccttgtaaaacatttaaaggccaaaaggagaatacattgtaccttctaaatcactttctaaacccagccctgggaccctcaggactccactcattacaggatgggggtcagccagcatgaatagccccggcttcattggtgatcatgaggagcaagaaaacaaacacctgaagagcctgagaatggaagcccaagtgtcagttcttccttgtagtgcctctgcactgtcgcaaatgggctgtggggagactttatgtgcctcactcagggggttcgtcatgcctccttctttgagtaggaagaggaattggaaatatacaagcatcagaagtgtgactgccatactcttcctcccaagagagcagatttaaaatccactcatagagatggaagtaaaaaagctccctaacaacttgtttcaaatcaatatgccactttaatatgagaaagttcccatgtcttcacagtggcttcacaagtggatttctgtcttgtctcatatttaatgattctataactgtgtgtgcaaagcatatgatttgatacatgactaaaaaggtattgttattaactgttaaaataccatgactacattcctactttgctcagttttaattttataataaataccttaagattttccaaattgctctaaatttacattttgtaacaggttcttcaagtttgttttgttttgttttttattttctccagggattgggaagcttaaaggaaaataagactgcaaagggatctcttaatagaaatgtataaattatgctgaagataacagaataagcaatgataaaaactgcaatttttcaaattaagtctggccaccaagtagattgggagtgtgaaaatgaaagaaaccataggaaaaaagtgtctatgacatcttaagcctcatcagagctagtgaaaggaacattagctttaatcagatgaatagaagccaggaagggaggcttcaaaaaaaagtcctaataaaggggagcatgaaaccatggctgaaactctgaaatggaagaaggctcaagaggtttattagactattcagaaagaaatttcaatttttcttctgcaaataattcagaaaacaaaaaaggtgggggcaggaaggcatatctaaagagatcaataggaatctctgatgacctcaaatttcatgaggatttgtgcaaatcatagaaggacaaatagtacagaggagaatgttcctaaacttagagtcaggaaagctcaaaaacataataagctaaggcttgaaaatgtatagacagcaagaaaaatattctattttttttttctttttaaagtgccatccagtacaacaagagtcgtaaagccaaggagcttccgttcatcacagaggaaatggattatgaaatgtttagtgttgatggatggggtgttgctctacttctcattattttctgtaatagaggacaactgtcaattaaagaatgttggtgtcaatactggcatgaagccaggcacgaagctggacagacagggatattgtaaaatgcattttctcactctgaaggaattagagactctcagccatgttcacttatgggcgaccacatgtcctcatttgtctgagatattcctagcttatgcctgcctttctggcatagctattaatagacctcctttccattttaaaagattttaagcactgagcagaccaatatcaagttccaaagttgaatcagtaataccaacaaacaaaagccctacggcagatggattcatggccaaattccaccagatagacaaagaagaactggtaccaatcctactgacgctattccaaaaaatggaggaggagggactcccctctaactcattttatgaagctagcataacccggataccaaaagctggcaaagacacaaagaaaaaagaaaactacaggccaatatccctgatgaacatagattgaaaaatcctcaacaaaatactagcaaactgaatccagcagcacatcaaaaagttaattcaccatgattaagtaggcttcatttccaagatgcaagcctggttcaacatatgcaaatcaataaatgcgattcaccacagaaacagaactttttaaaaccacatgtaatcatttcaatagatgcagaaaaagcttttgataaaatctaacaacccttcatgataaaagctttcaacaaactaggcatcaaaagaacatatctcaaaataataagagccatctatgacaaactcacagccaacatcatactgaacaggcaaaagctggatacatccccacttagaacaggaacaagacaaggatgcctgctcccaccactcctattcaacatagtactggaattcctagtcagagcaaccaggcaagaaaaagaaatcaaaggcatccaaataggaaaatacatcatcaaattatctctcttcactgacaatattattctatacctagaaaaccatctcagactccaccaaaaggctcctattctgataaatgactttagtaaagtgtccggatacaaaatcaacgtggagaaatcagtagcatttctatacaccaataatgctcaagctgagagccaaatcaagaacatgatcccatttacaatagccacacatacacacaaatctaggaatatatttaacctaggaggtgaaatatctctaaagggactacaagacactgctgaaagaaatcagagatgacacaaacaaaacaaaaaacattccatgctcatggattagaagaatcaatattgttaaaatggtcatactgcccaaagcaatctacagattcaatgctattcctatcaaattatcaatgttatctctcatagagttcgaaaaactattctaaaattcatatggaaccaaaaaagagcccaaatactcaaagcaatactaagcaaaaagaacaaagccaggggcattgcattattcaatttcaaactatactttaaggctaaagaaacaaaaacaacatggtactggtataaaaacagacacatagactaatgtaacagaataggaaacccagaaataaagtcatccaatcttcaacaaagttgacaaaaataagcaatggaaaaaaggctccctgttcaatatatggtcctgggataactggctagccatatgtggaagaatgaaactggacccctacctttcactatatacaacaaataattgaagatagattaaaaagttaaatataagacctcaaactataagaatcctagaagaaaacttaggaaatacaattctggtcattggccttgggaaaaaaaatatgagtaagtcctcaaaggcaactgcaataaaaataacaatcaataactaggacctaattcaactaaagaccctctgcacagcaaaagaaactatcaaactgcaaactacagaatgggagaaaatatttgcaaactatgcatccaacaaagttctaatatccagaatctataaggaacttaaacaattcagcaagacaattgtaaaaaccaataactccactaaacagtgggcaaaagatataaatagacacttcttaaaacacaaaagcagccaaaaaacatggaaaaatgctcaacatcattaatcatcagataaatgcaaatcaaaactacatgagataccatctcacaccagtcagaatggctattatttaaaagttaaaaataacagatgttggtaaggctgtggagaaaatacactgttggtgggaatgtaaattagttcagtcactgtggaaagcagtctggagatttctcaaagaagttacaacagagctaccaatcaacccagaaattccattactgggcagataccaaaggaacataaatcattctaccaaaaagacacatgtgcttgtatgtgcattgcaacactatttgcaatagcaaagacatggaatcaacctgggtgcctatcgacaatggactgggtaaagaaaacctaatacgtattcaccatagaatactatgcagccataaaaaagaatgaagtcatgtcctttgcagcactgtggatgcagctagaggccattatcctaagaaaattaatgcaggaacagaaaaccacatactgcatgttctcactcataagtgagaactaagcattgggtacacatggacattaagatgagaacaacagacactggggactactagaagaaggaaagaaggagggcggaagacgcaaaaatctattaggtaccatactcactaactaagtgataggatcatttacatcacaaaaccttagcatcatgcgatatacctaaacatgcacttgtactccctgaatcaaaaataaaagttgaaattatataaaatataatattaaattatataaaataaaactatctttatttgaatgacaaattatgtagtcatctttaacatatatcaacatgccaagagtactgcatgttttattgttttcaataatcttcttgataatctgaggaacagattatcaaacagatttttgtgatgactttgaaagagagaaagcaaacagaaagaggaaacatgggtttttaaagactaaattaggtgagagcctccttatttctttcttcattagggctattgcagtacatgtcatgggatttctgtagatagatcaaatatggattttaacaagacctcagacaaagatctttttgatagttagagtcaaggacggaaatatgaattgtcatacagtctgatgtattttaatgagttgaatggctattccaaatagtgttgactaatgtttactaatgagcaatgtcaactctgcccttggtactgtccttttcaatatttttatcaccaaattgtattaagacatgctgatcaaagttgtatctgatgcacggtaatagcagatattgagatgacagagtcaggatccaaaattatctcatcagactaggaaaatgtgccaagcctgaaaaattaaatttcatggggaaaaacaatttcacagggagaaacttatttttccaaagaccagttgcacaaaaataataagagaaaatatgagatgaaagaaagaacgtttttgctgattaaaaatcataattggtgaactggccacaaaagcattaatatcaacattaagaggctgatgtatcaatcctactgcgtccagcatgtcacacccaaaataacatgttccactctgggaacctcagcttaagcaagatagtggcaaactgagaaccatacaaaaaaataataggagagtaaattctaacagtgatttaaaaaaaaaagaataagaacaaaaatagtaacaacacagatttgcaatcccttatctgcagttttaaaatccaaagtgtttgaaaaccaaaaatatgtttaatttttgtcaaatcctgacctgaaatagagaaggtatctatgctctttatctatttcaacttgttgtacatataatttgctgtacatatttgcataaatattaatatacttgattatgggattctgccttatgctccattggggatattacataatatcaccagtgtatctctgtattgcctttaagaaaaacccaacaataggaatttcaaaatatagctggtctcaaggtttggagtaaaggattttgacctaatggtaataacaacaataatgataataataacagataacacaaaaatagcacttactatatgtcagacactgtcctaggaacttagcatatattaattcattcaatttttgcaataaccagagatgtatataccattattattatcctcactctacaataaagtaaactgaagcacaaagatttgcccagagccacatactaagatgctatttgaatgttaatatgatacttgaatagttgtcttcaagttgaaacattgtacgtggaagtagcaggaagcaggatgcctacaaatgtaaagcttaattggggtgtcactgtagaatgttcttaaaatattttgaagcttacagaaatacaccttgaagcaaattatttttgcttgagtagtctttctttgtaattttagaaggaaaatgtgccaattattcagggaggatcaaaacagaaaataattttgtaattgatcaaaccacaacttcctaaagctactacaatgcaaagttgaagcttcagaaggaaaagagaatgagaatctgacaatggacttccaagattcaaagctgaggagaaggtggaagggaagcacaacttcaccttaatgaaaaggaaaaagaatgatgtaggctggtgagccaggcccaagacaggtatttaaaggcaaagctgttgggcacagcttctgactagtaccaagaactgctctggatgcaaggcactgtggggagacttcgtggcacaacagctgagcatgtttgtgtgaactgaatatccacggtggtgtcaccagtgcatccagaccagcagtagcctcaccatggcagaggacaggatgcaagagcaacatgtggccacgggaagcagcaagaacagactgccatacttttgcttcgacctttatctgttgttagaagcaaaaaccacaccctgtgtggactgaatacaccagcaacctactgagacagcgaaggggtgcctggagaaactccaagcagcctgcccactggggtggagccacagaagttccagccctttgcagcggtgaggagccgggctcctcctcttcctgggtggaacctgggattccgacaacccagcgggaagtgctctagcggggattctgggcttgtgagagtccctgtttacccccctttcttccttttcatccattaaaaccctactttactcaccattcaaactgtttgtgagcctaaattttcatagccgtaggacggacaaggaccccatcgctagctgaactaaggaaaagtcctgaaacatttttggcctgcaacgtggggactcaagaagcagtgagtgaaatggggactgaaactcttactgttccttctaagcctttacatccctggacttctgagggtggagaaccatgcccccaaccccctgtctcccccaggccttttcatgccttttccttcctttttcgagacccacctgtgagcagcagctccccaccgccacccccatccctgccagcactgggacgcatggcccaagggtcctgcacagccactggctggttcgcagccaggcatgctgccgcagccttccacctccctggtcaaggggttcagctccatcagacagtaaataagcttttctcttggtggagggaccacttatctaagaataagaggttcttccccaggcatttttaaactgttcttttttctttccccttctccattctgttggcagttaacttttaaagtttttttttagatgttttactaggccaggcttcacccagcaactgggtttccttttgcctgtctgtgtattgtgtgtaatgtctgtcaaaagagctctaattattattgatggacatttgggttggttccaagactttgctattgtaaatagtgctgcaataaagataaagaaaatgtaacacatatataccatggaatactatgcagccataaaaaagaatgacatcatgtcctttgcagagacatggatgaaggtggaagccatcattctcagcaaactaacacaggaacagaaaaccaaacactgcatgttctcactcataagtgggagttgaacagcaagaacacatggacacagcaaggggaacatcacacacccgggcctgttggggagtcaggggcaaaaggaaggagggcattaggacaaatacctaatgaatgtggggcttaaaacctagataacggtttcataggtgcagcaaaccacaatggtacatgtatacctatgtaacaaacctacacattctgcacatgtatcctggaactaaagtaaaattaaaaatttttaaaaaaaagtcaacaagaaaaaaaaaagctgtaattaatttggccaaaagaaagacaattgcttggatctgatgtttttaaagggaagataaaatctatggtacctttcagttcatgtgactttaatctttaagaaataaaaacacccctaaggactattagtaaaatgcaggtcagatgcaaagttttctaagtgttgtgagtttacaaactgctttttgggttttgagaactatttgacttgctggcttcacaattggtaaggcctggggactatggaactaactatgccccttattatgctatagtcaaaccttggttgcagttagcacacaattaaagcaacttaacaagtttcaccttaaagataacaattgctggggttaccattataacaggtaattgagactactcaaaatagatttacatgcaaggggtataagaacagtaaaatgtgctttttctttgtaaaatgttataagaaggcatggaaatataaatttttgcctagggttaaaggattgttttaaattagataagagaaagccgaaggttcaaacaagtggtagaagaactggggaaattaatcttgcagaagaggttctctgggtgaacatattgactaacttcaaaaaagggtattatatggtttttctgtaaattgaacattaaaatataagaacaacaaggtattcttaaaatgctaatctgctccttaacaaaattcaaaagggttataaaaggtttttgcttctttaaaatttctgagtcattttggcaaaataaataatttatggtaatctggaattctatttcataatattaagtgctttaaacatatttaacagctttcccaaaatcaaacttcagtttcaaaattgtcttccctggcacctggttttttgaatacttcagagggcccctgaagtgtctagaaaagagaggtaaaaaggattatttgacatgtttaggtatatgagattgccaaaatgatgctcaatcttctttaggttatatcttggtggataatactaatatatgttccaaaattgtatgggatttctaaaattctaaggtctaagtatatgccataaatcataattaaggttgttatgttaagttattgtaaaacagagataacaaaacttctttgtcaattgtgtgtctaactgtaactaccctggacattttgttattcacagacgattgttgtcttgttttaatcctttcaaaagatggtttataataagctatacaactttaacaggtactttcaaatacaggcttctgataactttagagactgtaacattggaataaaggaaaaagtacaggactcataaagagctgaaatgttcatgaatgtcaagcaaaacaagagttaagtaaatggactgaactcaggaagctaaagcaaatctttttgacttttgcttggaatattgatgatccttgctttagttttttttatagtcaaggaaacttagtttgaactatttacgacctttaataattaagtgaagtatacactcctgtggtcaaaatttggagcatgtttgtttctctctgcctggttcctctagaatttggaaactatctgtcagtattcttatggcaatatagttgtttgcatcagtacaataagaatccatttttcttttgcaacaggacacaattagagaacgtagttattttaccagggttttgactggaagggtatgcttccctttaaggagtcaatcttgacttgcagagccaataaaaatctagtgggaaactggcctcatacccttgtccatgtagtccctgtacagggttcttgacctgtggtcagtaaagaatgtcactttctaacaggtccaggagctccaagtttgtcttgggaccttaagaggagaaaatcacccaactcacgggtatttgacaatacaaacccatggctgggcttggctttaaaaggtcttatctaagattccttgggaaacagagttccatgaaagccaattcaaaaggcctatgtagaaatagttattcttgctgcactttatgcaaataaccaggccaagtataagactaaagtctgttttataaatcattccatcatgatgatatttaacaaaaatgaggacttgcaagagagaaatcacgtttcaaaacttatcatatgcttgtcattaaattctaaactcaccagtcattttcaagttttcacctacattttagatcaaccctacttgttcctgtgaaccaaccactgatccccagctgcagctcagaaagaacaagagggatgggtaatgtagaaatctggatcaatagtctagttctgaacagttatcctacaaatcctgccaggtagtgggaataaataggatgcccataacccagaggtttcctttttgggaaagtaagaccaacgtagctaaccaaagctaagtgtcatccaccgaaatcccagcaagcataactatggctaccagttatctgggtgtgtcacaagacatccattcctctctcttgttggaggagaactcagctccagtttgaccttagcatttggcttatgacaaggagtccatgcgacccccgctgagacacatttttgtctgaaactcaattccaagcttcagataaaaaccctaggaaggaaaactggatctgagggatccagaggcagacaataacagaagttaaaaggcatagcacatgtgagcatggctgatttctaccgattaaaccaaccccaagctttcatgaataaaggccatgttaatatccatagcataaatgaggactaaggaactccaaggctactgacagtagcggagatagtggcataggtgagagtgggtaattcctattctctaggtcctccctgcttcatgggtgcaagtcactttgacacccatggtggcatctgccgaggtcactggaccctggggatgcaaggacagaagaggaaaagaggatgctcttccctctcttcctcatgtactgtgggtatctgctaggaaaagaaaggaaccagggatgcctgctcccctttttctagatgggtagccatttatattcactctgtacccctttagactgcatcctaaacccctgggaatcctttaaaaggcaccttctcttttctcttcctctggtctctcttcacaaataggtaatcatgtctctgtactattagacacttccctctaatgaatcctccaaactgggaaaagttaattttccaaaccttaaacttgttggctcaggatcaagctcagcgggaaaggaacccagaagcacaacatgctggcaaaagggtaaagttcctcttccagtagggcttttggcttccctctccctatgcaaactggtaaaaggccttgggatttttgagctatccttacccctccccttgtttcattttgatacatgttttctaataacgtggtgtatctgttcttactttcaagcatcaaactccaaacactcctgtaaccagagcctctcacatggccccttctactaggaacccttagataggcctctgagggtgatctgcctgctgtttccccaaaacagtgcccccttatcaggcgaaagcagttaagatagttctttgtccctatccttaatctaatggcagttagatgtatttctctagaaggtggtatgagacagccaggtgggagggggtgcctggagaaactccaagcggcctgcccactgcggtggagccatggaagttggcaccctttgcaagcagggaggagctgcggtcctcctcttcctatgtggaacctgggattcaaacaacctgtcaggaagcactctagcagggactctggccttgtgagagtccctgtttctcccttttcttccttttcccccaacaaaaccctccttactcactgttcagatgatctgcaagcctacgtttttatggctttgggacagacaaggaccctgtctttagttgaactaagggtaagtcctacaacactacttgggcaatttagggaaatactttcaagtgggagataatggatttagaggatgtatacacaggtgtcttgcaaagtggatccacttaaggtagccatgtaatgcacaatggtttgagacaaattctatgttgcctcactagaaatagactttactggagaaagaggaaacatgcaaagacaggatcaacacaccaagaacacatggattcccatcctcccactgtctttatagacaggtgtgtggggccgagtgagctgctagatacaaagtgtagcttgctatgctttttccttttagaaagcaagatcatgcttatcaaattcgtcatggtagatgctgaattttaataactgataactttttagttgttattttgagtgttttaatccctcctaatgtgttgctccaaattctaacatttaatagcatgtattaaatataaaagttaaggagatagtgggagaggtagactatatgacctctaagatactttccaactcagcgtctttagttttatgagacactctggagaagtattacatattattaatattttccctaatcttagttggcgttcgattagccttcttcactgatactgcacactgacttgagaacttaaatatatcaatatagaccttttcctcaattctattaactgattcagtacaatataaactgcactccagttgaacatcatttctacctaactcaaacactacaattcaatctcttccgattcttattccatctctcaacctgctggccagttcccatttattttctttccctactcacgccactgattccacaaaatccatactccagctctactgtactgcttactagagatttaataatccccaaatagcaactaagtagacttacagatgtctgtgttgtaacaactgaggaatataaaaggcagcgtgtttttccctagtcataatccttaaatgaagctgataacgtttactgtgaactatttgagattctttctcccctaaataagagggtacattgtcttcccttcagttggtacaccctcaaatttgaatctacagaaacactcactgtttgtgtctatactcaaagcatcttaatagcactggtttcacattaggtatcacattaataagaccactgaatgggtcaaacttaggtttctaagaaatctattatactataagaaatatactggagaaataattagttgcaggtcttggcattcaagaactcacagtataaaaataaaaaataactataatttaatgaaataagtataataaaggaaaaaagtacaattggccttcccaagaatatcatgtagcccccagaaaaaaaaagaaaaattagagtaagcaaccatggcaacaaggcaggctgctggccatttatccaaattacatagatcaatgttagctggcaatcaccgtcagatttgtacatagtaagcacaaaacctagataaggaaaaataatagggggaaaaaagaatcagaattctggtcacatttctcgttagagagctaaagtacatagacatgccataaatgtaggaatggatatgggccaaatattgatcccttcattcttcaagggctagggtgaggagaagaaaggaacttccaggcaagtcactttgtgtctcaaataatcttttatgaactgaacgttcgtgtccacccaaaactcatatgttgaaattctaaccctaaatgtaatgctatttggaggtagggcctttacaaagtacatagatcaagatatcagtagttacctttggtttgaagcaacaacattgatgcaaaccaaacattagcaacatttagattttacaggaagaaacagaaatcctgaacagaccaataacacacagcgagactgaaccagtaataccttaaaaaaaaatctccctacaaaacaaaaaccaaaatcagatggattcacagccaaattctaccatatattcaaaaagaattggtaccaatcctactgaaactatttcaaaagattgagaaggaggaatcctccctatctcattacaaagctcatatcaaactgatacctaagccaggaaaggaaataacagcaaaagagaaaactataggtcactatccctgatgaacatagatgcaaaaatcctcaacaaaatactagcaagctaaatccaatagcacatcataaaaataattcaccacgatcaagtgggtttcatcctaaggatgcagggatggttcaacaaacacaagtcagtaaatgtgattcactgcatacatagaagtactaacaaaaaccatatgatcatctcaatagatgcagaaaaatattttctaaaatccagcctccctttttggtaaaaatcttcaacaaactaggaatagaaagaacatagctcaaaataataaaagccatctatgacaaacccatagccagcataatactgaatgggcagaagttgaaaggctcacccctaagaactggaacaagatcaggatgcccactttcaccacttctgttcaacagagtgcaggaagtcctagccagagcagtcaggcaaaagaaagaagaaaggtcatccaaataggaaaagaggaactcaaactatttctgtttgctgatgatataattttatatctagaagaccctaaagactctaccaaaagactcccagatttgataaattcactgaagtctcaggttataaaaccaatgtacacaaatcagtagcactgctatacactgataacaaccaaaccaaaaacaaatcaagaacccaatcccatttattatagctacaaagaacaaatgaacctaggaatatacttaaccaagggggtgaaagatctctacaaggagactatcacatgctgctgaaataaatcacacaaacacatggaaaaacatcccatgcttatgaatgagaagaattaatattatgaaaatggccatcctgcccaaagcagtctgcagattcaatgcaattcttatcaaaataccaacataatttttcacagaactaaaaaatatcctaaaattcatgtggaaccaaaaaaagagcctgaatagccaaagaaataccaagcaaaaagaacaaaaccagaggaatcacattacctgacttcaaattatactacaaggctatagtaaccaagacagcatggtactggtataaaagtaaatacatagaacaatggaatagaatagagaactcagaaataaagccaaatacttacaaccaactgatcttctacaaagcggacaaaaacatacactagggaaaggacactctattcaataaatggtgctgggtaaattgaaagccacatgtaaaagaatgaaactggagctctatctctcactacatataaaaattaactcaaagttgattaaatacttaaatgtaacacctgaaaccaaaaagcctctagaagaaaacctaagaaaaactcttctggacattggcctaggcaatgaatttgtggctaagaccccaaaagcgaatgcaataaaaagaaataaatgaggcctaattaaactaaacagcttctgcatagcaaaataatcaacagagtaaacatacaacccacaaaatgcgagaaaatatttgcaaactatacaatgaccaaaggtctaatatccagaatctacaaggaattcaaatcagcaggaaaaaaatgataccattaaaaagtgggacatgaagagacgtttctgaaaagaagatacacaaatgaccaccaaatatatgaagaaatcttcaacatcactaatcatcagggaaatgtaaattaaaaccacaatgagataccacctattcagtcagaatggccattatttaaaaaatcaaaacacaatagatgttggcacagatgtagtgaaagggaacacttacacaccggagattggaatataaactagtacagcctctatagaaaatagcacggaaatttctcaaagaactagaagtaggtcttccattcaatctagcaatcccactactaggggcatccacccaaaaaaaaaaaaaaagccatatcaaaaagacacctgcacgcatatagttatcacagtacaattcacaattacaaagatacggactcaacctaagagcccatcaactgatgagtgtataaataaaacgtcatatatatacaccatggaatactactcagccataaaaaataatgaaataatatcttttgcagcaacttggatggaactataggctattattctaagtaactcacaaacagaaaaccaaataccacgtgttcttatttataaataggagctaagctatgggtacacaaaggcatgcagaatggtataatagacattggaggctcagaaggagttttgaggcggagaatgagggataaaaaaactacctattaggtacaacatatactatttggatgacaggtatcctaaaagccaacttcaccactatacagttcatccatgaaaccaaaaaccatttgtattcgtaaaggtattgaaataacaaattaaaacaaactaactgttcaccaagctcccacagtcgtgtaaggtcaagtccctggaacaactctcatctcctatagcagctctcactgtttcctctgatggaatcccgactgataactaggggcatggaagaggcatcctgggcactgggaacattctacttattaacctgatggtagttatgatggtgttcgcttagtgcagatcaattaagctttaaatcaatgttttgttcaattttctctatgtgtgctcaatttcacaatagatgtttttaaaactcaaaaaaataagattttatatttagtactggagtttgatcatttttctttgtaaacttcttctgaaggttaggatttacgcagatctaaaaaaagacacttccactctttacagtttattttttatatttaagacatacctggtttatgtttaatagttgataagtagatatagactagtgttcttgattcaaagaaaacaaagaataccgtggagtaatctgattctgaagtatctttggtcatgttgtaactgctgagtagctcacgtctttcatccataaaaaagccactgagtgttatatttgtgtgaagttggaaggagaaatgtgttgattctgaaacattcttttggggggcaaggagaggaaaaattacaatgaagcagaattttttaagagaaatatctttatccaaacttaaagcacttttcaaacagcagctctcctctttctgataaactaagagcacttctcagaagtactctgtcaaaaaaaattattttgtaaacagttttccattaagtggtactcagctgcctggaggacccatcttcagtgtgcttgccacttccttctttttgacagatatccaggttgcggtgacagttgcatacagtatcttaatttcaggaagagatggaattttccaaaattgactaacagtgaggagtgggaggttgctccaattaagcactcggtcctctctattgtattaaatttaaatgataaaaatattgtaactggtaatttggaaactgtttttaagtatagaaatgtctttgtctaaaactcttgtaaatcattaataagaaattaaaacatcccacttgagtacctttatctaatcccatttttccttcaagctcctcaggcttctgccaacaaagctttccattgcattgcttatttctattttgccaccattttttttcgcttgacctcccttattaattcagtaaagactgtaggccatcttccagggtatgtgctagaactacagtttaaaagatgagtaagcatagtacctcccttcaagaagcttgtggtccaatggagaatgctctgctagcccatttttaaattattgcagttcatttttacatgtctaaaattattgcatcaaatgtacatactgcaggaaatctttcccacatgtgtattttatctactattatttttggacgcatggacaaacaattcataattaaaagctagaatttcctctgatataagattttaaatgaagatacattaaaacaaaattagtacagaatttaagggctggaagaactctataaagaccttttagtataatgttcttatctaactgatggaaacactaatgcctagagagtgaaacaactttatttactcaacaaatataaatggagcatcaaccatatgccagatagtaaggtagaagctggaaatatagtgttgattaggacccacattactcagctgtaattagcaaataattaaattataataatcaccatacatgagaagtacaagatgctgaaagaacataaaatagggtgatgaaacccaatctgtagatgcaagggctatttttctcagagggtctcattaaagatggaacttaataggctgggtgtggtggctcatgcttgtaatcccagcactttgcaaggatgagatgggcagatcacttgaggtcaggagtttaagaccagcctggccaacatggcaaaaccccatctctactaaaaaatagaaaaatgagccaggccaggtggcaggcacctgtaatcctagctacccaggaggctgaggcaggaaaatcgcttgaacccaggaggtggaggttgcagtgagccaagattgctccagtgcactccagcctggcagcctgggcaagagagcaggactccatctcagaaaaaaaaaaaagatgaagatggaacttaataaataggaggctcaccccagattgcacaatgagtgagatgcgcaaatggaactgaagtcaaagtccttatagcatgagtggcatatctctgctatggcaagctcccaactggtagttatttatggtgcacgaactatgagattatgaatagaaaactgtcaatctcattgacagaagactgtcaagaagaggtgagaatataagctcacctctagtcctgcctgaccagcctgctcaaccttcaataagagtgttgaaatatataacccacatttctttgatcaagaagaattattagcatatgttcaagtttctaaataattgagacttgctttttagttaggtatctttaatgccctttatgcagcaaataaattattattatataaagtttgttttgcaatacatattacagtggaagaagtgcagtatatttctacattaaatgtgtgaatttttccaattatttctttcttattgttaggtcttgcctctcagtggcatacaagacaatccatttaataatgccaagtaaggaaggagagttttagattaataactcctgtaagtaacctatttgtcactaatataaccattttatcattgtctatctgccctggtgcactgctgactaacattattagtagcatgctttgcttaggagaatgtaagaataactaattttgtggttttcccagaaatatttgttttctccagcttttattggtatccagataccactcgttctaataaagcaaagccctcagtgcttttcagaagcccctgaagtgtgtgtttggttactctttacgtgattaattttcccttgttagttgctgttcacacacacgtatgtattcacctgtgtatcactaccgcctttcccctgtccattgtgtgattgctttaaacaagaaaaaccaaaatacatttatttttagagtttaataagaagttattcaggaacatacttataagtactttagaaatatttgaaagaacagtaagtaggtagagaaaataagtggttaggcagccagctctctgactccttaatccctatatttattagaccccattttctgcatactcattcttgccctttctgcattctctttcttgccccatatactgatgcagaatagctagcccactagaactcccccctattattttaggattcctcaataggtatctcatgatttagcaaaagttgttctcttctgctctgtggcagcagcatttcttcaccagctctgacccccttctaagagtggtccatcctccactctccacaatcccctgagagctgccactgttgttggtgtgcgtgagagctaaatctacctaaggtactttcctcatgactccaaagctactggccacctcctggcaatgacattttaacataagattgcaaaccagacagaaaaagtactatccatgcattattatccctggagctattcctcatcagagaaaacaaaagccaggctgaaactcaacaacttggagatttgagggttctccttcagactgaatcaatcaccagtgacagagcagggactttgtctcattcccaagtacacagacttccaggcatcacactgaggtgtatttactttcaattgctagatacatgctttaagaggcagacacaagaaggatccttttcagttgataaattcaagagcacaatagcttcaatgatctcaccttctctaaacacatacttttaattgacaatgattatgtatccaggcaagttttccagaaaaagaaaatccattctttaaactttgaaggctgtttccttcttatttactgtatttattatttacggttaattatcatgggtaattcctcctcctttatgagtatgttttacttgaatttgatgagccatcccaacccaatatatagaaataaattagcaacttctctaaatataaaaagtctcattcaaagccaggaaacttcaaaactaaactagataaatgtatatacccttagtagttcccaaagcatttctgaattatggtacctttcttagcactgattccttaccgtataaatgcttatacacgtttattttcccttctatactatttagtccctttagatcagagatagaaattatgtattattatatccctactgtactaaatatctgacacacaataggcactctctaaatatctgaatgactgaatgcatgaatggagagtgagcaactaataatgacagctgtcctctatttaagacataatacatctcaggcactgtcttgggcaattttcataaaccatctgatttatttctcatgagatcataagggaggctttattatccccaatttggagatgagaaaacagctgcttagagaggttaagttccttggcaaaggttacagatcttgtagatgatagttttaattttaactcagttgtttcctatgtaaagcttacactcttattcactaagacaggggtcagcaaagaatggtcggcactgtttttgcctgccaatattttagcaaagacagttttctggcgactcggcctcacccattcatttacctattgtctatggctgttttgaggctacaacagaaaagttcagtagttgcaactgaaataatctagcctgcaaagcttaacatatttattatatgactccttacagaaaaagtgtgtgggctgggcgcggtggctcacgcctgtaatcccagcactttgggaggtcgaggcaggcggatcacgaggtcaggagtttgagaccagcctggccaatatggtgaaaccctgtctttactaaaaatacaaaaattagctgggcatagtggcacgcccctgtagtcccagatgctctggaggctgaggcaggagaatcgcttgaacctgggaggtggaggtttcagtgaacctagatcgtgccactgcactccagcctgggcgacagagcaagaatctgtctcaaaaaaaacaaaacaaaacaaaaaaaagtgtgtgacccctgtggtaggatatactgaataagcagaccacagcagtcagaaaaatggtgaaggaaaggcagggaaacctgcgcaagtgagaaacttgttctctacatttgctgaacccacaattgtttcctactccccaccctaacataattgaattattgtggcattaaaaagtacccaggcaaggccttagtttaaatctaaccagccttacattaacctggtctgtctgtgctgttgccttagctcattttcttctctgtttggtgctatgactaactcattcccaatgaagcctctgatatttcaagctgagagaagctaaggagctgaaactcttgttaaacaattcattagcttttcacagggcagagataaggtgatcacattcttcaactcacaacataaagtgcaaaagtatttcagacctagtgagcctttctctttttccttaattttcccttatccttttctcctaggtgtttctttctcccctccctccatctctccacttaattgttcacatgtaaaccttactgaaggtcaagtatatattgcattaattaaataaaatccaatgctcttttcttaatattcaatcaggtgtttaaatacattacatataatatatgttacataaacaagatattttgtccagacaggagtctggaaattgattgcttttgttggaaagacttatggtctttggatgatgtgtgggtcttccttcccatagctcttttcatccatgagtgatgagttaatagtagattaaaaggctcccaggagagaatgaatttggactgcactcccttttgtgtgagatagcattaaaacatttctgaggtttttagataaccccaaataaagccaaaaaggcaggcaatagtaacctccatgaaagagggatcatgttgaattttttcactactgtactctacattgcctagcgtaatatctagcatgtaaatatttgtggatgaagggaaggtgagcaggaaggaaagaagtagagaggatggaagacagggaaataaatggaaggaagaacgtgagaaagaaaaaaaatcatacttagggcacgatcactgtatatggagtgggcggtgtaggctgatactctgaacctagcatctgtctgttgaagaggaaggctactgtagtcacagcagactggggctgatgctagaatcctcttgggtccaaggactcagcttcaggaaagtggcccactttgtgtattatcacacccggctcccagtgattcttgctgtaacttgtgtctttgtaacaggactctctggaagagaatatcctccttcacactttgatggaccaaatttcagggggagtggcagagctctgcacttgggacagaggtgtcctcaaggaatgcactaggttagcaagagaaagggccttgattatctaccatagctgtagacctgtaagacttcaatggcaccagggctccatcggaggcagtaagtggcctacccaagagcaccttctgaaaagtctggcttgaaggagtataatggagttgcatctctccagcacagtgtcatagatgtgtagcaagacagacaggctcaggattaaatgtgaccaaaactgcagattctagggattatctgggtaaggaaagcctgggtaaagtctagattttctactagtttaggagatgggagcccgtacatcttgtgttctgtgtattttgtttgtattattttcttagccacaagttgttgaagtctgaaaatatggactttcatgtcatccttcattaccttccacagtgtgatctcagaggcaagcaatgcactagcatctggcctaatgtgttactgatggcagcggtgggccatccagagcagctgttgccattacacctgctacagcaaggaggcacaagtggtagcagcaggagaggctgcagggcagcagtggtggccatgggacccctgtgccctgcgtccccaaggaagctgactgcactgcccccaccttcacgcagccgggcagtacccactccaggccccggccccgcttgccactcttgacagccactgctatggggagttcatggggaagaggcgaatagtccctagagacttcccctgggggaccccctggagcctaccaccctgggggccaccatgatggggccgggccaagttgcctacaggcaggggaacaatgtggttgggcacagaggggtgaccagagaggggactcgaggcggagccgggcctggggtggtaccatgcttcagggagcctgcaagagccctggacaagcgggagacccaccccctctgagttagctgggtgggagctccctgggtgcagctgcagctgctctgccccatctctggacccaggcatctctgtgttcctgggggcccaggaaggcccctctgacccctgcaggcttggaggtgcctgcttccactgcctggcttctccccactgtcagtgtatgctctgatcttggagtaaggttggggccaagcctgagcactgttgcagtttggccaggggcatatgctcagggcagcagtgacccaccaaccccttgctgcctcggctccctctaaactttggctgtggacaagcacaggagggaggcacaaggggtgctgaggacagcggggtactggcctgcaggcgccccttggcatgaacggtctgggtgcgatgaatggtgacaggcggcagacaggctcctgggcagaagggggaaggtcctcagtgatgccctaccttcaagctgaggagggcctgaaccctgggggctgggagccattcccgcataccagaaggtgaactcgtagcgcttttccctgggccctcgtgggtgcccatggactgatcaacatgcacttcctcccctctgaggcccataaaaacccccagactcagccagactcaagcagaggacagacagatgatggggagatgaccagatgacaagctgcagagaggagctgcccaccccagggtctcctctctgctgaaagttgaggagacaatgggatgaccaaatgcagagaggagctaccctctctgctgagagatgaacactcactgggatgccctggctacagagaggagctgcccactgagagtctcttctaagctgttctattgctcagtaaagctcctctttgtcttgctcacgctccacttgtctgcatatttcattcttcctggactcaggacaagaccttggtacctgctgaatggcaaggctaaaagctgtaatagaaacagggctgaaacatgccccttgcttgccacgttgtgggtgaagagaaggagagaaaagctgtggcccttcagggagcccagctctgggagctccctgagccagggcagtgactccctatttggggccctgaagttcctgacatctccaagcttccaggagctactgcattcgctggtgccagctggagaagctgtttgcagtcctcctggtccagctgtagcctcacagagagccagcacccacactggcacctggaactgcctgccccgcagcagcagcagccagtgtgtcttgctgtgcacactggccagaccccacactcactcacactcaccactccacgcctgactcacagtctcccttggaggcataggatccaggccagtagtgtaagccaagtgcaccctgccaggccaagtggacagaatgagcccagcaggcccagtgaaaattcaggcaaaggtgccaccagccatagaggcttccagccagaaaagcgacaccccacggatcctgtaacattactatttccttctatccaaagatatgtgaaaaaccagcccaggaattattgacctgtcttgtccctctcaaggtgcctgtcaccctacaattccagtagcttgcgtctaccagtttttatctttttataatgcttttaaaatataaaatacaatacatacacagaaaactgaataaaaccaaaccacatgtctcagtgaattattacaaaacaagcactgcgtgaccaccacacaggtcaggagatgcaatacggttggcacatctgggggtcactccccaccacacatgtatgtgccccgctataccagctcccaaccacaaatctctcctcttgatagccactctgacttttaagataaactttgtcttgattttttaaaatcattttcacctaacagtgtattcctaaaccttttagtttagtttttgcctgttatttttctaactttacataaaagaaatcactttatctccacttgaactttatctgctaggccacttttgagtttgcttgtgagaagtatctccattgttatggttatctgtaattcacttattttcattgctgaatagcattccattgcatggacacactataacttatgtatctattctagtattaatgaatatatgggttgtttctagctttagctattatgcacattactactacaaatatgcttttatttatgccttgttgtaaatggatgtgtatttccactaagtatgtaaccaagaatggaattggtagatcatctggtatgcctgtcttcaaacatagtagatattgcctatctgttttacagggtggtttaggacactacatgcctcacaacagtgtgcaagaatcctacagcttcagactcttgccaagacctgatattctgtttcctttaaatttagtcatacttatagacagatgttgctatcttatctttaacttgcatttcctagattaatagacctagatttgcatttccatattactggacctaacttgcatttcctagattattaggaccattttaacttttcttctttgtattggtgaagtaagtccatgttcaaatcacaagctcattttttctattgggttgtatttttaatactcattgatttgtaggctttttaaaaaaatagccattctagaccatatacaagcatttcaatcattatgtatattgcaaatatcctatcacattctgtgtctttgtttttcactgtctgaatgcccataaaattctcatatccagtaggagaagatacatgtaaataaaacctttgtgccaggttctctcatatacgtatgttcagggtattaagaaatacagagaaggagttgtcaattaaatgtaggagggatgagaattcaaaaaaatgtcatagatgggtaaagtgaatattggaaacatgcattcatatttttcaggaaattaaaggagcaaggatctctatgcaaaaaagcactctgagtcctctgaagccctatttatgcagctgagtgagagagcagtactcttgactagagaaatttttcaagggaggtcggtgatgaatagagccctaagtataattaaggaaaggtaaaagaggtctctggggtttagagacatagtttcgcttagaataaatattcccagtggtttataaaaagagtgaacagaagtatagttgtcttggggtggagtagagctgagctagatggcaatgagagtgagtttaggaagttgcagatagaaggcaaaaaataccagaagtttggcaagtattataggaaatagataacataccagctttagagtcacagagatcttggtttaaattctgcccctcctttccctattttctctctctctctttctgacacacacacacacacacacacacacacagagacacacagtgtctatggcatgtaatgcagacttttcaaaaagtggctgggaatgctttctctcagttccctggacaataaaataactcacaatgagagctctcgcttttcctctacaaaaaaaaggttcacaccttttttgatggtgttacagtgctttattcacccgcaaaggagcaactgcatctttccattggttccaagcttcccaggttttgagcagctggcttcctcagaaaactctggaaaacagctgacaattatacctgttatacaaatagcctgtctgcagagtctcttcttcttgctctataagaacagagaccaatcacaggcaatgttgctttaatgtaatataaacccactatgtatccagcaagggactggccctggcttacctctctgtgggaggccaagaggcttcaggaatgtgtgcctctcttgctgacaccagcctataaatttcccccaataaagcctgttccttaaccaaatgattctgtggaatttgtcttgagccctgtgcacaatggtaacttgagacaagcaacaaccattcttagcctcggtatcctcatctgtaaaagaggaattatgccaacaacaataagttattgtgaaggctgagcaagataatatatttaaaatgttttagcactgggcctattttacatggctaatagaagaaaatgtacttatggctaaaataatgaaagctgagtagcctcaatttctcaactgaatgataatgttatggcgctgatctcaaaaaaatcattcactagataactgaagactgccagtagagtgtatgtgtgtcaggggtgagaaggttgggatctagggggtggctggaaaggattttccaaaagagatttgcggaatgagagggactggccagaagcagatatactctgccaatttatctcatcaacaattgtagattgcattttcacttgtaataatgacccaatagctattttaattatgtttatatatacatatacagtttatgtatataacaaatatataagcagaagcttctgcatgaccatgggtaaaattgttcttatgctactggactcagagaggctatatgtttctattacagtagttggactgaataaatacgttctggcggggagggtctgttttcctgtgtttaagctgtaaagtgggagattctctatagagcagattataaggaagttggcccgaggatgacataaaagataaactgtgtgtaaataaagtagtcaaagcaaactaaggtttccagggctaaacttcttgtgttggagctgggaattgcttctgattttattcctactgctactagtgtcacaggatccttggagtgttgcttttctggctgaaaacctctgtggctgatggcgcctttgcctgagttttgctcgggcccgctaggctcattatgcccactcggcctggcaggctgcgctcagctcgcgctactggcctggttcccacgcatgccaagggcaaggcaggcacggagtggtgaggggtatgtgagcaagcaagcgtgggatccagcaactgtgcacagccaggcacgctggctgtggcggggtgggcagctccaggcacctgcatgggtgccacctccctgcaaggctgtagctgaaccaggcataccacaagcagtttccacggctggcactggggaacgcagtggtgcccagaagcttgaagacaccaggaaccgcagagccccaagagtgtgtcacatccctggctcagggagttccttggtctgggctccccaaagggccgcagctcttctctgcttctagtagaccacaacatggtgagcaaggggtgtgttttggccctgtgtgtgttacagctctttcagccccaccatttggtgggtctccagttcttgtcccacatccaggaagaatgaggtacgcagacaagtgaagggtgagcaaggcaaagggtgctttactaaacaactcagaggagacctgcagtgggtagcttttctctgcaggcagggcatcccattgtctgctcagctctcagcaaagaggagacccataatgtgtagctcctctctgaccaaatgatggtcagctcatcatttgcctgagtcgcttgaatccagggtttttatgggcttcagaggggaggtagtgaatgctgattggtccatgggcagccatgggtgggcccagaaaaagcacggcaagttctcactcctatctgcagaactggcctgaaggcggggtttcaccggggaactgcccctttccacccaggagcctgtctgcctcccattgtcattaacctgccatttacagtgcccatggcgtccaggctattcatgccaaggggtgcctgcaagccaacactgagctgcccttagccccttcttggcctccctctcatgctggtcagtgcccaaagtccagagggggctaaggtggcagggggctggtgtgttagtgctgccccaagtgtgcatgcatgcacctggccaggttgcgacagtgcctgggctcagccttaactttgctctgaaatcagagcaggcaccgggagtggggagaggccaggcagagggagcaggtacttctgatcctgcaggggcaaaggggcttcccaggcccccaaaagtgcagagatgcctgagtccgcagccgcagctaggtcgctgcagtggtgcctgggggagtgaggttcctgcccctccaacttggaagggggcagggcttccatctgttcctgagagggctcagccctggccacacctcccctactgcagccagtgtcatggcaacagccactccagacaggccgttgctgttatcattagagctggccagaagaaccaacactttagtaatgagttaagacaatattggaggaatgagagtctgtttgggcccacctgaaggcataatactggggcccccacaaggatgaaagtaagcatgcaagcaggagggtaagagtggagcagataaacttcagtgttgcccttaattacaaacgtagctggctgggtgaaagagacaccaacccctaaaatacacctgacagatctgctcactcaaggaattctactcagtgagaatttaatcctggtagactacctagatcttcgggcccttttaaatgcaaatgacacaaagaatgacagaaacctcattgtaaacttacatttaggtctgagcatgaaggactgtatggagttctttctcaatggcaagtttagggtaggatggagggaagatcagagctttggaattctgaaggagagggaaacatgctgaaaagaaagagaactggaggggaaagccaggaatagaaaagaaaatgttgcccattcacaatgggaattaagcttttcctataataaagaccttgacacagaagtgagtgggctaacgaactttctccatccaacagttagttctatgtgtatcactaaagttataaacacattcttgagtaccagaattttaattttgataccacaacctttgaaattctactataattgggtcaaactctggaacagtagcagatatgctgacttgctatagaatgagagtgacaaagaatgatgaggaaatgcctgaggttgagtcccaaagtactctaagtgtcccccaccaaggacagtgatgactaaggccctctccatgtccttgatgtcaacattagatgatgtgtgttaaaaatgttgagaatggaggggactatcttcaggacatggcattactctccacatggaaggtgtgttcaatatgccatcctgggaagattgaattcttgcagcagcacataatggaaaaatactacagcactaagcagtaaactgagaatatatcagaatcccaaagactacatctaatattgcttaactgtagaatgtagttatacactgttctgactggaaaaaaaaataaaacactgcaattttttctcttccctattgaggatgagttccttactaacttggaattcagttaaggtttagtttaaccaaactattccttagggagttgattcctatcaaaggtcaaatcctgaaagagtaaaataatcaccttccaaatatcaatcttgtaaaacagaaggaggatcagaaaattagtaggttatactttatgggcaatttctcttcacagcttaatgctttgtttatataactatccttattaaattattttagcaataagaatggtgttgccttcaccccacttcactctccaaaccctcaataggaaaaagttggctggaagagtgaataacaaactaatcgcctcaaacttcactaagattaactggatatgtcacctcctctaaagatcacagcagtcattcactggaataacaaatggcaagacgggaaaccaaattgtcaacatgggtacaaagaatctactaatttgcttgaggttagtgggtaataggcagtgttatactaacattattattcctttgtgatacatttccaaccaaatttcttttattagaaatgcttttttctgattatgaaaataataaatgctccttatgaaaaatcaaaaatatattttaaaaatacaagaaaacaataataattaacaataagactggcaaccacagatgatcattgtaatgaattagcattcttctttcagtgttttggtgtatataagtacaatacattacagcatgtaggtgctttgcagtttatgtgtattagcatggtctcattttgttaaattattataagcaacaatattaatgcctgtattatattccaatctattgacatttatatatcctttgttttctaacataaaaagcttttaaaataggtacaaatactttttctaaaagttttacattacttcttagggtaaaattcttggaagtagtgtttctgaaccaaagagcaagaagaaaatattttgccgaattattttctagacagttttctttgttttatagtttgtttaatcttttgctgggcatataaaatagtagtctgatctctgtgccttcttatcaatccaaaatatttcttctcaaagtattttctatttcaaaagatgaaaaatatgtctcaagttatgtttcatttattacatctaagtcttaatcattttcataaatgtatcagtcaaatgtagtttctttcataaattgttggaatatgccctttgtaaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttgaaaaacactcgaagacaaggaaaacttgattctgaaaagtcataggaagagaagacctttgaaaacacttcaatacaggagctagatgaacaactcagaaaactgatcagctcaacaggtgacaaggagggacaccatccatggtccaggggaggcttcctgctggcttctgggccctatgtgaggtgctcccagctgcctgcccttattccctgttctgcccaccctgttctccttgctgtaccttaaacatgtcagacactcttctagccagaaagttctttcctgagataatcgctagcctcaccacttcatttccttcaggtctctgttcacacaggaccttttcagaaaggctttttctctgaccacactgcttaagtagcagcttccttcactctttttctcctcaccctgccataaaggcttcacagcccttgagtgcaatggcaagctatcatagtgattaaagacctgattccgtcccctcccacctgtatgaagttcagctagctattcaccctccctttgcttcattttctcacgtggcaccaattgtagcccacatgattgctgccccaccctctcctcagtcaccattccagagtgctctgatggcttcacactgctagtacctgcaatctgtagccagaaaatgtcatctggccccaggagcatgttcaacctatgtgctaagcaggacagaagagccaaggagtcaaaactccagggaatggccttcacactatggtgagggggaagataactatctcagcttccttaccccttgggtggaaaaattaaggccatgtcgattccagaagtctgcagccaaactaagacccagttgcccatatcctatatgccgtgtaatatatttcttctcctttctctccctgtcttagttctccactcttttaccagtccagcactggggaagtagcaagcaggtaacttcactaagttccaaaacattaattgtgttttccagtttagaagttctgcatttggcagatactgggtaactgactagccctaaatgaagtgacttttgtatgtgattaccttgtgtcacctatgatttctttttcctcatctaagatctcagagagaggatctcgagctctgaaatcccactgaagccttaactcaaaattatttttgggtttgtaagaataagtaaatgtctctcaagtattgaggcaaaagtaaagaccttaactaaagaggaatggacatcagattgtcctaagctacctctactacattaactgctggatgacaatgtcacaaatctaaagagttctggagcaaaagtctgtgttccaagctaagataatagaaatatagtatcagatatgcaagagtttagaaagacgatcttttactgagaaagttcaattggaaaaacaaaacacatcgatcaaataagaggagaatcaaaagtaacaacttaggaataaagaagtaatgtaagagtaatgtttgagtgtcttctattcagatcagactatgatgtaagactcatggaactaggaagattagcaacagttccacacataaaccataaattgtgtcaaagaaatagtactagcaatgcactgatttagaagttgaaataatttgggatcataatgaaggctatgaagcttgatcaaagatttgaaagaaaagatgtgtatttgtatggataggaaaaaaaataaaataagagcacttttgaagttggaaaatgcctgagcaaagatccaagattagagatgctcaaggtcaatttttgccacagtgaatacaccagctggactggaaatacagaaatcactgtagcatatcaggatgtaaatttggaaaagtgaatttggggtagactgtggggggacctggatgtcagaccaggaaattaagaatattttattttgtaaacaatgtggaactgttgagaactttgtgaaaaatcaagtagctaaggggcactaacctgtatctgtggaagaatgaggcaggatagaagcctgtcacaaacatttgaaaagagagaagggaacgtgaaagatatagtgcgataaacaaaacagcaatagttggtaactgcttaaatatgaggctcaatatggagaaagttactactttgatatatcaaagttaagataatgttgaggaattaaattaaaaattagggaaacaggtagtttagatacacagcatagaaggaataatgttatttactatctacatttagggataatagttggcatttacttaatttagttatcaaattctcttttcgataaatctgtataacatctcttttctcgaatataattgtttggtaaacattacagcattttattaacaaaccttgttaaaagttataacaaattatacatgttttaagaattaatttggaatacaattatatgcttaaagggacctcaaagaatgaagactttagatgaatttttcatattaagccaaatttgtcaattggaaagaaatgtatataaaagattttttccatcatttgtcttctcctggtgtcccaatggtaaagctataatattgattaattagaaagagatctcatagagaagccattttattcactctgataccctggccactctcaggaggacgtgagagaaccactcaatatcctgagcacttcctgtgtaactgacttgcctctagacccaactttgaattaaatatttgccctggaacttgaatcatgccagaaatttgaagaatcaccttttgcgtttcctgatttctatttccacctattccctttcctatatttatctttaatttctaaattttctagaaggagaaattgaagtaatattggccgaatattcccaatggtagtaaacaaaagagaaacaaagtacctaccagaaactgaccatcttaacttgtgcattctgtgacattttattaccaaaatgaactatttctacgcatcccaaatctcctactgacttctacaattaatatattcccatattccacaataccaccaggaataagtcaatatttagattagaatatttctccagcacatgcacaattattacaatgatcatggtattatcaatacatatatgtattcatataatttctatcataaatatttttccagagacaatgagactatatcattttattatttcctcattttctatgatgtctaataaatatccataaataaaaaataaatctaagtaatcaattaagtatattatttgtattattaaggagtattttcccctttttaaatgagatgttcttaaagcaatactgtaaagaattctaacagataatatatattttctattttgagggtataacatcatttgatattggaagaattgccatggggtaaaaactggaatatggaaagctaccatattgacaatccctcagcatgcaagtatcaccaaaactcttacttaaatgtgctagtagttatttcttgtatacagtcattaaatttagtttgtagccagaacaaacattatcataatatattttttcaccatattaaatgtttaatataatttcaataaactaatttatactatacgactgaaaaactacaggcagattattaatgatgataaaagaccagttgtaaaagaacatctgttataaaagttaaaaggcccattaagaaattatgtaattaagtcttctatatccattcggagcaacagcaaatatctctaagtcatttaagaaaaatccaaagtccccaattaacacattctttttattcttttgaattttgcatcttgtgtgaattgtgccttaagagttattagtagaatctattcatatcccaaattagaggaagacatattagtgaggtcaacctctctagctgtaatcacttagcatatgaaagaagaaaacatatttttcctgtttcattaaaaatgtgaatatggcgtatagagagctttataaagcagatcaaaaaattcacttatccttatttgtgcagtccatttgagctagtaatttctgcttaggtgaaggtctgctcaactatgttacagcatatcacaaaacccacataaggaaaataccttcatttatcattgttaaattttttcaagtgtagaatactttccattgaatcactgtcctctgtaccaaaatttcaagatatggaaaatctgaattttcttaagaatagtttaggaataaaaaaatcctgtttagtttaaaggcatattcaagctaaatcagttatgtttaggtcacggttgcccaaccatggcctatgggctacatgcacgtgtcccaggacagcttggaatgcagcccaacacaaatctgtaaactttcttaaaacattaggaaaattgtctgcaattttttttttaagctcatcagctatcattagtgttagtgtgttttacatgtggcccatgacaattattcttcttccaatgtggcccagggaagccaaatgactgggcacccctgatttacatcatgttagtcatcacttttttttcttcttcactaactcacctataaagagcaatgtccttcctgataaagtgataaagtgaaaacaatgttagaactattaaaggacattttaacactaattgatccaacctaatggaaactgtaataaaagaaagattagcaaagcacaaatttttcttgcttttactttgtgaaagtatttgtttactttattatatataatatacattaaattgataatataataatgtattatgtcaggctatatgtttggaaatgaacagtgtctctttcttcctaattaaaaaaataagtggcttgcttggaaaaaaaagaggaaaaaaaaataaagccctgtaactaagtctcatttataaatattaatgcaaaaagttctcaataaaatactaaatattaagtaaaattaaatctaatattatattaaaaacaatatacagtatcaaagaagcatttattccacaaaaaacagtgtagttagacatttggaaaaaattgataaacgcattaataacggacaaaaatacatcatcatgttgataggtgacaaggcatttgacaaaatttatagtgtatctatatttagtaaaactttaaattagaaatcatttttaggatggtcaacagtgacatcagagatcagcaggcattatttaaaaattgcagtattagaggattagggtcaaaacaggaatgcccagcatcacaatcagtattccatgtcattccagatgtgctaaccaatgcaattagacatgtaaaagaaataagaataaaaataactgataatctgaaattccactggaagcagttagtaaataaaagtgctacttaaaaattattattttaagcatatcaataacttcttaatatacctacaattacctgaaataatgagaaaaatttaattagcagtcataacacattaataacatcagcaaatatcaaatctccataaacttagtgggaatttcccagaactacattaaaaattataatatactactgagagataatatgagttgaatacaaaatgtacacattgctcccctgtacagatatagtattttctcgaagttgatctgtaagtttatcctattcctaaaaaaattccagttaagtggataaattttaaaacatgtatttatatgttcaaaaacaaagccagcaaaattttgaaacccattctaatggcagtggcttgccctattagatattaacatatatcatggcaatattttaaataatgatatactagcacaaaaaaagatagccagattaataaaatagacaattcatagcagatctagaaaatataatattgtatagtaatatattcttaatatttcatattattacattttaataatatattaaaatggccttccacatcactaaaaaaatttgatgagttttttgagaaataactttggatactggctatcaaaaactcaaaaaattagatgtctatttcataacttacaacacaaaatgaagatgaattcaatgtttcattattaaaatgacatcatgaaaaagctacaagaaaatacgtatttttaaaagtcctgaaagcttactatggctattttagtttaaaacgaatttcccagttcaaagattgacctgtgaacaagatataatagtaaacatgaacttatcaggtaagagtaaaacaaaatattttattgacatctgcactctgggagcagtggtgagaaaagagaaaggtgtttagcaccaggaaagagagacatttggtagtcagtaatcaagggagggtttgcttatttatattactcttatttagtagagagttggtagtacaaaagaagagaaacctttttgaaagttaatatttttggccaatccaggcctttcacaggagatcttccataggactgttacacatttctaggcataacatgacagaaagtgcagaggagaatcttgatggatgggccctcacaatttgtttaaattgctgtagggcaagtaacaccaaatatgaatagatgaattacagaaatacaattgtaaaatatatgtcagacaacagattaatgtatgtattctcaaagagattttgacaatcaaaaggaaacagaggaatattccaaaagaaaaataggcaaagtaatgaacaggcaatttgcaaaagaataaatacaatggctaattagtatacaaaaactctaaatctcattaggaatcaatgatattcaaatttaaataataataaaattaagttcaccactgatgtatataaagatgaaaaataataacacccagttttggtgaatgtgtgggaagatagataaattgatctgttactattatgtatatgactatgaacagcaatttgagagtagctatcaagaatcttaaaggcagggattacatgcctaagaatttttccatgaaaataattgaacaagtaaattgttgtcatcttcttcatacacaaaggacgccatgttgttaccgagattaagataaattatttattttttcagaatgaaaagctatttactattgtaaagactctgtcctcgcagtagactaaaatcaagaaaacacaaagactcttttttagacggcacccacaattcaaaagctctaatcacaagaacaaagagagacacagaataaaagagacagatggagacaatgtgagtcccatttgagcacctgcagggaatgggttctctgaacagtaaaaagctggaagccgaagcagggacacctgggcattacccatctttctttccctggatgagaatgaagccttgctaatgctaacttcaattcaagaaccagaagagcccaatatttttatacaataccttaaatagaagtgcacagattgttaatgttaagttcttccagaaggctgatgtaagctctgggtacaaaagactcatggctcagcacaaatggggccttttcctacaccactctagttagtatgggcaacaccaacagcaattctgtgatctattccagaaccaggggccaggaaatcctccgacagaatgtgccatgctaaaccagaaatataacctaacttaacacatacacatgtacggtctcttctcactaattggaaatgtgcaacacctttacaactatgtacctatttaaattcttaagccatttttatttttaatttcttaagccatgtgcaaacataaccccctgaaagagggatcaaacctgctctagagtttataaacacaatctgctgaaacaagcaaaagcatttccatttgtcatgcttgatatactcagcccatcctgtaatttgaacaaggttattcattaattaccttggtaattaatgttatgtcaatgttatgacataatgggtgtcaatgttatgagtttataactgcaaactggatgtttttgtgtccctctccttacatttaggcaaaaaactgctttaaatatttctaacctttgctactgtatttcctctgaggctacacgatgccaagacagcttaatagaaatggaaaagtgcagtcagtactactgtaaatagctttttcatatgaaaccaaatatgcttatgtttgtaaatatccaaagagtcatctcattggaaaatctttaagtcaatgttgttggcatcacagtaatactgttgagtttctagagattcaaaatcatctctccacttactaccatttcaataaaatacagtctttctcattctccccctaatgataaccttgaaaccaccattgcaaaattataactgagacagtgaaagagatctgacctaacgaactccatcttgcttctaaccttcaagctgtcctgtccctttgggaggaactttgtttatagtttaaatcaaagatgataatagccctttctgaaaacaaacctccttcctgcctggggactagactgcctttgtaggactaacaaattagccacaagattagaaattatggtttaggaatcatgcagctggagactacaagattccgaccctccccaaattgctcctgagggtaacatcactattgtaaagcctaagaccagtgcttcagacattttccagaccctgtacttgatagatcagctggcaccacccaagatggataagctggttcatctgatcttgtgatctccaccaaggaactgactcagtgcaagaagacagcttcgactccttacgatttcatctctgacctgaccaatcagcacttccaacttactggcacccccacccaccaaattatccttaaaaactctgatccccgaatgctcagagagactgatttgggtggtaataaaactccagtctcccgcacagccagctctgcatgaattactctttaattactctttctctatcgtaattcccccgtcttgataaatcggctctgtctaggcagcgggcaaggtggttacaacctctctcatgatattaaatttaatactagactgaaaattcactagtatgtaatttttccattcccttcctgagcaatgtccagacgtacaaaaagccatttcaaatgaccattaagtttttcattcattcagcaaacatctattgaacacctcttagctatgcactaaactaagtcctgagaatgtaaggtcaagtaagtcatgactcccaccctcaaaaagctgtagtctagggtggaggcagacaagtaactttgcaattcaattgcagtatggtaagtgctacctactgataaaggagcatgtaggtggaacatcgaaatcagactaacactaacgagggtgatctcaagccagagaagcctttctagaggtgacttttgacctcagttttgaaagataaagagtaaaaggtgaaatggggttttgaaaaataaagagtaaaaggtgacatgtcaaaaacagaagagagaattattcaggaaaaggaacaacatatgtgctatcataaaggtgggcatgacccatttccagaatcacaaagtccagcatagccagagaaaagggcacatacagtacaaagacaataagaaccttttcaggacaggtatgatgtgttaagccaaggagttgaggcaggatgctgaaagctgcagggagctatttcatgactgtaagcaagaggaaagtatgatgatagaagtgttttgaaaacaagccctctggctgctgcacgtagcccactagagagaggggaataaaatgttactgaaataattaagataggagcaatctagtggggaagaacaggtttgcaagatatttcattaccggtgaaatactgaaagcaagtttagtagtttaaactggttcaagtttgctgacttggaagaccaggttggatgctgtttaactcactaagatgagaaactcaagagaagaaataggtgtgaagtgagagttaatacacctaattttgaacttgatgagttgaacatccaagtgaaggatacagttggagaagtgaaaggtctagatctttctagagagatgagaatcatctgtatagaagagaaggctgaagccataggagtggtcaagattaccagtgtggggggtgagtggggggttgggggatgcagaaagaagaacagaggaaccagcatagagccctgggaaattctacgttgaggaaagcatgagtggtagatagactacaaatatttaattgctagaagaggagaaggaaaagaaggaaaaaaaggaggagggggaggaagaggagtaggggaggaaagaaggagagatccacagatgttgatgaaaaactccaagaaggttaagtgtctcagatgctttaacaacataacttaggatgagcagcacaaatgtttggagccttcagcaacgtgcaaatcagatctgaaggaaatattggtacagggaggaagaaaaggagaaggaaccagattccagaaggctgaagagggaaatgggcagtgtggctgtagtgtagggcagttttccaaacagtttattaaagaagagaaagaagaatgcagacatcctcatatcaaccactacatttaaaaggactaattattattatccaattctttcacaaggcatatgttggcaacatccttttcaagcagaaataaggtctttttaaatcaattttaatggaagaaaagatatactccctttccccattctaatctgatgacaaaagttctaataaagtagcagtgagaacaggagcagtagctgggaattagagtgaatcaccttgagattccatccaaagttactcaaaattgtgtttgcacacacacacacacacacacacaccacatacaaaacatagtttatattagtaaagtataaataaatatgttatattcacctcttagcatcttacatctttgataagaccacggtgttacgtttagttacctaatatttaatagcagtgttttatatcacttctttccaagagatttaaatcactgttctcaattttcctaatgcaatcttctctcattattcctttttgagattggtggtgatcctcccacaacccctttgtataattattttcagttattactaatgcttgtttataactctgatttaacatcagctataaattacagtcatgcaccacacacatttcggtcaataacagactacatatacataatactgaatttttactgtaattttctatgtttagataggtttggatacacaaataccattgtgtatctaatactaatacaattgcctacagtgttcagtacagtaacatgctgtacaggtatatagcctaggagcaatatgtaccatatagcctaggtgtgtagcagactataccatctaggtttgtataaatacttctatgatgtttgcacagtgacaaaatcacctaagaacacatttctcagaacatgcccccaacgttaagtgacacatgactgtatcaataactataatggtctacatttatatagtattggtctgagagatcccaaaggacctttccaaacaatacatttttcacataaataaatgccaggcaacattgagaatgataaaagcaaccagtcacacaattaacatactgtttacctagctcctgaacaataaaaatgcttctcaagactcaagctgatatcaatcacaataggtactccactgaacaatatgccacaagctaatatcacctctgattattaatatggggcaattttttattccctaggagataacttgtatcaagtcaaattgaattggtttgtacaaacagtacgaagacagaaaataagaaccttttcaggacaggtatgaaaaggatcagtggcattttttaaagtcttgactaaaatggtactttatgcataatttatataaaatctttcttatactgagctttttctgctaaacagggaaatctgtgctgataactgaaacaaaaggtggtcccaagtcacaaattgagactcaagtaagcactccttccctgaccttgaacaaatcatttatattgtttacctcagtttcactgctttggaaagaaaactctatcatttctgacatgaactcagcaattcttgatttgaaaggtcatgaaaatgtgctgagagattcctctttccacaggtggttttggcagcagagtcttgtcttaaagattcacgttattcaggtatttttgttaacctgccataataagtagtaatgtagaatttcaagaaaataccgaagcatagacatttcccaacggagaaactctaacaacttcctgcagtaaaccacataagatattaacaatagaataacccaaaatacatcttcctatctaaaactgatattactatgaaaatgagaagttgaaagtgggggaacttaagaattagtgataaataaaatcaatatgggcaattaactatcctctatatagaaaacaattgcaagtataaaactaatacttgcttatatggctgtgaataaaaccagtgagacgtggctacagagagtaggctttcaccattacactcttctggtctgactccaccaaaaagcttttagaaaatagattactggcagtactcgggatccactgaatcagaattccgtaaatctgtgtgcgtacgtgtgtgtgtgtgtgtgttcagtgttcccgagttgattctaatgaggctgtttccaatacacagaagtcactaaccttgcttacctgcagaaaaccaccaccaccaaaaataaaacactgttttcaaacagaggaaaggaatcatattctccaagcatttggttttccactgggaggactgtcacacaatagcttttaattcagagatgcacatgatatgtctgcaagggtagagaattttgtaagcatcagttgctctcctctctgcttaccctgggaacaggccaggatttttccttgtaactctggtcctgaatgtggcagaagaactgaaatgtcctcaagaagaccggtctaacacgagctgacagcatgatgtcatgacaagaacaaaagttctgaggagcaccacaaatagagactaaaatcctagctttgttatttacgatagtataataataaggggaaattatttcccttattaatctccctgagccttcgtttccttctttgtaaaatggaaataataggagccactttcacaagattgtgggaagcagtacagcatgatgtttaagagtggatgcaaatcccaatgctgtcacctacttttaaaagactaagttccttgtctgtaaaatggggatcccaagagtaccaccttcagagagtgatgaggaggaggattaaatgagacaacacatccattacagtcatccatccctctgtataagcttggaattggttccaggacacctaccccccacaccaaaatccgagatattaaacttccacacttggccctgcaaagccacccacaggaaaagttggtcttcagtacaggcgcgtttcatacctgcaaaccctgtattttccatctgcatttgggtgaaaaaaaatccatttgggtgaaaaaaaatccattagatccatacagtttaaatctgtgttgttccagggtcaactgtattattattatgattgttgcagtaattaaattaaaatattgtaacaaaattgggccaatgtttaaaccttattctcacattttttaactttatataggtagaaagacatactggctatgctcaaaagtctatgtaccaccagagaggctgaaaaggcaagggaaaaggcagcttgaaggcaagttttaggactgcaaagcagtcctacaacagtatcctatttcctttaatttgggactttaaaaaagatctgggtaagcatttcaaggattaacctcacagcccccaccccaccacacttaccacttctccaaggccagcccgcacagccacctctcctacggagcatggtggccaactcaccattaatcaaccacgccaaatattttaccctcagtgcccagactcttagcctgccttctgcctggaatataaccgacaaaccaagtccccatccagcaaaatctcacttactcccgtaagacctgacaaaatactccttcctctttctctaagtttctcagtcagaatacattattccttccactggactcccataaagcaatcatgtgtatacctaattctagtcactagttaattactaattctggtcactagttaattactaattctggtcactagttaattctgatgtattttaataattgcctatttataaggctggctttcctttagatttcaagttttctgcgggaagggactctatcttacatatcttcatttccaccacttccccaacagaggctgacccgctgtctggcatattgtaggtattcaacacaaatttgttgaaatcatatttatgcactggggactgcaatgaatggagcccaaagctcacctcaatcacttggtacctcccctaatggctttaactcattgtatggtatatactaaatgaaagtgtgctttgaaaaataaagcataaagccattcatatctgaaaagtagactagtgcataactgagcctaggacatatgtagtacgatttcagtgaaaggatacaactgattggcagtttaaaaagtcatgttcccatataaaggtattatagcttaatgtgctataatgcagatccagtaaaatccccaccactcatttttaaatatttgaagacatataaggtaatgtctcaggaacacagattgattttcagtggatgtgctattaaaatgatccacttttcatatcataccctatgctgaccctttagacaagtgtcttaaactatactaaattatatttcaatcacaatcctatagcaataaaaaataaataaaaagaatatgcacctggagcgaaaatggaacagaaacatagccattgctaaacataacattttctctattttggtattacttttaaaaatttagtattacttttaaaaaattataccaagtggaggtattaaaattttcaatcaaagtaatatttgagttgcttctctaacagtatacgttgtttacatgtttttgtaagccagtctgtttcttcttacttcatacaatagtacttacagagagaaattatttagaatagtggctctcaatgtagtccacagatccctagggggcccccagaccctttccagtgatctgccaggtgaaaaacattttcatagcaatattaaaattgtatgtgcctcttccattgtgttgacatttgcacttatggtaaaaaaaaataagaaaaagaaaaagcaacaatggtaaaatcactgatattttacaatgaggcagacagtggtgccgaactacactagtagtcatcatattcctcactgctacacacttgcaatggaaaaaataaaaaattgctagtttcacttaagaatggccaagataaagaagtaaaatttattgattaaaaccttgatgtgtgagtaaaaaaacagtgaaatgtaaaactaaagcacttctgttccagaccaaagcatgacgcttgactcaggaggggtgggggagcatttatatgattgagttgtgatctgaattagccatctttttaatggcatgttttttcttgaagaaacgactgacatataaaccatggttattaagacttgggtgtttggaagatttttcttaaaaatgaataaacttaaactattagctcaagaaaaactgacagaattttctgccaatgataaaatttgggccttcgtataaaaatattttggaaaacttgcatactcctcaaatcaagtccaggttttctgatcagagttttctgattacactggtggtgatatcaactagcgtaatgttttgttattatacaataaaatgttccaacatttaaaagagatacataactcagtgaaccaatattttgcaaatatttcaaagcttctatgattaaaatatctatttaaagcacaacatagaccaatgaattttaagtttattgaactgtctcagaaaactgaaattaatctttatcaaacaatatttgtcagattttggtgtaataccaaagattatctgaaaatgttatgaaaatactcttatgttacaactagatatgtgtcagaccagatttctttacattcctcacccagaacttaacatggcaacagattgaatgcagtggaagatataagaatgcaagctgtcttctagtaatccagacattaaagggatttttaaaattgtcaaacaatatcactcttctcacaattttttattcttttgcaatggctatttttcattaaaatatgttatttattaacatgtaattgatttattattatttttagaatgtaacttattattttaaaatgaatcaaacacattttaaatgtttctcacttttaatatctgagataaataatcaatgataatgcacacaagagcttcctggaatccttaataatttttaagtgtaaaggtttgctaggaccaaaatgtttgagaactgccgatttagaatttatatgttaggattctctacaatttaatagaaaaaaaagatcatttctctggcaatgctatttttcattctgttgagtttgattcttatctgtatagattcaatgatcttcatgtcatttattcaacatttttcagtccttgctatacgccagatatagtggaagaaaccaggacacagtttctgttgtcagggtacttacaatttccattgttattcatattaagacatagtcatatattatattatattatattatacttgtttctcttctgtgtgtgtgtgacgtgtgtgtctgcatctgtgtgtatatgtccaactgcttcctaaatatcttcacttgaatattccacagagagctctcataggtccaaaactaaaattattcaatcgcatctgctcaattaatgaaaatgtattaccttgtactttgcttttgggtttttttccccctaatattaacactaggcataaaatgtgaatagtttgtctttttcttttgtgatgataaatcacagctgtgaagcttcattcttttctattctgttccacggtacaacctctgcttgtaaacatattctccctaagtcatgcttattgaatttcttcttgcacactggattttcacaagattattcctcttaccttgtgtttctctccttccgaatattaaataccaccctcacaataaaaagctatttagaattacgtgtacctgtattccatttatggcatctctataattcataagcaactcagatatataataaatttatatgtacaatagatatataacaaatttatatcttctgaaaattctcttttgatttggatatatttatttgccctaaagaaagctaagagaatactgcttattaaagtcacaaaggggccattataaaatattacaactagagttttaatgtgatgatttaaaacaaatgaagtacattcattttttcagctcaccagggaaaatatcaaaataaaaatttagaagattcatatgtatttaaatatcacatttcctgtgaattagacaaaaattatacaaataaaccttcaatgtatggccatggcaatggagacatttctgtgttatgccatagtactcatattactgaaattatattcataaactacatgagtcattgtatgttccctaacattacaaatctttaatagtggaagactctaaatttatgaataaccaggaaattcatccatggttatctagaatatagaaatgaaattttctgattcagatattattattgctttattgagaccaccatcataacagtaccctaaaagttaaaaatttttataattagtaacaaaaagcaaaatttaaactttttaaatttaatttttagatagtattaaaacgcattcaccagttttacacatttatgttacctgtttgactagtccctctaagaacatcaaattccctggttttgataatttgtaatcaagaccaaacaatccatttgatgatgacttactagaatataagcctagtaacacatcaagaaactacaatgactcccttttgcctacactaccaaatttaaattattctatttggttttaattaaatattaaatttaaatttttagatatttaaatatctaaaattgctcaataaagcgcgaaatgtcttgataacaatgatctttcatacaaggaatatgcaatataaattatacttcaatttttcagtttcatacttctatgtagtttataatgactgaatataaaagaaagaacacagtaaaccactgtgtagttactgtgttgttaatggtttcatgctaatatgttttgcttattatatttaaatgtatgtatcttaactcctaattgaaatatatttttttcatgtttagggcaaagcgttagtcaaatgtatcattggtgccctcccaacactatattacactattttcaacataacatatattcagtaccattaaatgtcaaatcacacttcaatttaccttggaatgcctggttacaagaggatagccgtatacatagacgttactttctcaaagacagactacttgtctgtagtttgctattactgtttcatgcttcataacttcaactacaaaaatattttgttggacaaaaaaaccacatttacatttgattttcaggcatttaaaggtatgcattcctagccacttgccctattatgctctgtggtcatgcattctgccagttttacacattcatgttacctgtttgactagtccctctaagaagatcaaattccctggtttggataaagattttataatcaagaccaaacaatccatttgatggtgacttactagaatataagcctagtaacacatcaagaaactacaatgactctcttttgcctacactatcaaatctaaattattctatttggttttaatactattcatattctgatgctaacatattaaccaaccttattctcattactaacaaaaatatatacagtattcactgtattttctttatgcttacctttctcaggatgctaataatattcttcctattttctccactttcataaatactatggatactttttctttcagttttgctttgagtaataaaaccatacaaatacaactgaagaattataaattttccttcagtccaattcttctccatcgcctccttgctttccagagataaacactacctcggtatttattattcctgtgtatatttgtattcactttgcatataagtttctatctacaaaaacatatagtatgtattaatgttcatatattttatattattttattgtgtcatattatcacactattctacaactagcttatatcactcatgttttctagatttacctatattggtacatcatacttaatagtaaaaaatgtaattatttctgtctatgataagaaaaaagacaaggatgtcttagtttgtgtttttccagtacaattcaacattgtaatggaagacctaaccagtagcataaattaggaagaagaattaaacatcaggcatattggaaaggaagtaataaaactatcttcatttgtagataatatgattaagttgaaaggcctaaggtgtctaccaaaaagcagctgaaaaaatatgagttaataaagattgctggacacaaagtgaacatacaaaaataagtttttccattaccaaactagaaatggttattttttaaataattgcactcacaagaccatcaaaaatatgaaataaagagaaatttaacaaaatatatggaatacctacatgctgcaaatttaaaacattgtggagataaattttaaaacatctaaatagtggaaagataatgttcatagatgggaagactgaaccgtaagatgtcaattctctccaaatctatagattcaatgcaataccaactaaaatcagagcaggtcgggtttttttttttttttttttttgtaaaaattgacaaacggattataaaattcatacatagatgcaaaaggcatagaataccaaagtaatttttaaaaagaaaaacaaagagaatttacactatttgatttcaattcctaatataaaactataataatctagtcagtggggtattagaatatgcatacacatatagacctttagaacaagacagcaaatccaaacatagacttacacatatgtattcaactgatttacaacaaaagtataaatataatacaatgggagacagtcttttcaaatactggtagtagaacaattaatattgatatttttaagataaacctcaagcttcacctcttatcatattttaaaattacccttcactggctaggtaccacagtacctcacacctgtaatcccagtactttgggaggccaaggcgggtggatcacttgaggtcaggagttcgagaccagcctggccaacatgatgaaacctcgtctctaaccaaaaaatgtttaaaaattagccagacatcctggtgcctgcctgtaatcccagctactccagaggctgaggcaggagaatcgcttgaaccgggagggagaggttgcagtgggccaagatcatgccactgcactccagcctaggtgacagagtgagactccatctcaaaaaaataaaaataatgaaataaaatcacctttctaaggatcacagacttaaatataagagctaaaactataaaacttcgagaagaaacaatgaaaaaaaaattcataagcttgagttaggcacaaatttcttagctatgaaagacaagtaagattcatttttagaaagttgacaaattagccttcatcagaattgaaaatgtttctcaaaagataccattatgaaagtgaaaagaaaaatatttgttaaatatataaacaaatattacatatttttatataaaatatatataatcatatatttaattaataaaggtctgattttcagaatgaatgaagatttttacagttcaaggggaagctgtaaataattcagtttttaaaaatagacaaaagatttgaagatacttgatcagagaagatataggaatggctaataagcttatagaaagatacacaagataactagtgaccagagaaaggcaaattagagccacagtgagtaatgactatacactcacgaaaatagctaaaattaaaatgactgacaatatgacaatatcaagtgttggagaggagtacagcaactgaaactgtcatatattgctgttagtgatgcaaaatggtatggtcactttagaaaacagtttgtcagtctctcgtacagttaaatgtcttcttaccatagaatcttgaacttctattcccaagtatttagccaagagaaacaaaagcatatatcctcacaaagagctgtacttgaactttcataaaagctttattcttcacggggaaaactggaaacaatccaaatgtccatcaactaatgaatgaatacacaaattgtgatatgcaaaaagggaggtgggcaatgaatgaactaccaatagacacaacacaggtaaattttaaaaacttcgtgctaagtgggagaaagaacacaaaatctgcaaaagatataactccattcatattaccttttttaaattaaaaaaatctactgatagaaagcaaatcagtgatttctaagaaatgggattcaggacatgacactgcagagagacaggagagaacacttgaggtaataaacatgttctaaatcataactgcagtggtggttacaccactgcatatatttgttaaaaaaatgaaacctcaaattgtacacttgaaattgatgggttttaccgtgtctatattttacctcaattaagccgacgaagaaaaaaataatgggctggaaagaaccttaatgtccactcctcagcctcaaaaaagtcatgaatgttaatatccaagcctcaaatatgactgtaataaactttcaaaagatttaccttgacttcatatttgttttagccactgtcttccaattctttaaaacgactctttttttggcttttgctcctcagttcctgttttcacttttcttcacataatctcacacttagagagaactagtctgactctattagtcccagtgttctgtctaaattataaaggttctttgctttctcttttagacacatatttttttcactaataagttttcccctgcttctacaaaagcagttatcattagaggtggtataccttaattaccatagtaattaccttaatcaccctgtaattaggactacaactaagggtgaagtgattcttcaaagtcacaaatcctggcttcaccacttaacttgtatgggtactagatgtatgcttcagtttcctcatctgcagaaataaggataaaaattatccctactttatattattttgaggattaaataatatagaaataatgcctagaaatctacctgacacatcataaggactcaataaatgttagcacttgtatcagtctcacattttccattggaaattccagaaagaatgaaagaaaaccaatgtgactaaataaggccacaaaatgagattttaaatctaggaattttacttaacatcaatagtcaacagaagagtcattttctgtgcctcttttttgtatggcttcttttttgaaaaaaaagaaaatattgttgcattcttaagtttctgctctgtattacaatggagagaacaatttaaacattatttctcagaaggatatttcttatacctattactaccttttctattgtgtgtgtgtttgccttgtgcatgttatgtatgtacatgtagttaaatttaccttgtcttaaagttaatttggggctcttcagaggacttgcattaattggagctgtgtaagcaacttgcattatttagacagaaaaactaggaatacccaagtccttccttggcttagccaatcctcctcctgtggaggtctccaaggaaacatacacacaaaagaggcaaaggaaggcaccattgcactttattactagctatgactttggcctgaaactccatagtgaaaattcataaactagaacagacaatagggagggctccttgcccctatttcagttagaaaagtgactcagttatataagcagggcctaattttgagttgaactggaccaatctgccccaggccttctcaggccagaagagtgatctttggtcagccactgtatgtgagaaagcacatccttagaagaaaagctaggaggcctgaactgcttagagagagcatctcactacctcattatcactggtcctttagggaatcctccaacaagagccttgctcacttgtttttagccaggtgatgactccacccagcagcaaagagttaaacctcaaatctaacccatccaattcaacctcttcctccttgcatggagtgggaggaattcaatgatgagatcaagtggagagcatttactttccattaaaagcttacagcagtcattaaaatggctatattggtggtcacagtggcatgtgcctgtattctcagttactcagaaggctgaggcagaagaatcacatgaagtcttgagttcaaggcagtagtgcactatagtatgcctgtgaaaagccaccacactccagtctggtcaacaaagcaagaccaagtctctaaaaaaaaatgactatgaaaattaattaacatttgactagttgttatccgatgtagtttgctatgctatactttccagaagcttcaattaaaatctaggaggtatttgcaagacaaaatattttcagtgttcagtagtgtcatgttcacagtgtgaacttcaaggaaacactttaaaaatcagtacttcctaactacagtagggtatagtacagactcatgtagaagacatgcctggaccctaaacactgtgagaatagccataaggatttccatgggtttctacaaagtgtttactagatgatgtgtcattttaactctaaagagcaaatcatactttgagaacttcaggaaataatatactttttagcacaaagggctctgactcccatgacagaagagaatttactatgatggttacacaaatctcttttctgtctaaaagtttttgtaccagcttttcctaggctcttatccttctcacaaatcaggactcagttcaaatatctctatcttggtgacactttccttgacttccctacctaattagtcccactctcctcctctgacaatatcctgtttctgcatggaaatactttacattttgtagttgcttgttaagtatatgtgttactaaactgcatcctcctgaggacagggattgtggtttgctcattcagctcctaacaatgcctagtatacagtaagcactgattaataatctgttcaatgactagcttgaggaatggatgcagatttagcaattttaattggctatcgtcagagcaatgtcctcttttagctcctttgatacttggagcattgaacatagaattgaaaattttggatctagtcccaattccttgactatctgtgagtcttaaatatagtgaagcatatatctagttcacctacctagttaagtggtagagccaggatttgagaccttgaagaattacttagtctatatttaaattttatatatatatgtctgttgtcaaatggcataataacactcttagttgctctactacacaggacaattagggctaatgacagaatatacgcacgcacacacaggcatatatatatatagatagatagacacacgtatatacgtatatatacacacacatatatacacacatatatgtacacacaaatgtatatacacacatacacacacatattaaaactaaaagcattaagatttctgaaatttttattgtaatttgaaaaaattcaagatgattaacagttaaaatgatttaatatggttaaattttaaatttatcatcaaagaaattttccactgagtattgaaataagaaaacctgaggtacttattaggagcttatcatctttatatatatacatacattagtttgaatataaatcccaaatgatgagattattttccacctcaaatactgaaagaatgtttattattcaaacatgggatagggaaaaaatacaaaataggcaggcagtttaaagcaatttattatttttctaagtgccatatagtgtattttattctacccctccgaatctacattttaagtgatctgaatccacactggaatgcatcaatctttatgtatttgtgatatcattgcctttgccaggaaactatgcaaagacttttcaatcacggtgattaagtattcatattcccttgtctacaaagagaaatacttaaaatcttagggaaccaccgccggataatgatatggcatttaacagttttttttcctaattcaaaccaaacattagaaatggataggctaatcaggtattattatttcaaggaacgcttgaaatgcacagggttaattttttatgttagattgaatctgttggcatagtcccttgtgttatcaaatagaatacctaaacttgtatatgtcaattaaacacctttcccatggggccattcagaatgcagtatttaaaaacctgcaataaatcgctaaagttttaaaatagctcattacattaatctgcaacagtatcatgcctaaattatgatgctcttaaaatgtagtaaagtagatagatgttgtccacagtactctgagcatatttgattcttgttcaattcttaagattaaaaacaataataacaatataggtagtgaactggctctggaaacattttcggtaaatgccagccaaaagctaacacaagctcaaatgtcatttggtttatcccagtcactgttcaaagatatgaagcaattcaaaatctacttttactcaatatctctatgaagttagaaaaatttatcttgacattggcaagaaaacatatcctttctttacatatatcattttattctttttatttatttcttctatttctatataaagagaggtagctgtgtgtttatgtgcacacactccattgtaaacttaaaagctgttgttattataaattcactttctagttagacctgtggtaggacttaaagctattcagctgaaaccattctggagtttgcaaaatatgctattttattttcataaacattttgtgtctggaggctgctagaaaatttatggactggttattttctgcttcagtaccagtaaagcacattgctatcatgctcaaaagccaaaagatggtttcaataatgctaaaaagaaaaaaaaaatccaacacaaaatggtgtttgtttattcatatattagcatatcattgtccaaagtagtatcatttaaactttgtagctcatttgaaaggttcacatagtgcaaaactgatgaagcacataacccgtaaaggtataaaaagaaagtattatgcatacattgcaataaaaatctcatttttttaaacaatatctgatagtttgtgcctatgcacatagactgtttaagatgaaaagaaaaactttctcatttaaatctactagttaattgcagtctttaacagtgaaaatgcctttcctctccctcaccccaagatagtttctgtgtataagaagtgtcaattctctttatggttttggctgaagtttatctagaaggatcagagagatatacccaagtaattcttatttaaatactacctggaaaaaatgtctgaaatgtcagtcaaaagcttttttttgcagacggctgatgtcatttcagaataaatacggggacagaaaaatcagaaagcacttatttttagaaaaaggagcaatgtacaatcaagaacactgcagttttctcaaatgtctctttagcactctagaatttattgactctagtatgtgtgacaactctgacagctgtcgttaacaactaagtgaagaaaagcaaatgtgttttcctccctggtaaaatgaaacaattacatgctaagagaaagaaaaagttggtaaccttatactgatgtttttagtactttggaactaccctagagaattagctgggagagtatgattttcttctttctcctcagtgcctaggacagagactgacgggattagattattttctgatggtgtcaattgaaactgaaacagatgtaagaatgctgtttcctagaagatgaaatatttcaggaattacatttaatattcatatggattaatcaggtgctcaacagccagccaataaatcctatgcagtaatattttccatgggtaattcttcaattcaaccttattagtttttatttatttcatcatttagacaatatttatgttccttcagtcccaacaatcacaaaaataacaacaacaatgatacatacacacacaattctgactacaaagaacacttgacttcacttttcatgacatttgaacaattgagtatgggcaaaagtttcatcctcaaatctctaagtgaaaaaaaaggatgggttcaacaaatagtgctggaacaactggacaaccccatgcaaaaaaaatataaataaatctaggcacagaccttattctctttaaacaaacaaactcaaaatgaatcatatagacctaaatgtaaaagggaaaactattaaaactattagacgataataacatagaagaaagtctaaatcacactgggtatggggatgctttttagctacagtaccaaaggcactatttataagagaaagaattgataagctgggcttcattaaaatgaaaaacttctgctctagaaaagatacattcaagagaaggagaagacaagccacagactgggagaaaatatttgcaaaagacacaactgataaaggacaactatatcaaaatatacaaagagcccttaaaactcaataatagtaagatgaaatgaactatcaggccataaaaagacatggaggaaacccaaacgtatatcagtaactgaaagaggcaaatctgaaaaagctatgtactgtataattccaactataagacatctggaaaaggcaaaactgtggagatagttaaaagatcaatggttcccagagatgaggtgggaagaaaatatagataggtggaggatagaggacttttaggtcagagaatgaacctcaacatagaactatggatactcctatacattccactcaattttgctgtgagattaaaactgctctacaaaatgaagtttattatttaaaagaatgacgataacaaaaccaagacgagaaggttcatgaaggtaatattttctttaccagtttcaaaaaaattatgggtattgtactaaaatgtaaacctttataaatttaaacctcattaatagatattaaatgttatttcataaaataatttcttcagctttaaaaattaaatattgaatgtctaacaaagtaaatttaaataattgaatctaacattaatagagacagataatggtagaaatatattttatctttattaaaaattgctgtgaaatgaagccggacatttaaaagtacagattatacaattttatttatataaagtttaaaagcaagaacccctagtctgtgctatcaaaagttaggagagcgacttcttggcgagggtgtaatgaggaatagagaacccaggaggattttgaggtgccagctgaggatttgggggtttgttttggtgttctggattctgtgtggggtgctttcaatttatgaaaattcactaagctatagatttactgcactcttctgtatgtattttatactttctctaaagttaacaacaacgaaaagccgaacaagacctggggaaaattagagctttcttaagcaggattgagtataaattgtacttgccaaaatgttcatttctatttgaattacttttttaaataaatagggcatatgacttttaagtagttctgtcatgcagaatccacttatctctgttctgtgagcatggacaactgagtcagctgggcagtgctacaaggacttttctctgattgagttgcgtgtgatcaaagggcaacagtttaactctgcaaaggaaagagggtctctttcccaggcaacgactaagtttctgaagagactcttaagctaggaggtgtattatattctagtacacattccctgaacaccttttcaaccaacaacctccaccttcttatctatcctatccttttacttgaggccagatatattcatataggttttaggtcattttactcccatatcttaccctaaggttctaataagaaatcaagggttcaggaggtgactgcaagagaaaaaagaaagggcaaactaaaaagtctaaaccttttgggaatagatgaataacaccttgaagaaataagaaattaaattcagatagcacaatattactgattacaggagatttatcagatgctttgaaatctaaggcatgtaaaggaatttgtgtggatgggcatgtatttggtgagtttttatgtgtgtatgcttgaaattcagtaaatatatactgagggtttattgtcaggagcagaaaaaaataatagttaccatttattgcatatttacactgtgccaggcatcgtgttaagttcttaagcacgaattatctcattaaatgctcacaataaagctatgagctaggtattattattttttccatccaaagatgaggccataaaggcttataaaatataaataacttatccaagatcttacaacattagtagaagagctaggatatgagctcatgtctgtctctgaaaagttcacgatcctagcctcttactactctctcggttactgagtgatcacaagggcaaacagagaaatactggggagaaagaggacaagaggagagaaaaagaattttaagatataaaggaagatgaagtaaaagaagtgagagaacagagaaaaaatacaaatggcacagtttgggcacacaatagacatttaatgaatgttaaatgaatgtttttgacatatgcacattaaataccataaatacatacttacagattttttaaattaaaattgagtaattgttcacttagcttagctagagacaaggtgtttatatgagtcaaaagttattttataatcattttaaacacatccaaaagactgggaaaatcaaaatcccttaagcatagtaattaggcacaataatttaaaggaattttttcattaatgtccctcactttttctttcttttccttttttctttttctttttgagacagagtctccctctgtcacccaggctgaagtgcagtggcgggatcctggctcactgcaacctccacctcctgggttcaagagattctcctgcctcagcctccctagcagctgggattacaggtgcgcatcaccacgccgggctaatttttgtatttttagtagagatggggtttcaccatgttggccaggctggtctcaaactcctgacttcaagtgatccacccacctcggcctcccaaattctgggattacaagcataagccacagcgcccagcccctgtccctcactttcaaactaattttgtgtttaaaccttaatgtaattataaaagttaacagatttaaagagaaaaaataatcaagtctccattataatttttgagtagattctttctgaagcaaaatactgctactgctaagaaaataattatccctaataacatgggcgcaattccattaaatacgttccatcaataaaaaaagtaatatataattttgaagaaacaagaagaaataatgaaagaatgaaccccacctggtccattctagattcattagatgcccatctcagcagtaaagtactttcctatttaccttaagaatgtcataaaaacattcacatttctgttcctatatccaaggacctggcactgctgaaaataccctgttggttggtgctgtggcagaagcatcctttccaactcctgccttgttttcacctcccaaactaatccttatatgtagtactttctaagtctgcatctttctaaagattctcaagttctcagtcccaacccactcatctcatcatttttgtaagatgacccaagcagtctaaatattctccatatattgtacagtttatatatttttaagtattgtctatgtatcatcaccttacatttaaacttcataggaaaccaaaatagattagtatatatatccttatcagctttttttataaatgaggaaacaaaaatgtatagaggttttgttgcttggccactattacaaggtgttgaatgttgtaaagctagattcaaactgagtataaaatttgtgtttctgatcgctagaaaaaatacaaactattagacataaactccttcagaaatttttcccaccacctcaaatcttctctgttcctacatctgtttcctcatttttcattcaaggctcattactgcatcccagtttagacccaaggtcagccctcaattattaagcccatggtactccacctctctccaggatttatcattcatcctgctttttttcaaatgtgatgaagaagaccaggaattacaaaaataaagaatgagtaaaagaagcccaacacaatggatgaagttgagtaggactctaggaagagctagagtaaaaactgatttgcttcaagcttttcttcaatgctggctcagtcttggcccacatgtaagtccttatattttaaaggagaaataagagattgataaaccttgtccttcaaaactataaaagaaatcagactttgaaaaccccacagtttaacacctcactcggttagaaaacagaggcaggtagaattacagtgctaaatttcatggtgatttaatgggtaagattaatactttacagctagcttgatgtttccttcatcagaaacaaaaaaattacttgtgaattgacctattcatttctaaaaatatttataaatttttaaaaagtgaatgtatatacagtaatattgattatatagcaataagcagagacttcaagaattacatatttccaaattattaatttcctcaattgtatttctaatgagacaattattaaaggatattatttttagatcaacagataatcaatcatatttgactttatttcatttactagacaagtaaatttaatcataaggaaattatgcaccataacttcaagagatgatgttttatgtcaatttttccatataatgaatttctgtctcattttctacttataaaagtagatgagggcgggctcgatgattcacgcctgcaatcctagcactttggtaggccaaggtgggcagattgcctgagctcaggagtttgagaccagcctaggcaacgtggtgaaaccccgtctctactaaaatacaaaaaaaattagccggcttggcggcatgcacctgtagtcccagccactggggacgctgaggaaagagaattgcttgaactcaggaggcggaggttgcagtgagcggagatcgcaccactgcactccagcctgggtgacaaagcgagactctatctcttaaaaaattaaaaaaaaaaaaagtagatgaaatagaaagtagtgtcaagttgatatatcaatagtatatatactaaaatactgaattatctccagtaatgaggttgtcacaaacagttataaagagagatcattggggaagttaagatacttctttggtttctagtcaaagcacagtacctagaacagagtcatcattcaaataattctgtatttccttcctctatctttgacttctttccatttcacatgtacctttactttcctattttagatactattttctcattgtgactactggaactatctcttaaacataccatcgctgcctttaatctcagttgcttcagttttcaaattgctgccatagtttcttttctaaaacacttaccctagcacttcactgtcctgctcaaaaagctccattcctttttccctgctgtgtcaaattcaaagccaaactcggcacaggtttctaaccaggaccaagctcatcttactgtctcatcacctgactgcccccacaaccactgtgttacattcttccacagtggatgctcaactttcttagaatgtgaatgctcttccctgtcttcaagctattattaaactgccttctctgtcatgaataccttttccacatctcgaccaccagaagaaatgtcactttctatttgtaacttaaattagatgtcacttgctctctgtgttgtaatctttaagcttcccttatgtagtttcttaatctcaaccttatactgtgtttgtaaatgctcatgcctctatcatatcacttatcaaattgaattattgttagtaacaggtttctgtacctccactgttaagctatgaaatttgacaactcacagaaccacattgtcttaatctgtgtattctcaattttaaaagacacagcactcttgtaaaaattaggtaccttagaagagaatcaataaaatatatgtaaaataaataaatgatttatgaaagataaacatgaacataaactaaagaaagacaataagaacactgataggcatctattttttttttcttgtaaagaacgcctttgactttaaaagattatgtagagaattcagacctggaagagaactcaaatattagatcattttagtataatctttccatttaaaagatgaagttgagaggcttggatgggctcgcaacacagaaaaatggcagaactaggggaaaaaaacctaggatcccaaatacacagtcaacaccattatatagtgttatgccaactttactgagagtcatacagcatatttgaaaaaacaaagacatttcttgtttatggacagaagagctaagtatgggaaaaacgttaattctttctgaataaatctgtattcaggcatgttataatcccagtagaaataactaggcagtattttctggaattttaatagtattttaaattttaattatgagagtaaatgagcaaaaataactagagtgattttatactatacaatatattgttggtgggttttagttaaaaacaaagtgaaattgtgatttgtttttttcaatgaattactgtaaatataattactgttaataattttcttagaatacctttctagaaataagaaaataagaatttgatatgtaccaagcaaatgatctccaaaaaaacaatgctgatcaatataatacattttagtaactataaatgtttaagtcttcataaatttgataaggggaaaacagtctctcattgatgaattggactttctttgattataagtgagacttaacatttttttcaaatgtttattaacatttacaagttttgtcaattgacctcttagagattgcatagtttatatcaattcatgtggctcttttaatgtttaggatattcatgttttgacacaacacccccccaatgaatccttataatttccgtttttgaattatgttcatgataatttgtaatatccaagtgttacatttttaaagaatcaaacatggcattttttaaaataatttcttttactgattttaaactttcccattcaaatcaaataaaccttcgcctacattttcttttattcttttgcttctttttcacataattctaaaataaatttcaaatggataatactttcttatgtggaaaaatcatctcagttgaatctactgtaaactcttaatcaataaaatgttatttcccagtgagttctaaaagccaccattatcatatgataaattcatatatatatatatatatatatatatatatacacacacacacacacacacacacaattgtagaattatttacttatttatcatcattctatgtttctgactatttctatttggtttcatttatcacatgtctattttggtactagtttcatactggattgattattgtagtttatcacatgtctattctggtattagtttcatactggattgattattgtagtttaacattatgcttaagtgttaaatgtttggtaggaatatttttccttaaaatcactctagttatttttgctcatttactctcataattaaaatttaaaatactattaaaattccagaaaatactccctagttattctactggaattataacatgcctgaatacagatttattcagaaagaattaatgtttttcccatacttagctcttctgtccataaacaagaaatgtctctccgttttttcaaatatgttgtatgtctctcagtaaagttgtcttcaaacaggttcaatttattccaaaatattttaaataatttttgccaaagaaaaaaagcgttccagttcccatgtattaacaatgacttcttaatactatgtagaaaagtcttaatgttctaatattaatgttacattttatctttctaatataattattgtcgagatcaaataatttgaaaatcatcatgaagtaatttttcccttatagtaataatctttgtcatttttgtttcatgtttatcacactggttaaaactgatagaatattaataatagtggcaataggtttgatccatctcttgataagagtaactataaatataaaatgttatagactgagaaagatgtgctttatcatgttaaatatttgttcgatttctagtttttttgttttgtatttgtaacataaattaggctaatatttttatcatatgactttacacaatcttatgaaatgtttattattgtcttatttgacctattagcatgattgtagtatattttctaatgttaaactataattattcctttcagatagcttaaaggtattttatgctaacaaatttccttcaaaatcagactatagtgttcagagactctcaaattgtatatttggaaattttgcattaactctttgaaatcaataaggtttctaaaggaaagaagatgctgataacttctatctatgtactggtctctacaatctaacaaacgtttccatattattcttggaatattgagcactgaaatatttagatcacaactcactgctgagtttagggaagctgctttcttcctcttggtgtcagataattcaaccccaatacaagggtttgcattacaaaattctgaagttgactcttctctccaattatcacagatccttcctgattcctgtctccctcaggctaacacaaactcatccacctaaagaagcaatgagattcagatacctagacatcacccctctctcaggtttccaactccctgcttaagctttccccataaggcacttacagaaactttctaaatgtcacctttttctatagggagtggtctgtgacaaccaagtttgtactacttcctcctgtacactgataatctggaacagatctgacatacaacctaagtttggctaatgagattcaagcttccaagaagctgacattgagacttaaaaaaaaaagttagttttaacaagtgtcttaaagaatagctaaaccctggaaatggagatcctctgctatcctgtgaacctagaagaagagaaaaccaatataaagagaaacagataaagcagacagacagaaagacagagatgctttttttttcttataggtttttatttcttaggaccagttctttctttagactcgtttctattcccgctatgcggtttcctgatgcacattcacaaattcttaatttcagcttaattaagcaagttttagttggtttctcaagttggttggttacatacaatcaaacaattcagattaatatgccactgtgcttgacctgccctgatatgagctcagctatagggcaagggagtagggaggtagctctgaaattctatccaacactttctttatgataaataaggttctcatagcaacagaaaaatctttgattctatacaagatgtacagaattaatattttattgcctatagatcagtctggagtaaggaattgacaagttcctaaaatatctaacctccttttctctatatttgttgataaatcttagggtttaaaaattatagaaataacattttgttcagatagcagcaataaaagtaaccctaaaaggaaagtctttgtttccttctggcttcccaagtagacagaagatgttaagaaaacttgtaaggaaaacatgagtaattctggatacactgtgattcagaatgtgcttaaaatacagatgcagaagatggttcaggtacctttttttcagtgattttaaaaaatcagtttcagtgattacattcaattaaaccaccattgtagcttatgtctttgatgccaattagtactctacagttcagcagtttgactgaatattccagctttagttagttattttttaatgaaataattctggcctgaaatactagtcatttatcactctaaattctaacatattctttgctttgtcaattaaatgatacactggaagaagcacaatcttttacatatctttaaaccattgcttaagtaagcataccacatacctggttacaatgtgagaaagattaaattttaagaaacaaacagttctctttatttttgtaccaactgtctgatgagcttccagtgctctggctacttcaccttctgctcctataaactggaagcagaatcttcctccacaccgataacgtggttttactatcccaaactaaaaaggagcatacaaagaaatgtatcctgatatctaattatgtcaaaaagaactaatttaacaacaattttatctatacaaaaattaaacattgggatagccactattcaattttaaatgggcattactaagtaattccatctaatgggtcaatttttttaattccttgagagtaccttttgtagctcactgatcctggcagacaatctagaaggccacactgtacaaacttggcagttgccttataaagctcattctttgacaactggcaatagctaggctaaaaaccttctaatatataatgttttttgttgtcgtgtatagtaagcagctctggttctagtcaagcacatctgggttcttcagaaaattaaaaattggtcctgagcaaaccttgttttggccaatggcctccttgcacttttggtgttagggaggtgggtcagctgtcccaccaggtgagaacactggctatcaccaacataatcaactcaactggtttccaattaacaacataacatagctgttttctaggttcctaacagctaacacaagctccaaaagtctacttccagctgctattaaatccctgcgaagagcaatgatatgtgtgtaagtctgcagattgtatgtgtgcttcatagagccactgggactcttcaaggtacttccgagaccagtaagcaggactaaggaagtggaccagccagggctatgccaatcccttaacagttcttgttttttaacagattgaaatgttagatttctgagtaggatatttttgaagatagagtcttaaaactagagtataagggagatgttcttcatttattcttcagagtatggtacatccccgtatcatcagggctcaaaagagttatacatctaaatcaaggatgattatcttcctcctccttggaaacatctttaatgaaatatactatactttcagtgttataagagttacatcatttcttaactttgattgtgggtacaaatgcaaaacagccagagaagacttctgcttttgctgtaaaattttgtaaaataacattgctcatttggctgtcaaagtcgcatatgacacctttcttttggaaataatttccaagaaaatgtgttctctcttgaaaaataggtaagcttgcttctatcatataatgaaaattataaatcacattgtcggtccctttatgctttgactgcttaagaagctcaaaagttaatgatttcatcctttattctgcttaccatatttgtttcttcctcctttagtagttttgatggtgtacttttatttgaacagctttgtgtgtcatttttatcataaacagaatgaacatgaatacataagtcaataataaaattaaaatgtgatgaatatcctggaaatcactgaaaatcaacagaattatgtattctatgatcatttgcttatcttcaggtctcttatcctgtattatcagctactggaacacaaccaagactcaagcccagcaaaatcaatctccaaagagctcaaagagattgtcttttaagttcatatactaagatttatttattttccataaccctcatctgagctatatgttgccttatatcagacacagcacagttctattatgctccaataggttcttgttgctttcgagatgaagaacaaaccttaataatggcctataagacctcacatggtattcatggcctggcctattgccctacccttatctcagacacctactcccttcagatttcatctgttcctaaatccctatattagggaaatgtccactattataaactctaaatccagaatatctcccttttcagcactcattgcagattacataattatatttttgtgtgcttatttgattaatacctaagttctccaggaaactcgaagtgccatgaatgttttgtctatgttccccagtaaagtatcgtcagcacctgtcctaaaaacaagcacagcaacagcagcagcaacactttgataatgtaaaaaaaaaaaaaaaaaaaaaaaagtggacagaactcaaagattattggagtctagaggcaaatccttttaatagccattacattaagatattctttaacagtctttaatagtatcattatattacaggatggtataataattataataattgaagtcatcaaggaagggttaggttttgatcatggttaagatgaaagacaaattagtaatttgcctttaaaatgctttctttagtgcttctttaaaagacttccctgtcttctggaggtgagcttcagttctatggaaacttcactcatctgcattattcttcccacttcttaactagcaatattagataaaggaagtgttccccaacctcaggttatggtaaacaaccttgtattgcaacattcctcttttgatcaatttcataattgcataaaaattattttcaaactcctgttagtgttcatattcccaacaaaaagattaatgttatgtaatgtttcacaaatattctgccacagacgatgtgtgttgaatttaaaccaaattctgtcttaggttgcctttaaaggaaaaatgcaaaaaaaaaaaaaataaagaagaagtttccacttgaattctaaattgaagatgacctcgtgcttttctgagaaacgctggcaactgaggtcactggagtgtgttatgatagacggtgcagtgctgtgcgtgtctcaaggcatgtccattgtatggattaaagccaaaccaaaagtattagacagctcagagcattctatcatttcatttgaaaataatgatcaaagtcatgggcaacaaccattgcaactctcatgaaagaacagcagcattcaataattccatcacttcagacaggcagttgggctattttcaatcaaatactgtgaatccagtatattctgtatcagtttctcgtggcagtcacagaaacaacatttctgcttttacagtataaaaatcctgcctacattgtgtgcatccctttgcttccgaaggactgagtcattgagaaaaatataaggaaacagaaaacacagaaacttaacactcgttgagtataaatatacagcaactccaagtcatccattttcttcaagtcaacctactgtttcaaaagcttaaaatcagtttcaaaacaaaatgtctacaatctcttctctaataatgacatgaacaaaacattttcaaagaaatctaatgtcaatggtttcaaataagccttctaagtgatctcttcaatagtgatatttaagtaaaacattttgattgacagaggcttattttaaacttttgcctccttcacgcatagattaatggtagcataaaaaatatgtttgagattcaaaagcaggtggaaaaactcacacttctaatcaaagaagagaactgcttctaatcctgtgttttccactctgcctgggtatcttctatatataggaggaaaaacacaccctgtcgcttttaatgtatttagacacacacacgttgtaacttaccattaaaatttacagcccgaatataaccaagtagctctttcccatcaatggtactcattcgtggacaaaggccaatgtatccagggcagagatctttgtgcatattgtgcagggcgtaagccatggaatatacagcatcaattacaaattggacctttccttcctgttcataagatgaatcccgagcaattcgctccagccctgcaaaataaaaaagtaaaaaccatcagttgatgttagattccaataaaagacagcattagagctaagatttccatcatttgaggaacacttaatgagacacgactatttgatttcacttctgattaattctatacttactgagtcaggtttttaaactggatattaagtttatttggaaagagtaaaactatttcattagcaacaaaaagatataaagtaaataaaagatgtatagtttcattatcttttttccaccttattgagtcctattatattgtgcattctagtaattacataacattttggtagtggcttgatcttttaagtaaaatgtgcagtgtgtgattcttgccatctgtctcagctccaggagtgtcatttattagtggcccaaagtaaggtctttcaccacctaccaaatcagttctaattttgaatgtgctccatttgggagcctttttgtaacttttatatgacaatactcccttaagtgaccctggttatctttataataatcattcaatttgttttctttttgaactcaattttctatttagaatttctgttaaaaagatgtagatacctcaaaatgaatgtcattcagaataaatgtacctgtgtttgggcatatttagggctgctcattggcactggagattacttttaggttggtgtttataatttaatatggaaaagaaatatattttaaatgaaatataaatgagagatcaactatgatccaacattatcattttgaaagcgaggaaactaagactcatggagattataattacatggggtacatggggtacatagggcaggtgtgggaagcattcgtaggtctcagactgcaagcccaatattctctcaatccccagaaaaatttggtagatggcaagaatgttgggcatacaagaaaaaattatgaaagggacatcaagagtttattaagggaacaaaaaatgatctcctgtcacttctacatccctcaccaacccttacacaactggtaacacttagacaaaagcaagtattttaaactttccatggatgttactaaccttgaataaattgtatttaaattcaacaaatatttgttttctgaacatcaatgcatataacctacatatttagagagtcgaattaacgtggtttatatttgtatatttacactctgaaaaactagtttttttctaaacaaaaatagtggtcagtttatttatttttattcatcgaattattgtttttgttcttcctctggtcttaatcacttgtgacactctgtgcttttagatgctcttggttggtattctggtctctgtggtctgtcatgatgctgaattctgctcctccctgtttggcataggttttccgattttctcatgtctcaacttttcattctccaaggctgagtttcttcatccccaacctcagaatctgctaattgtcaattttgtcaactactaaaatttctacagtctagaaatataaatcggactataaaatgttgactacagaatccagaacattagatcaatttataataatcagtttacttcattttggaagttagctttttggaaaattagttttctaaacctttcttgccatctaactgctatcgtcccatatttccaatggcctaccatatctctacgtagtctgctgcttccatatcaaacaatatatgtaaaacaaggctatctctgcaggggattccctaaaatatcctactgaaagttttgcaagtttgcgagcacaaagagacagggaagattacttctcaaaagttatattgtctccttcaacctaccccttagctgcatgatctaagctaagatccacaagacatggggactatgttctctccctatccctaggttatacttttgtctcctgagtcttagaacaacactgcttgttcccagaatcattcatcaagtttcctgtgaaaacaaccctttccacttctgcctaaaatttctctcccatggctttaaccacaaagtagatcattcataagtaaatactgaaggatggttacagcaaccaaatagacgctgttatttccgtatagattctagtctggtaactatcccctcttgtttagtccaggactgaagggcttctcaggacctaggaccaaaacctgaagagcccccggaaaaccaggatggttgcttatgaacaaagaggcaagtgacgaggaaatttcagagagaagactgaataacaactttgaggatcagtccctaggtctggatggatatccctgtgtttcatttattttgcatcgctgaacttgataacggaaaataaagacagtgaggttcagggcagttgtttccacacttgggtctctccttaagtacagatttctcagcaccaccccagacttgctgggtcagaatctccctacttgggacatgaaggatctgtcatttcaacaactcgccaagagattctggtgcaaccagctgagtctgtgggccagctttaggaaatttctgctcttccatacagcaatcctcaaaaataccactatagatctattgtttagagaattttatggtattgaagtatgaaaataaaaataattctttcatgatatgcacaccccgaagaaaatctaatcaaattcttccccttttctcactagatgaagagtcaaagaacacaattcccaatatttacgcatttcaaagcttccaccatgtccttagacacacagggaggcctggagctgatgacaagggtagaagccagaaagacacgaaagatctgcaaataagaaagaatttcccatttctcaggatagagttcagttttctaagttaaaatgtcagagggctaatttaattgtcctgaaattaggcatataaaacttctaacatcaatgcaatgatggcccaataagcaggaattgaatgtgttcctcctgagagggtggaaacagaaaatagaaagcagtaggaagaaaaagatacagagaggagggaaaggaggatgcagcaacacagagaaaggcttgagcccaaggtacaataatggcagagggaaatctaacgttccaggttgtttgtattgctgctctctaaacaactctgctgcagacacatacaaacacacacacacacccctcacatacctcttctgtaaatattatttgtttttaatctaattattttttattttgtgggctttaaagaaaagggaggacttccatgtttccattactgcagggtggtgaagggtggagagtggacacagaactggcagaaaatgcctaagccaaatggcttcaaatgaagcaatgaccacaagagcattaaggaatttggaaattttttacaacccatggaattcatgtaacagctagacatgtgtgaatgttttatagtttcaaacttactctatcctaaaatgttcttgatttaatatattatcattttagtgccagtgcaacctcaatttaatatattatcattttattttatatattatcattgtattttaatgccagtgcaaactccctgtcaatttataaagatactcctcagcattcaataatttcctgataaattataatcgacatgctccaatttaatacatatactcttcctcagcatttcttaaaaaataaacagcctggtgtggtggctcacagctgtaatcccaacatttcgaaaggctgaggtgggaggattgcttgatgtcaggagttcaagaccagcctgggcagcagagtgagaccctgtccctaccaaaaaataaaactaaaaattcaactttatatccaataggtctaaatgaacaatcaaatacacataatcttattaaagaaacatatttaaaattgtactattcaaattattcattttcttttctagttataaactccaattattttgactgttgattaaacatattcaactttgtacatttttgttcttttaaagagttcagaagtctgcctagtaactggtgccacatgtgaatcaatgaacactgtaagaatctccccataaatcaacataagcatatggtgacaaactgaaagactgaatactattaccatttctaaacttaaaagtggatcatttgatttcttttcaggctgtttagacaatgtatttttctgttccttaacacttcaacctcatgatgacacttaagattttacagcagctagaatttgctcctcacttcctatatttgattctctcattcatctaaaagaggagtttaggaagctgacagtgactcatcaacctaattggctgtaaaatttcattatgctatagtttctaaagttagtgttaacgtattgctataaagtgctaaatatcgtcaaaggctttatgtcagctaaccattttaaatatcaccgattgtaaagttgtgatgtgttttagtgtatagcttaaaattaacaacatatagcaaagtgttttcatggtgagagaggaagtcagcctcctaaattttatgggaagattgttttacatcttcattaatgaaatctaaatcttgtgactggatctcaagttcctggaaaataataaattcttactggtctaagaaatatcacacatactttagttaaggtctttcacactttgtggtatatattcttgggttttgttccttttcagtaaaaaaggcaaattgacttaagttggcaaaacattgtatatgttacaatgtaagttcctaaggtgagcctaagagaaatttcagactttgatgcattgtggttgcaaagcattgctttctaagaatttcccatttctcaggataaagttcagttttttaagttaaaatgtcagaggactaatttaattgtcctgaaattaggcatataaaacttctaatatcaatgcaatgatggtccaataagcagttggtcaattcaagtaaaaaacaaatggaagtcataccagttgcttaattctggggaaatcaaacatccaattggttgcctttttcttacaaccatctcagcttggagtataaataatcccacaatctaaatttgtagattaagaagtattttttaaagtttctccctgaatttttctgaattatgaagcaactattttaaataattaagtcagtttcttggagttgctctggagagaatggtagaggaagaagggaatttgtgaacctgctatgaataaatacatttatgcatctaggcccagatttagaagtcattctgaatttcacaggagcttctctgcctattgataaccaggaataagactgtcatgctttacattgtgcttttcccaatgtgacacagatatattgttactgcatagtgcagtgacttttaaatccatgagaaccatgccaagaaccacatcacacactaaagagtgagcgctatcaagctgacaaataggtttttttttttttttttttttttttttttactaaatttaaactgatttgggttccaggatacaatagggggaacataaggtagaaatacaagcatgttcaattatacaggaatatctccagagcactaggatccacacatgaaagtgtgcacctcccatactgaagacagatgaaaatatgaaccctgagatgagacagaaaggcaaactgactgatagaagcagctggctaggggagagagaggatcagtcaggtagatctggatccaggtcccagctggacagcttagaaggcgagtggccttggacaccttcctgaaccatgtcactaatcctgggccttcagctggcattgccactcttagggacctctgtaatggggttcctcatccctccagcttcatctgctgcaccacacacctctctgctccactcttaggtccttgaatattacataagatctccaaatgcaggcctttattcagctgttcactctcttcattccttgcctagatgtttccaagcctcaggggagatgtcacctcaaatttgttaatatttaatgattttcttcccaaacttcgcctagattagatcatcgagcatcttaaatactaggcttaaatactgaatattgttcacttgaaatggagaactatgatcaatatttaaaattattgctgagaataatgtgtaaaatcaattgaagcaagcataggttgaaggtagagataagttgggaggcaggttatgcagaaagtggaaacaggataacccagggaagtgaaaacaaaggaatgagagaaaatatgttttagaggccaaattgacagaatctaactatctgattaaatatggcagtaaatgtcaggaggcaatgaacaactcagggttctgatgctaggtagtagaaaattggcaccatgaacagtttgaaaaatcaggtgaagatttggttaatgatatctccccaagggcatcaagacctcaattaaaaggactgatttttaatgttctgtgctatttattatatcctctaacagagtatagactttatatagatgtttaattattaaaagaataaaaggcccaaatgtttagagtaatcacataccaataacgtggttgatcatttatttgcaacactggcataatcaaagaagctacgttggagtagagcaccttatgcaatgttgcagtaaaaccaacggcctgagaagccagacttgcattctggttctaacaccacaaccaattaactttgtggccttgggcaaaacatgatctctctggcttttggttacttctcagtaaaaattagagaactgaacaagatgctctgtcagggcccctccagctctgaaattctggattctaaggcatgttctcttatttctaactgcttcctccttatactttctaagatcccttgaagattatttaagtaatcttcaagtaagtgtgacagaacaaataccactaaacccaattctccacaacagtatgaagtatcctgtaactgggctactgctgagacctggaaattctgcactaacaaaaataccaaatgtcaacctggattaattttttcccgcattcagagttttggttcactgtgtcaccatatttccattattcttagacttagagccattgaacaaatctggttcctcaaaaaagagaagattttaggtctcttctttttctgatatgctggctaaatgaatcaattatggaaaataaggtcagagaagtgaaagggaagagggaggatacaaataattaaaatggtaagagtacttcacaaatagtatccctttaattctaaattattactactcctcttgtacaaatagaagaactgagattcaaaaagtcaaataacttacccaacattgcaaagtaatggcagtaaacggcaatttaaaatcaggtctacgtgactcaaaacctctgccattaccgctattccttctcctctgtgaaatttcctttgattcttccagttcaggtttatcttttgcttctccaaattccccttttacttacacccaccagaccaatgattagcttgtctcttaaattaactgtaaatgcaggttctctacatgtaatgtgttcatgcacttgtgttaatctttaaagacaatagtgtagtaggagtcaaaaaatattataaaatataaacttttacagaaatactgacaataagtattaacaaatactaacagaaatgccaatacttatattgaactacacttaaaaaggaaaaaagtttctataacattttaagcatttttctgaactgttaaacaaacaaaaaaaacttcttatgaatttcagccatccacttatggaaaagttgtcataaaatggctgaaattcccaagcaaaaggactggacatttgtgataaagaccaacgctaataaagcttatacatttatctttataaaaatgactaaagtattttagtcttggaaggtggtgtgtctgagtctatgcctttatatgatttttcttaaaatataacatcaaactcaaaagagaatttcacacccaaggttctgctttgtggattcttcagctggctctgtcaaggacctgtagagacagatgtattggactaatgaagtaatttgagccactaccttatctatttacaaagggcagagaaaattagaagacaagggtcctttgctgaaaatcacctgctatcttcttctgtaatttaaatgtagcagcaagaactgaaggctcttagctgcctgaggacacatgaggagacacttgtaaatcaaccactgaagagctctagatcagttcacaataacatctctcctttgtgcctggcaggaaatagaaagtgcttcaggcaggtgccaggtgtccccttcaggtattaaaaatttccatgcaatgccctagagtttcgaaaacactgaaaaacctaaggtaagtggcaaataagattaagagtgtatcttcaggcaaaacaaccagtttaaaagaaagactttcagaaaagcaaattatttcatagatatatccctaagtccctgaacaaagaaaagcctgtttgattaaattcaattatttgcatttttctacataattatcttagatcatacacatgagagacaaattttgatttaaaataatttataaaacttgatatatcatagttaatgtttctcttttttaaggcatattaaagacactcctcctcatacaattcaaatttgggcctggaaattcccacttcagcagaaaggacttctaatgctacccccacccccaatatgttacagtcatttcagaccctatgacttggctcaggatttaccttttaaaaatacagtctattttttaaattacaaaagtaatacatattaatactagaaatatggaaaataaaagtgtagaaagaagaaaataaaaaaaaatctattagcctcccagcttaatgaccatttgtatattggtgtggcgtcttacatttctttctttgcctctttatttttaaacattaaagtgatatactctttttaatatgctctattcacttcatctataatgagaattcccctatattatagaaaagcatggttttttatcttgtccttaatctttcattaagattcttatctaatatttaatcattcaacagattaatatttttgcaattaattcttttgttatattcaatgtgatatttgggttgagataaggatcataagtttttcattttccaaattgtgaaccaattctcccagtgttatttattacatgtatattcatttcccaaataatttatataacattatttttaacatatcagatttttatatattcttgaacacctctctggattttctgccctaggccatttttctcttaatatgccaatgctacatttttatgattattatgtgtttatgttataccattggttcattctgtactctatcatactcttttgaaaaatttctgattagtctaatagtctttataactaattaaaccagttcaaaaagttagaacttttattagtcatatcaatttttaaaattaattatgaaagacataacatagctacaatactaagcctccatttgctaacatagagtctgtttattcaaatcttctttaggaatccttaataaagatatgtcacttgcacatttatttttaagttaattcttcaatattttatgttttgtagctttataaaatgatttattttcattaactggtataatttataaatttctatttatttttaatactcaacgtttttctctcatttaaattctacacatcctagcaagcccagattaagtcctacctcttctacacaacacggaaaaatataaaatagcatgggttttgagaccagattaagattttaggctctgcctccaagtctctgaattcttcactcataaaataggaatttatgacctatgttgcatggctgctgtgaggattaaatgagacaatgtaaggcatctggcaccttatgtagtaaataaatgaacatcactatttgatatgtgaggctataaaatacttaaccttctataacatacaacactttttcaattatacaaatgaaagagattacaacagaaagttaaactcagtatatattcatatattcaattactaagcatgagaaaggtaatttagttctgtgattgagaccaaccaccctgcttccgatctgcctaggttcaaatctcaataccaccatttactagttatgagctttgagtaagccctttaacctcctatgcaccttatctgtaaaatggggataacaataatatctcccccatagggttgttgtcataattaaatgagttagtatatatattagacaattaaatgagttagtatatacattaggcagtcagaagagtgttgaaaagaataggcactacataagatgatattattattatctttattattatcattcactgagcttgtgtgatatactaagcagtgaggaggatacaatggtaaacaaaaactgacctactccttgctgtcacagagtgacactgggactacgatctgaaagataaatgggagtgaattaggtgggcaagggaagtagaggggagcacaggatgacagcagtggcaaaagcccattgatgggggcagcagaagagtacaaggagtgaggctcagccagtgaggcttagcaggggaagaaggagggaggcacaggtgaggcctgacgggggcagggccagattatggaacaatgcaaatgaccgggagtctatctgtcttctttctgtaaaagcagagggaagccatcaaaaggtaacataaccagatttccagttctaaaagagcactgagtcaagagaacagataggaaggaggaaagagtaaatggagtaggcagattgggaggtgattttatagttcagaaaggagcatacggtgtcatgggctaaggtggtgatgaaagtgaagaaatgtgattgcactagagacaaaacaggattaaaaacaacaggatttggatatgggcaccatagcaaagagtggtacccaagggtgacttctaggttctcggcttaagtatctggacagatgccagtgctgctcaattagatgggcaacagtgtctaggacagaaatagcatgtcctgccagccagataactgcacatttacctaatgcatggtcaacatagtgagtttgttcctgttatgacaggtcaggggaatcccactagcctgcacctcctaaaaattgtatactcacttgccactctgagaatgtaacctgccttatttgtaggatatgtccaagttcaaggttccaacactgcgttatcattatttttattacttacaatctccctaggttataaattccaacccaggaacagagaaagagatggcatcagaattgttttcaagaatgtgtcatcattcaacactgacttcaatcattctatttgcaagttactaatagtactctctcaggtattcccttttaaacaaaaagctgaatagtcaatgtgatgacctgctttaaatataaacatagaaaagtaaaacatttcccctttccattatctttttaagattttgtcaacaatgaagtattatcacgggaacacatgttataacaccttaaacctgtaattaatagaaatgcttatgttaaaataatctcatcctatctgctttttctaaaaaattttatttatttatttgtttattttgagacagggtctcactctgtcacccagactggagtgcagtggtgtgatcaaggctcactgtagccttgacctcctgggctcaggacatcatcctatttcagcctcccaagtagaatggaccatgggcatgagccaccacgaccagctaatttttaaattttttgtagagatggggtctcctcatatttcccaggctggttttaaactcctggcctcaagcaatcttcccatcttggcctctcagtgttggaattataggcatgagccactgcacccagccatatctgcttttttctaagctatcatgacctattagtgataataaaatcaatgtagttggtcacacacagcgtatttccaaaataaagaaaacatgtagaaatcaagttcattgcaaatagtaacaggaagtattgtttcttgagtctttatttcagttgagaggtgggtttgtatactgtattgccataaacaatatattattaatctggagtgaagtaaaaaaaaatttgaaactcattaacctagtccaattctagtattccacaaaggtgaaactgagacagaggaactgagtgatttttttccaggtctgataacctgtgaagaggcacagccaggaatagaaccctaatcacttaattccatgactcttgttttatatcatgtctcttttcagcttcattttctctcccattgtaattaagttctattgaggataactaaaacttaaggaaatcactgaatgagtttgcccatgaggaattaaaagcattgaaggaataatgaagtatgaaaataaatgaataacaagaaagtatgagtaatgggcaggttctctcttactccaaagggaaactatcagtgaaaaccaacaacaaagaaccacagcttttggttttgaaaaccaaaaaaatctaaacacaaacgattttataacagaaacttaaatttgtaaataaaggcccataagtgcctgaagtttatgatgcatatcctttaagtgaaaattttagggtgtctgtgtgtattattggaccacccaaatgaaaaatgaaaacaattcttgcctctgtacaatgcagtcaatcctctggatgactgactaggtctttcacttttcttcccaattttaggggtcacagcacaggcataggtatagtgccagtggctgattaaagcaggtcgcaatctgtctgggagagtttctgtgccattcttcatagggacagggaccagacaagatgacctcccttgctgccttccaattaattcaatcagcctctgcttctatcagacatcttcagggatgcaaactgtatactcgctccaagtcctcaccaggaatcagtaaacacagaggctgcagactgtgtttaatgaataagcaggattcatcttccagtcatcatttttatttacagcttgtttccaggtattattttctcccccaatgatctaaaatccctatggaagactggggccggatctaacttctctgagctcctgctggggctaatctggtacccaaatacatcttaggttaatatcaatgttgttaaaccaacctaacctgaatttctttctcaagaaggatgtataagtaagataatcccaattagctctccataaatctttttgctttaatattctgtgaagagccactctaggaaactattatgagatacagtaaagtacagtaaggaaaacattgtcaaacaaactaaatctataccttctatttctgaaggcatatatttagtgagccactgcacctagccctacctgcttttttctaagcttcatataggccatggcctattagtgataataaaatcaatgtggttggtcacaaacagtgtatttccaaaataaagaaaacatgtagaaatcaagttcattgcaaatagtaacaaattgaacactgcaaatgttcaaataaatatacataaaaggtagagttggtatggggtgtctgctttttgtttctcttcacatggactggcaggataatttccataatagaggaaatagatcatctgagactaactatattagacaatgttggtacaacagatccaagatgaggtaagtgctcacatgacagctcatttcaaacccctcataaatcaggaacctgtggctatatttcaacacttcctatacaatcaataaaacatcagtgttcattaggcagacctcatctatagcctcagatcaaaaactgtggcttttgactacaaacctaccttacaataagaagggagtgaatttaacacatctttcctttaaaagaaaataatctaatataaaatgtgatgtccttcaacattacatataagctaattatagcacatggtttgtgtgagctttagtgggctgcatcaggacctggaaaacattccaaaactgaagtggaattttggcccagtaagaactgaatcactaaggaacaaaccctggtttcaccttgagagataatgcatgacctattaaatctctcattattacccttgtgtacaaaaacaaaaaaaaattgaaaacagtttcatctttaaactttcaatgcatgcacatgcaaaaaaagaattaaaaatattttcatctttaaactttcgttgcatgctttgaatatcaaaacatattttgtgagaaaaattataaatagaaatttgataaatttagaaccaatgtgaaaatcatagcctgagatgcactttaaacttatttctaacaaatctgcttttctcagtgatttatttttgctccccaaattatggtactggcaccaaggacttggagagaaaacaggtatgataaagagaacatttaaacataatggcacaaatgtacacacgttcctaaatagccttcttcacagaagctgaaaggggaagacctaaccatttattgggatctattatgagcctaccaccatgctagacaagttggacagattgttacataatgcttgtaatcactctatgaggcaagtattattattaccgttttttaggaaaactgaagctcaggttaaataacctgcccattattatagatttagtaagtgataagccaagaatcccaactctgcctgtctattcaaagtgatctaactctttttattacagctcaggtctaaacaataaagaacatgcccacgtacagtgtaatgaatttagatgaagatataaacgtgttaccagatcctaggaaagaccagtttcaactaacactagtactgtaagcacatagtaaccatttggcctttgactttttatcacaagcttgcgttcagcttctatatgaggtgacttttccaggctggagtgtagtagctactcacaggcatgatcatagcacaccacagccgtggactcctgggctcaagcaatcctcttgcctcagcctctcaagtaactaagactataggtgaatgccactgtgcctggcttaatgtgtcattttctaatatgtgagttttctaatagtcttccaatacttttaggaacaagacagactcgggtattggagtaatctggtaaaacaccctctttcggtcaagctctttagaagagcctttatgcttctacttccttattgcaatgcacatcttggctgctgcaatttgacttctatcccaaccacacaccaatgctacctaggcagacaccattagttgtacttcataccaattcaccacttcttacatggtattagaacccacgatttttaggaaggcatgacttggtcagaataaagactttatttttccagcctcctttgcagccaaatttagctgctgccaataggatgtaggcaaatgtacagtatggtaatttttaggaacctttcttaaaagacccgggtcttttaagacccaggtctttcgcttctttatcctttttcatcctgttctccatcctgccacctaaatggcagatgaaatcactggagctctacctgtcacctggaaccaggaggaattagagccacaacgtggagatagcagagtaataaactagaaggagcctaggtcactacagcctgggtaaagcagtgccgctgcacccttcctgcaccacctcctctagattttaccagacacaaaaatgaggttttatctcatttaaacaaatgttatttccactctctgttacttttagctggacacaatcttatatgatatataactatgatctccttgtgtctaaacccaaggacactaaacatactccaccacattttgacttttaattttaccagtcttttgaggttttctggagcactaggaaaaccataaaatttataagagaaatctctcctcttataactctgttatctatggcaaataacaacctcttttgctttcactgtctccatctgttgtgaaagagagaataatgacctcctacttcaaagtgttgtaaggaatcaatcaaataaaaactacaatttctagttttcttgtgccccttttcacaggacacaagtcacttaagattcaaaatttttacatttgactttaaaatacctatttacctgagtacctcttttctagtttcacctactcaccaaattaacgaactttttaatgaaccaattactgtttacaaaataaacaaggaaaaaataaaagcctttaaaggtattctgttatttgttgtttctaaattcatcttgctttcctatctaattttaagacaattttgttaatggttcacaagggcagggatcatgtttattttcattcatcattttatttccagtgcacatggtaacatctcaaaaaatgtgagtgtcctctatcccaaccttctatgtctgccattcctgcagtgaggggtcatttccactgccatgttacaaaaagttataagtagatttatgtcctacctgtacaggccacctcatggcatccccttgtcctttatttttagtacaattctataacctatcatgttccttaataagaactagttgttctactctatattcttatactccaataatattataaattaataagacaaattcaaaagttctcaaaagttattatagttaccatgtatgaactttttgtccatcagctggatgtgccaatctaatttagaagatctgattaatctgacaaagcgtttctgaactgtatgactgttttactcttagttaagttcacagagttattttcagcatcatattgttttcattttgcaaatgtttttctgggtcacaatgctggctcttttctgcacccatgtgtagtacacatctaacctagtaatgagggaggctaaattagtctccagtgcttcttgcttttgcagttctagatcattatctcctctaaatagccatccttctttctccacatctctgcccaacaagtgcccaataccatcaaaagaaactgcttcacacagaaatattaatgactgataatgcccgggtgtgaccactctgagtgcattttgtcaacatgttatcacttctggaatttatgtcaccaacaagtttcatgtgtgtgacaatcaacaaatttagatggccatttatttcaactatcccaaagtcccctttctcagatttctgggagtcaacaaaaagaggggagggagtaataataattccaactaaatcctatagtgttacttttgttatcaaagtagcaaaggcctactttccttttgatactagtcatttgaaattaaatatgaaaactcatttacccttaaaacaacttgctatgtattactctattaatgaaaagtctttcttcaaaagtacaaatcttctattataaaatacatgtgaaaaatattattaaatcaattctttctcaacctatgagaaaacattctcaaacttcctcttttcctattatatttacaaagtattttctattctccttgatcacttttccaaatagcatcccattttatttatttatttgctgttatgtttctgttctttcttacttcttcataaccttctcttgccctgacttgctgtggtcgatatcttttttttatttctatttctggatattcaatatcatcttacatatttgtagatcatcatgcctcaatatgaaaattcattaactagggtaaattctactgaaatgtaatttttagttaatttcactaatattcagagaaattcctaaaactttccgtttgtgatccgtttcattctcttagacaaaaaatatcacctaaaaattaaatatatcacaaatggctaaaggggaaaatctccatctaattatttctatttgaaagtaccacattaaaaaatgcaactcctttattttcctcagtgaatctttgatgaaatccaacaaaaatgatgagttacctgaaaaatgtagatttctatcattaaaacaatctggccggtgcgatggctcatgcttgtaatcccagcactttgggaggccaaggagggaggattacctgaggtcaggattttgagaccagtctagccaacatgtcaaaaccccatctctaataaaaatacaaaaattagctgggcctggtggtgggcacctgtaaacccagctactcgagaggctgagacaggagaattgcttgaacccagcaagtgaaggttgcagtgagccgagagtataccactgcactttagcctgggtatcagagcaagactccatctcaaaaaaaaaaaaaaccctttcagatatctttaacatttatgccttgttcactcaaaattgtatgtgctttttaacacctcccatcctacttatactacatcttctttatattttctttttttcagagtcactcaaatatctcctatgccctagaatgtgattcttcccccatcttttgaaatggtaaaataaaatacaattgtgttaaatgacatgaagaatgaattctgtttcctctacaaatggactctatcataactttatagttgaacatacaattagcagcaaaccacgagagcgtttaattagacctagactctaggagttgagttcacagattgtgcctatgagaaagcaattagaggtagatctggtcagttaaaaaaaaaaaaacctcagagacagaaaaaaaaaaaggtccattgttttgtcttcagctgatgtaaattcagccttaatgaaagataagctattttcacagagaatagatttttcatattgctcagagtgtatttgaaatcttataacatatggcattctaactttgatatgactttttctgagctacctctatattatcaaggaagagaaaggagaaatagagcaaatagcaaagaccatatcaaacatatcacaaatgactatagacaggaaagcaagatggtttttcttagcatagacttaatttgtctacagtatgatacataacatgcaataagataatcactataaacatcttatgtatattacacttattttgcatttcctgcttgccagaagccatactgaaatccaagatacactaataatgttcaaaagactaaccaaaaaaaaacacacaatgaagcacaatacagagtaattactattctgtggaaagaacaacaaaggcatttttttttcctgtagctgtaatcagtttataattatggcccagcaaacaaggcaacacataaagaaacagtaagaaactcctcctcagcttccatgttataaatttatggtatcttaaagctttttatctttgctgccccgacagacgacagggactccacaattcttaggtgactgttgccttcatcagtaccagcatccataggtacaggttaatgttccacagccgctaatttatttttttaaatgttaaaaccccatagagcatgacaaataacacaggtttaaaatataaacatctaaaactcagcaacaggagaaagtagcttcttatttgccagtgacaaataacaagcctgcagaaatacgaaaaatgctctccaaaaaatatatggatattatctgataatggtgacttggtaaaaattatttcattctagtaaaatagaaagtgcaagttgctttttgctactccatccatttatgttttccattaagttcctttctatagaaggtttgctatataagttatgtcgtatattctcaggtatagatatatctggaaaaggagaacaacaaagactctcttaattttttcagagttgaatccctaaactgttttccaactggcatgttgtactatgaaatccaactattttatttgcttaattccagaactggtctctatgtgagaacacattctctctctcttttttttttttggacagagtttcgctcttgtcgcccaggctggagtgcaatggcacaatctcggctcactgcaacctctgccccacaggttcaaatgattctcctgcctcagcctcctgaggagctgggattacaggcgtgcaccacaatgctcagctaatttttgtatttttagtagaaacagggtttcaccatgttgcccaggctggtctcaaagttctgggctcaagtggtccacccgcctcagcctcccgaagtgctggaattacaggcatgagccaccacaagtggccaagaacacattcttaatgacattgttaaagatattctgctttttaaaaaatgcataatactagcataagtttgtattgcaattttctgtcatttgataaatatagagataactctactgcccaagaagtttaccttcatgtagcttcataaagatgcaatagataatacacccatccacaccaacattttaaattaaatgtcaggaattttgttttgtatttgtaattattcatgtcactgcattagccattgtattagcattttatttaaaagtttactttttttcattaaggattatgattgtaagtcctagaggtgaatccgctttgttttcttacggtcgtgccaaggcagtcagagggtgaagaagtttttgccaagtcagagaccagccctggagccagggctgcacttatgatagcaggaacatatgataaaatcaatccagagtccaaacaagtgaaggtgaatgaggaagggcagcagcgatgctccgtaaagtgtggatgcagacagtaatgcctggtgactgggtcggtgagaatccagggctctgggtaggatgacttggcatgaatgtcagaaggtgccaactgctctactagactgaagaatgggagtcagatgtctttcctgcggggcagttggtaggaaatttcagatcctcattaactctttgataccaccagggggccatttgataaatgacagtgccagtgttctaaatggagtctaagcatctgttggaataaatgtacatcctaaagtgcctagcttatgaatagagtgtcactcccacccagacaatgtgcaataatgacttgtacatctcatacatgcagttattacaccagggagagagacagggacctattcaggcatagcacacagttcttaagaatattacattactacatttttttaaaaaacacttaatttgagatgtcatgcttagataattgatatatcttctcttgctactagcattctttgcctttattttgtgacttgctttcacaacacagaccttctttcagagttactataatctttctaccttctgcactattttcatattttaaatgcaaagcattgtctacattgtcttatatgaggcagctttcccagactggattttctgtaaagtcctgctgtaaccaggtaggctgccaacttgaggtagtgactcacactctgggttctgcacacattcaaccacagagtagagaaggaggcattctctctttcccttgcttaggaaatctgaaggggaaactgacttgtaatgtctattgcaagtgcaacaggactgtgttcaaaagcataggccttaaatgatctttcaaagtaatttgctcatagtcattattttgttgccatcaggtgaagaaatagctcttggtcacagcttgtgggtaaaagaaccatagaggtggttaactggattccattttttaaaaatgcaaccctaaaacagataaacatcaattttaatcaggctattaatctctatactgaaactggacatgtacttgcagtgaaacaggtttctcggaaagatggagaaatggagacagatacaccaaacaggcacacctgagcactctgtgttcctcagtgagaacgtgggcttactgatgctgagtttgcttctgaaatcaggagtgcctggtatttggaaacatcctttcaatggaaggtcacagattataagtgatatggtttcagagtggtgattttaaatgcttgtggtacatgcaaaatgctgctgttatcccagtacctggagagcaaggcccatggtcccaggatgcccctcagcaaaaaatgctagaagaggtcagcaagaggatctgagcttgctccagtcctgggtggcctctccatatctggtcactctttgtattcttgatggatatttaaaagaacatcacggtgaatgcttgtgctctcttttaaccaatagctattgctcctggaaacctaaagtaatcaaagcagtatttaaaccaaaagttagcaatgtgtggtctctgtactagcaacagcagcatcaccttgtcaggaaacttattagaaaagtaaattctccagtctctccccagccctgcttaagtagaacctcttggctagggcccaacagtctatactcttaacaaagtgattctgatttctcctaaagtttgagggcccactggcttaaactgtaagcaattaggtactgttactctaaattactctcagctttaatcatgaattaatctgaacttggttgtctcccctgacttcactaccacagccctgcaattcaagcagtttcaatctgcaacacatctacagttccagaaaataaagccattgtttttccaatgaaagagaaaaaggcctctgtgtaggttacggggtgctttttttccatcccaggcatgaatagtgtattcactttgtcgaagctgtttctgtgactatgggaaacagaagtagctgcactttctaacagttttgaacacttgcaaaccatcagtatggtgactggccacagcaggatcccatttcttctttggctccttctgcactgcccctcggctacaaaagatacatgttccttcaacattctttcattttctccttctctactgaagtccactgtaaagattgtacatcagattcttccctgcaatacaacttaaactgcagaacactcttttatgtttgtgctaagcccctgtaccttcttttccctgccagaaacagaaaagagttggaagaatgtgttgaacatgatcatgctgcttgaagatttttcatgagttttcctatcagcttgtttacaaatctttacttcattatgtgtcttctttttctacttgtgataaagtctcctctttttctacctcctttctgatcaatactttaaaaaaattaagtaatcattgccgtgtgaaccaatatctaccaattgcattttattgttttgcttagttcggtttgctgtaataagagaaggttatgatagagtggaaagggcactgcggtcagaaggtccacatttaaggaaaaattccagcacttccagacttatcagcacaggccacttaaaattcaaagctggagtcccctgatttgaaaagtgggattcatgattactcctgccctgcagaccccacacaactcctgagaggaccaaattttaaaaatgcatgtgaagtcattgtgaaaactgtaaagagttatataaacctgatttcctagtttctctgcgaggatttactagactcaaagttaacaaaacaaacagaactaggacttgaaagcaatcacaagtctccttagaataatagtagccttttaacctatagagtcacaatgccacaaagaatttagacaggttgatccaattgagtagctagtaaatgtttgtaataacaagcaaatagtaattgttcagttttgctaaagcagagaaacttagaaaatatatcctaagttatttccatatttgaaggaaattggaacaaaaggagtaaatacaccaaagactacactaactaaaagaaccatgtgaggtcaatgatggcatatggaaatgtctactaatataaaatgggctttgtggttaatcaataatgccttaatagattatgggaaataatcacaccagtaaggaattactctggatcattaatagcagtagagatttccatcaatttaaatggcccttgaaaataacacataatatttacttgcctgggttttctttaagaaaaatatcgatttgaaactcagaaatcacaaaaacaaagaggctaaaatcagacagaatgtctttgctctattactgaaaccacataaaaaataaaataaaaaaaaaagcccttagcactagcagtgtcaattatccacattatttatcctgatatacaatcttgaaaaaaatctgcctattaaccttgtggaatgcattctcacagccattttgctcagcaggagcttacaaccagtcctaaattgttagtggcaattcccaggtttagtgtctccaaaggtaattttctccagttaccaaagattagagtcctcagaaaaatggggtccttaaagttaacatactgtcatcacagacccattttccaattcagaagataaatgtattttatttgctacctaagaaatgatagcaaacaacaggacacaattcatattgatttttcttccgaaaaacatcttcctaatcaatatcatttattctaatatataaaaatagtgttcatacttaaccagtgcattatgctgtaccctggtattttattattctgagttttaaaaaataacaagaccacaacactaatttaaaaataaaagaaatagcagtgcttgttaatatgccctaaaacggtgtttgtcaaagtgtggtggttcacacacctgtaactagaattaaccaggatgcttgttaacgttctgtaactccatcttagtgaattaactggaggggaatttggaaattgcattttcacaaagatttctggtgattcctgcgcacactacagtttgtgaaacactgccaagctagccagtggttcccaagtcggctgtacattatactcacctggaaaatttataaaaacaccaatggtcagacctcagcccagagcaattaagccagaatctatcggccatgggcagtgttgccaaataaaatacagaaggtatttctttaacatgcttatagtaacaaaataattcttgtttatctgaaatttaaatctaactaaacatcccatgttcttatttattacatttggcagcccaagttataaagctcaggcacagcaagatttttaaaaagctttcctttttgagtcaactggacagttgagattgaaaacaactgatactaaacctaggctctaaagatatcgaaagatatgactatacacaaactctcaggcattaggcgcagagttgaaacaatctagctcagaagcaaagtgaagtacccatcacagctccactatctcatatactcatttgttttccccaaaattttacaggtgttgactgatttttaggtaagtttataataaatgaaaagtatcaacataagactcatctttttaaaataaaacatcatttttaggaaatacttagaaaatactaaataaaatgagagtttccaaaaagttggtgtccatgatcagctaaattcttttataattggaaaattggcttctacagtcacaaatccctctttttggatcaccagaattcccattaggagaggagtcatgagtaacaaccacctctctcaatgccattcagtctgccttgaagcgttcacctggcagcagaaaattaacagcatttcctccttgcgaaaaagttaggagcctttagacattatccaattgtccaatgaatggggatccatgtggataaacgcaggcacaaaatcatccacagttttacacagtaagggagaagattaagtttactggatgtatgttgctgcagccagtgaagttagaataaaataagactggaaaaaaaaaaagcccaaaatttttggaaaggcagagtttccccattatggtcaccccacatttaaaacatcaacatagtctacacataaaaataatttacaataaaataaaacatcaatatatgaaccttaaaataacattttctcaagaagaatttcagcttctaattttccttaatatacatgagttaagattttaaagatgaaatttaaacaaagctgaattctaatcagataactgatttcaggagttactaaataaattttaacaagaatatatcttcataacgtacctttgtaaatgaagaaagaacacaaattaattaatatgagaaaagtacacgcccatttaagccttttttatataatttatctctgttgtccatgatttcagatttcctgaaatttccttaaaaggtatattcccagtatcacatcaacatatcatatcatatcaaacacttagccatcatcttgcttctgaaaaaaaagtgaaattctaaaactaccttgatatctattagcatatagctctagattttgatgataattaatccacttctttaaaatgtggtgtttaccaaagagggaaacataaatgaccagtggatgacttaaatgaccttcactgagttaacatggcactcctaatgaccatttgtcatggctcctggcaaactatttctcactaatataatgataggggagtggctcataggaacctggtgatttagtgtttacacactaaatccctttaaattaaaaataaactaagcacaagatgccacctcatttgaggttcacagtgtgcccattcctccctttttggtctaggagaacactagccctctgtgaatgcatgacatagactcctctggctaagatcctctagttaaagcaccctccaaaaagaagagccctcctctcatggatattatattcattattagcaaataaatatcattattcccagaaacaattttggaggacccactggggcttgtctcaattctaggcattataaaattcagtcctacactgagctcatcatcttatctctctttaggataaataaatgtgggttgcgagatttaataaataaatatacacgatgcccagttaaattcaaatttcaggatcagaagtgcgctgttctctccttttgaatgggagagtctaattggacattttacaattataatccatttactgaaaataaaaataaaagttcaaactgaactctagactacagaaatggtcattaaatgtgaaagcttcctatccccaccctatgagttattatcagacttgcagttcattaattcttgagatattcatggcttataattatcctagcttttctgtcaatataaaggttacaacttaataagagttaccacgctaaacctcttaatttttataaatacttcatctgtgttgtgaatagcattagtaaaagtggcttaaactgaatggcctaagaacatcatttgtggtttatcatctattatttacatttttaacatttaatctggaattacaagcaaaatagcatatattcttgttattttttaaaatattaaatcaccaataacatttccaactctattttttttaaaaaatcatattttggatttctctaaataccatgccatgctccatggtccatgaatatattcattaggactgcagccagcagtgtgcaaatttatcaataactctcaagtaacagaagtgaaaggctgctccaatttgaagtctactgacaattctctgaagccaaaaccttttagtctatcaagcatggatttattcatgatttttgaccttaaaaactttagggggagagtgttgaaaaatttaaaggtctaatcattgtataaaaactactcttagaacatgaaatactattctaaaatctgtacctaggactaagattgtgtaaaacaacaaaggaactcaaaattgactgctctctctcttctccctcatagcaacatgaacttttgtctggctcaagcccaatactatctaaagatatattttgatgttcccattaaaagtaagatggagacaacaaatattgaactgatagtatttgaaaaatgatttgagattgtcttatttggggataagtttacaaccccaggaaaactgcaagaagagaacgcctctaagagaagggccaaatgacatcaagatgctctgaattctgcactaaagaaagtctcagaattctttcccatatttacacgttgccaagtccagtgtcttcaacttgtcttccattatattgggattaataccttagagcattttttttttccattgtgtagtgtgcattaccttcataggggcaaagagaatgccccaaagcagattcaaagtgtataactcaggattaagaaaaaaggcttcaacgtttgcattttaccaagatagaacaaagacatcaaggagagtcctgatgggcaaaaattacagatccagatgaaatagtccagaagtctaaggcaaagaaaaactaggtaaaaatacaaatatttttctttacatttagagaagggaggaagacatggccatggccacctcatagtgataggggtgcttcaacatgtccttaaggccacacccaggatcattctgaatcatcagcacatatctgagataatgacagggatgggccagtgagagcatcctgtgcatccagtgggatagtaaagagagtttcagcttttgaaatagggctgagctgtctccatgtcagccttggctcttgcctagtagcgggcctttgtagaaaatcaaaagggaaaatgggacagtttccttcaacaagacgttttactaaactaaacttctcatacgtccaagagtgaagttctgggacttgctgctcctgacacatcactgaggacagatgactggcatttgcacaggaggtcagagagcaggaaccattagagggctggggctgttggaaaaagccttacctatgagatgagactgggaaagtctcccaagaagtgtctgtgttcaacgaatgtggatcagaaagaacaacagtgataataacttggagcaaaagttccaaggcagaacctaggtagcactattggagaacactccagagcctggtttgactgcctcagagacattatataaggagcttggagaagtcatttggggagttgaaaatgggccaaagacatagagggactaaaatgccatagtaactagtgtagacactctcatctcttgctgcccgaagtgtgatctatggaccagcagcatcaacatcatctgggaaaagatagaaatgcagattctcagggcccactccaacctcttgaatcagattctgcattttgacaagatccccataggattcttgaacacactgataattggagaagtaccactccagcatttagtggaaacacctggtactaaaactgaaggcacgctcaggaatctccattttcaacaaacatcccacgtgagacaaataagaagatggcaaataccaatcagtagtgaggagcatgttggtctgatgaagattagtaggatggatgtaagagacaagcagcaatcatttaaaatacactaacaataatgtagacatgatgatatttatgagtaaggtcagacaaccgattttaaacaacctctttgattctcagcttggcacacaggaacacaggatagattaagtatcaagaatccctccttgtacctagaaaattcattccaaagatagtacctccattccttcttcctccatccctggactgtagaaagcagattccccagctggggcactcagctattagtaaccgaagtactgctcatagagtacaagaaatagtggctgaagtgtggcaggcattctataaatgtggttcatgttgttgctataataacagcaattattactaatacctttgctatgcctcctcacctgtccagtttgctccctctaagttgggtttacttagctcattgagacttctaagaacctggatgagacaggcctggatttgaggcaaatcagcacaaaacttcagaatccagtaatctcctccttctcatcccaaggagactgaagccaggaaaaggagctgatgagttccaattaccttttcagaagatagttagaataggaataatcaacttactttacaaaatcagaaagtgtatacatcctcttttttcaagtatgatgacatggttatcctccaacacaagctctaactttcaagttttttttaaaatgacaatgatattaataatgatgaatgctgatgaaaatattctaccttgccaaattactttgtggttccttaaaaaccacaagctctacgaatctcatcatatcctaatgcattgctttgtacagacccaggaaggagaccagcctctatcattcatcaaagtgtccttcctaatgcagtctacgctcccttcagaagtccatctgcacacccatcaggcttccttctcactcctgtactatgaaagtgctgccttcagtagactttccccccatttttcccatttaaatatttataactgtaatgcagccatgccctagttcatcaatagtgattcttcttatattcaatgaaaaagaaatgtagaacattagtgagttagaggttggtctctcttgctacacgctaatttgtttctttgaccagcctctgagcttgcagctcacatcatcccaactgtgccacttggagggcatgaagtttcaaagaatatccagccctctaggatcctttatgtggtatcccagccaataatttggggagaaaaagtgttcaatccttttctcaaatgtacaccaaaataaattctagattaattaacgtttaaaataaagtgtttaaaagaaaatagagcgctaatatttccctgccttgagaaagacttttaaggaataatattagtcagaagccttaaaaagaatgattaatatgtttaactgaataaaaatataaaacttgtaaaatatttttaaagccatgtattattagtactattaaaaagcaaataaatatcttgaataaatatttgtaatatctgatgaataaacatgtaatattgtatatggaaaaagctgcttaaaataaataagaaaaatgagaaatatttgaaataaatttttaaaatctaaatggccaagcttataaataggatattcaaaaaagaggaaacacaatcaaccaatatgcatacgaaaagtgttaacctcccttgtatcaaacaaatacaaatcaaagccatgctataacacctatttttcacctactaatgtcctatatactgctagtgatagtataagttgattcccattctctagataaccatttgccaacatttaaaaaaactttaaaaatgtgtatatgcttcatgccgcaatgccacttgtagaaacatatcttaattaggggtagaggtgacgtctattaaagcaaccaacaataatgaacatgtatataatggaatgctttgtgaccataaaaatttatgatctagatctataattattaacttaaaggttgttgttgatatattgctatatcagaaacaacaagtttaatgaatagtatttttcttataatttattttgggtaaaatgaaaatgatgatatgcttatgtttgcagagggcaccaaaatagtattactatgtggctggtatttaatagcttattaattaaatattttcttttctgtattatataattttctataatacgtatgtattagttattgtaatgcatgttggttaaaaataaaaatatgtaaatatttacaatgcagaggggagggagagggagagagtcagcaaacaaaatattcggaaggggtcccctctcatagtaagaaggtaagtagagagggctcaccctttcagagcgactagttgcagagggaagagaggccatagtgggttgtctgtctcctttgcttcgagtcagattttattgctttgtacactttctcaactatacaaggaactattaataaaaagagttaaacatcaacattgctcacattggactgccagcaagtgagttgcctaatggtttatttaactaacataagtaatgtgtcactatattactgatgcaatattctgaagaacagtgatagctctacgtttcccttgttatgttagaagcactttttaaaattagcaaataaaaactatatatttatggtgtacaaaatgatgttttggtatttcatacattgtggaatggctaaatgaagctatttcacacatgcgttacctcacatatgtatgtcttttttgtggttagaacacttaaaatatgctctattctcttggcaattttctagtatacaatatatggcttctaactgtagtcagggtgatgtactatagatgttttgaacttacttctccatatctaactttgtatcctttggctaatatgttcccaatctcccttctcccagactctggtaatcactattctaacttcctgcttctatgaactcaactttttaagattccacataaaagtgagattgttcagtatttgtctttctgtgcctggcttattttactaacctaagtgttcatcaatggatgaatggataaagaaaacgtggcatatatacacaagggaatgatattcagccttaaaaaaaaaggagctcctgtcatttgaaataacatagttgagcctgaagggcattttgataagtggaataagttagaagaacttttgagtgaaccccacacctgtgatttttctggccagcctcttcgtttggccttccagaatactccatcagaacacattatcctaaccatgcctattttccttaagagctgcagcataaatggcagaatcactagaagccatgccacaaactggaataaaaccacaaaattaaagttttaaattaggaaagaaaaatcttcatcctttggaagcacaaaggtcaaaatgcactgagaatatcatggagacaatgaccacttggttcaaggaaatggtgttcattcacataatcacagcatcatataaataagctaatagactgtgggccacaaacctggtgaacaggcataaatgtacaggtcgttcttagcaggatttactgaccttgaaagtgagatggaggctgatttaacagaggcaggtcaaagagatcagtttccaaatagtcacttatctattcgtaaatgaaaatcatctttgaataaattagtgattctcttggtgcctgtgaggccccaaattattctggcttttcattgtaaatgttttgggtgtcatgatttcatttccctttaaaacacatcctttactagtaaggactttggaaccttgtgtctgaagttcagagaagctaccagcaggtggcaatattggtttattgagtaacatcacaggtatgtgtgggcacagactgcgggtagctccatggatactctccctaagatgtctagtttaattctttcaaaatacaaaactacttacacagcctccagcacttagttgagaggagggaactctaatcataaacgtatatacttatatagaaaggtaatgagaagcaaggttctcttttcaaatataaatcaaagtcaaaaaaaattataggtagtttgagtctcatggttagctgtcttattatcaatgttttcataaattctataatcagagcttacattcttccacatcctcagagatgatctttgcctttcttccagtcctgcacattctagttattgtgagatttaagcattgttctatgactccacaaaccaagtaaacaaagtccttaattatctctaagcaagggtgctgactacaatggtcaagaactccagccccagtatcaaacagccatgaatttaagttgttcaccacttacttgggcagagtatttattctcgttaaacctaactgtcttgctctataacatagtgttaaggatacacctgcctcataggattaaatgagagatcatgtgtttaaagtgctaagtttaaggcagtatgcctggcacatagtaaatcgtcactaatactattatcatgacttaatgcaagtccctgactgattgagtaccttttcttttgttttaatggtcagattttaaaaatggaatagttaacttaccattgcttgtacactaatcacaaaagatgcagaagggtaattatcaaagggatgcactctctcttctaaaactgatttcaatctcctctcctaactgtcctctcagtctgcacttttgcaattacagctcttatcaatgttgtattccattggcctgattcaccagccccttggctttccctgcagctgtctggcagcttagcttttttcccttatctctactactttaaggaaagctcttacttagcaggatcacttcttttcgttatctttccaaatattccaaacataaccaagatatactgaaatgactgcacacaatcattttattttctacaaatcccctccaactctatcccgcttcattgtctcattcctttgtttattcttctgccataattggccaggtcaggcagccagttgaagtaaacattttgccattaacctattgaccgcagaactttctgtgtgaaaaacctggcttgagagctccctcctctcctgtctcttctctgcatccttctccctgcttccacctttatctaacagatgcagcttaaagaaaatctagttataattccacttcaagatccattcaacgaagacacctgcattttatcctcattaaggatgtgctacaagctgaaaacattacagcctgaactacaaatagtgcccctttctttacggctgattacagcaacttggttgtggtagttggtatgcctctgtatgtttataacaaaggatatgagatggaattaactacatctagcttctgttatgacttactctacctatgctgaggcttgttaataatttgtaggactttcagaatcttaaccaactctatcttgctctgctagaaactattctaccagaaactgcaccctcccctccaaataaataaatcaacagcagggtgaaatttcttgcccagactgtggtcctcttaccactcaatattctccatgaacctattctgacactttccttccatctgagatgctgagtataccaatcccaatggtcagcccataaatagtaatagaactctaactcatgatccctataataatacgcctagaaagccaaaccgtaactcctaaagaaattggctcagaaaggtcaggacttgaccttcttaatgactgtcagcttccctattttttgtctccactctgctttcaacttgggaccaatccaaaaaagccaaaaatgatcccccaaacccatcacataagatgccccacctctggttagcctaccttcagcttccccatggcaataatgtccaatcagagcacaactggaactatttaacatgtatgtatttgttgaacaaagcttccgcatccccctgcctgtcttggaattaggcaagtgatggtggctgattcccttgctgtagcaagctgtgtgtgaatacctccacttattctgctttgaatagtctttgttattcccccagtattactagaggttccactgagacatggtctgcaccacccactgtttctgtccctaggtttcaatcaggtgcagtacccatggatacctcttacagcttgctgcttgtggcttgcatccatgcagatgtggaaagtcagcatgaggtctgaactcagctatcttttcactgagtcccttggctgtttattctgtttggtacccaagttttgttattgtctcccatttgtttgacatccttggcaggcctttcctactcaccctctttgctttatttcattcttctgtgtcggactgtctgaaagcgtttatcattagaatgagaatcccagggtagagcacaggcatgagtcctataagcctatagtttgagctggtctcacagactttcggttctctccagaccagtttccatttgtacaaactttgctgtgagtcaccaacaaaactggacgaggtcttttttctattctattttgtttttggggtcctgaagttttgctttgattcagacaagagttttgtccctgatgttcagcctactgtgtccagaattggtgggttcttggtcttgctgacttcaagaacgaagtcgcagaccctcgtggtgagtgttaaagttcttaaagatggtgcacccggagtttgttccttcagatgttcagatgtgtccagagtttattccttccggtgggttcgtggtctcgctgacttcaggagtgaagctgcagaccttcccggtgagtgctacagctcttaaaggcggcgcatctggagttgttccttccttccagtgggttcgtggtctcgcggccttcaggagtgaagctgcagacctttgccatgagtgttacagctcagaaagctggcacggacacagagtgagcagcaggaagatttattgcaaagagcgaaagaacaaaacctccaaagtccagaagaggacccgagtgcattgtggctgcttgcgcagctggcctgcttttattcccctatctggccccacccacatcctgctgattggtccattttacagagagctgattggtccgttttgacagagtgctgattggtgcatttacaaacctttggctagacacagagtgctgattggtacgtttacaatcctttagctaaacagaaaagttctccaagtccccacccatcccagaaacccagccggcttcacctgtcactggcatgcgtcgcgggactttgcggcacctagccagccactctggcagcccagagggagctcgccccccagtcaagcccagcaggtgcctgccggctgtgccgctgagtgcggggcttgcggagcccgcgcctacccggaaccgcgccggtggccacccgtaagccccagctcccacccgcgcgtctccctccacacctccccgcgagcagagggagccggctctggcctcggccagccccagagaggggcccccacagctcagcggtgggctgaagggctcctcgagcgcggccagagcggacgccgaggccaacaaggaaccgagagtgagcgagggctgctagcatgttgtcacctctcactaccaggggatatacattgtcaggtctgcatttataggcagctgacttgttgaggacctgagacatgaagtacacaagcattacttttgactaagttttggcaggtctcatgaggttaagactaggtcttctcctccaagaaaaacttctgcttcttttatgtactgtcattgcagtcgtaactcttgagcatagctctctaaatggcacaagttcacaaaaaaaaatattgagaccaaaggctacttcgacttgaaaaaaaatgttcatttgagaggtgccttaggaaaaaaaaggaataagatttctcaggcctaaggagcagcgtttttctcttgtgcagaggtctccaaatgaaattctgatttcttcactaaaacttcttcactaaaagatgctttggtctaggctaaccctcggtttgacaaacttaaaaatcaagcgagatgcatttccctagtaaatccctgttttcctagtccttcagttgcctccttatatccaggtttcccttttgcctcttcccccttcattatattatctctcctgccactcttccatcatctcctcccttcacttctccttgtctggactccctacattttccaaatgattctcctaaaaccctaaaatcccagttgcctctaaagacccatccgtcctagtcccaagtggtcccaggcatgtaggcaattctagaatttaggcctcagatctgagctgaattaaaagctataattaaggattttcctaactccacacaagactagcacgtactcatggaataatttagactattttgagtgcctacaacccatagatacttgacctatgacaacttaaatgtatgttggttggaacctcagacactaaatcctaaatgacaaaaatggaccggaatgactcaaaaaggagacctagatgatccctctttccacaataaacctcagggtagaaaaaaatatcctagtcctgaaacagctacagtaaaaatagattgggctataattcaatcatgcaaacagagaaaacatgacactataggatatttgtcaatggattacatgtgaaattggagactcaatttagaaacagaaattagcataagaagtagactcttttacctgagttacaatatcatacagaacatttttaaagggcttcagaacccaaacaagacaagacccaaaataaacttaagagacctgcagatcaaacagctaggtagctcactttctgacccatcacctaccgaaaaggatacttgcaagtattaaaaacagaagagacactggaaaaaaggattgtcccatcatgcaaaataaacaccaagtcaaagaaaaatctctcaattcagatctgtgagggtaatctgaagaaagaaaaagcacccaatatcctaccttactgtaaacactcaagatgaattaactgtaatatagatggtcaacctgctggcaggtacaagagctactctgtcttcattacaccctgttacctttgttcagcctcttccttagagcaaacatacaacataggtggtaggtttttcaaataatgcacagattgttcctatatctcaatctttaactgtaatccttgggctcttgagtaaaaaacattccttccttctctgtgataaaatccctgaaattttaataggaagtgacttactttgcaaattaaactgtagtatgaaatgcaaaccagaagaactatttcttgaggttccagagtcctcctctattcattatcaaattgtgtctgctctggtatgtctttgcctcctccattacatttgatgcctaccacagataaagctcctgatatatggattagtttcctattgaagctgtaacaaattaccacaaacatagtggcttaaaacaacacatatttattattttacagttctgtaggtcataagtgcaaaatgggtctaactgggctaaaatcaagagtcaccagagttgcattagtcctagaatctcacagggagaatctgttcccttgcgtattttatcttttaaaagccacctaaattccatggctcatggcctcttcctccactttcaaaagaagcagtggggcatcttgaaatctctctaacacaagccttcttcttctacttataaggaccactgtgattatattgggcccacctggataatgtaaaagtcaactaattagcaatcttaattccatctacaaactgaacccccttgacatataggatgacatagtttctggtcagtaggaggtgaacatctttgaggggctattattctgcttaccacaacattttacctgacattgcatgggctaaaatttctgctgatataggaaaaataattagagggaaatctattaaacttcagacagattctaccagacagttatccaaactcccccaatatccaaaagcaaaggaaggacttaaacctatagataaaagccttatatcaaagaccttcccatactctacactagcctttgtaacactcccgttctgccagtaaagaaaccaaagaagtgagaatattgatttgttcaagacctcagggccatccacaaaattattatccttaatttccccatagaatgtaacctaactaccatcctctcatcaattccaaatgccagccacttgctgcactgggacagatctctgctctgcccttttcagagtgtctgtagtgaagtcaatgcctttataccttcacctggggagtgcaacaatatactctgacagtcatgccttaggggttcactaaagaccctcctattttcctagattctcaaataagacttaaaagacataggtttcccttctgattcagttttgatacagtatgtagataatctcttactttgttcacaggacaacaaagcctgtaagaggaattccacttactctcagtcttagcagaaaaggacataacatttcaaaaaataaattacaattatgtcaaaatagagtcaattatttagggtatgacctatgtataaaggggaaaacatactctcattataaagacaattcaacttgtcctggccctctaataaatgacaacttagagaaattctaagtttaattgatactgaagataatgagtgccaaacttttctgggattgcaacatctctttatgaattgactagggcttcaataaaagatactctcctctaagaggaaaaacatgaacagggcttctgtaatccaaagaaggctctttaagagcctcaccttctctaagtacccttaactacaaaaagctcttttatctatttgtgcatgagtaatctggacaggttgaggtttaaactcaaattcaagagaagcatcagaaacacactgcttactataactgcacccatgacccggttgcacagacttagcctccttgtctcaggacaatagccactgctgcaaaaattgtcaatgcttctgctgaattagttcttagctccccacttgacttcatggttccttacacagtacagacattactactgactaagagcaaacaatgcttttcagccagttggttaacctcttatgagactctgttactgtctccctcccacattactaaaattcaccactacagtaccctaagtcctcccactctcctgctcctaccaaaagaagggaaactttacaattatcttacctaagtgaaggaactttatgtacctcactcagatttgttagagattcccattggaaactctcacctaatatgatttgttggcggatgtctcaaaacagaaacttgaggttatcaaacaggatatgttatccctcactaatttaaggtctcctttagagtacacttggccctccacatctgtaggctcctcaaccaagaattccaccaaccacagatagaaaatattcaggagagttttccctaggttttcttcaagtattgttatagtatcaggtctcacatttaagtctttaacccatcttgagttgatatttgtatatggtgagagatagaggcccagtttcattcttctgcgtatggctatccaattttcccagcatcatttatggaaaagcgtgttcattcccaatgtatgttcttgtagactttgtcaaagattgattggctgtaagtatgtggctttatttctggctactctattctgttcattgatctatatgtctgtttttatactggtaccatgccgttttggttactatagctttgtagtataatttgaattcaggtaatgtgatacctcctgctttgttctttttgcttgctttgggtattcgggattttttttttctttggtttcatacaggttttaggattttttttctaatttcatgaaaaaagacactggtattttggtaggaagtgcattgaatatatagttttgggtagtatggtcattttaatgacattaattcttctgaatcatgagaataggatgttgttccattttttaatgtcatctacaatttattcattagtgttttgtagttttccttgtagacatcgttcacttccttggttaaatatattcctaggtattttgaggttttctgtggctataataaatggggttaccttcttgatttgattctcagctagatgattattggtgtatacaaagtttacttatttttatttgttgattttgtaccctgaaactttactggattcatttatcaaatctagttttttggtagagtcttcagggttttctagatgtaagattatatcatcagtgaatagggataatttggcatccttttttttccagtttgaatgtcttttctttcttcttgcctaattgctgtggctaggacctccagtactatattgaataggagtggtgaaagtgggcatatttgtattgttccagttcttagaagaaatgataggcaacgaagattttgaagggtggaggggtgagaggggtgaagatgaaaagttacttaataggtacaatatgcattattctggtgaaggatacactaaaaaccctgagttcgccactatgcaatatatccatgtaaccaaattacacttgtaccccataaatttatacaaatagctttttaaaaaaattagaaaaaataatacaaataaaaaatacagtaaacaaccatttgcatagcatttacatatattaggtattttaagcaatcatgagatgatttaaagtatagtcatgcattaattaatgagggggatactttatgagaaatgcattgttagataattttatcattgtgcgaacattacagactgtacttacacaaacctaggtggtatagcttactacacaactaggctatgtggtacaccctagcgctcctaggctgtaaagatatacaacatgttactatactgaatagtataagtaattgtaacacaatggtaagtacataggagaggtacagtaaaagtatggtattataatcttagggtatcactgttgcaaatgaagtccgtcattgaccaaaacattgttatgtggcccatgactgcatacaggaggatatgtgtagattatatgcaaatattacattttatataggaaagttgagtgtacttgaattttggtatctgtaggaggagtcctgaaactaatccccagcagataccaagggaggacactctatactcctccaactgaggtaccatcagctcaggtggcagaacgtattatgcttactagagcttacaatctaacaaaaccctagaaagtaaacatgcatacatagagcaggtatgcttttgcagtagtacatgactttgggatgctttgcaaccaaggaggtttctcatctctgctggaacttccatcaaaaacagacaggaaacttttatgcagtctaccaccaatgggcatttaggttgatttcatagctttgctattgtgaatagtgctgcagtgaacatttacctgtatgtgtttttatgcctaccaggggttgtagggtgggaggagtgagaggatctataaaaataactaaagggaactaagcttaatacctgggtgatgaaataatctgtacaacaaacccctatgacccaggtttacctatataacctacgcatgtacccctgaacttaaaagtttaaaaaaagaaacttttagatgcttcctagggaggtgactattacaaaggttgaagcccatacaaaaactgatagtatgaaagtttggggaaaatgctatagcagatcattctgccaataagcaggcttcaccaaggttatgagcctaattaaactctcaaagaataaatcccttgaaatattcaaaaaggccgttatgaaatatcaatgttaagttcctaaaaagtcctaaaaaggaagaatggaaaaactctggttgcacatttcacacagatcatctctggcacccccaatgaggacactggagacatgaataacttccaatggatatgaacaaaatttctctataaaactactcatcatggtacagacaaattggttactatcttaaatcatcattggtggggaagatttatggactgatgaggctatttttagatcatgtgtcacctgtcaacccaacagcatcttggagaaactataaaggtggatgtgaaacctcaagaacccttaacaccctcagataggttttgtccaatttccattctccatgaaacttgtatgcctattttcaggatcggttgaaacatttccttgctgaaaagctacagccttcacaatcagtacaaagctccttgataatgcatttctaatttggggcataccaacttttataacaagtaaccaaggctcatgttttatgggagccattgtaaaagaaatttgtaatgcattgtcccttactcaaaaatgacactgcctttattactcacaattttctagaaaagttgcaagaaccactagcatcattaaaattagcaagctttctgaaggacgtgagcctcctttgggaggccaaagttatttccaccagcacttatggccatatggtccacctgctcagagaattactggttatctatctatgaactggtaactggaaggccccttcatttatggacaccacctacagtattagactaccctgctacacaaaaatatgacaaaatagcaaaagaggctcatgtagtatactcagttttatcaccaataagttaagattgacttcttaacttgtttacaatcctttcctacacagcctctttatgatcttcaacaggagatcctgattattagaacagacattagaaaaaactgttcttgaacctcccctgtaagggaccttatcagatacttttaacaacaaatacatcattgaaactccagagatcaatccttggattcatgtttcataactaaagaagcaattcaatattctatacaactggaaggctactccaacagaaaaacttaaacagaattcttagagatattatagaaatagttggtcttcagaagcagatggctgatccaaaacctccagaaaaagatgatcttggacagtagacagcttgcacccaatacatccaacctaaaacccctgcattcttgtttgtttttcaatcttcttacctgttaccactctccttattttccatagagctctgattgtcatccactaataatggttctttttctcttttttttttgtctattataattaagtcagaacatactcattctaatgccattcttatattttttttttcaaaaataagccactgccctcaatattacagactgctgtataggtcaaccagaaccagaacccctgataaaaaacctctgagcaatcctagtctcatcaaatgataccccagcaaattataatcagtgacatttccacttgtacctacatggacaaatgactttaaacaaatcaacctaagactttgctgttgtctctctataccagaaaaagaaccaattcttactgcctgtttatcagactctatataattctaaatttgaattccataatcttcactggacaatgggccaattacttgatgccaggaagacagtaatagagattcaaataggtaaactcagctaatgtgaggccttggttccaacctcatgtcatgaataattctttttgtccatggctgtccagttcgtgacaaaaattcctggtctcatctgcctcaggctaacacctcaagtctttttggtacacagaggccctgattctataaatcatcaaggctggaaattctgactcaaatacaagttccaaaatgaggccacctttgaagcattctatcagggagaattactgactcattgtttatatgaataatcagaacagtgttcccaacaccagaaatcgtatacatagaaaagactaagaaatttaacattaactctaacagaagttattaacagtaccaactctgccctagatgtaatacacatcagtcttaactcatcagcagtagtaatgcataatatcattgctctaatttcttgttggctagccatggtggaatctgtgccaatagtaatacttcttgctgtacatgaattaataaaacaggcaaggtagtacaggctatatgctaccttatgaaaaagctacctaaatctctaaggtgatcctcatgccctgtagaaatttttctcacagcctgaattgggcaatttaggttcttggacccaaaacatcttataaggactataaactattcttctttttgtcatagtgctcatgatgctgatctgttgcatgctatctagagtcttagatacttctgtgcagccactctcttatcagatgatagccatgatgataacacaacaaaaaggtcaagatcttgggaaatgatgactatatgtacaactgaacaatccgtaaatggtgaaggtcttaagccttccatgagaatgatgcaaaggtgagactgagactaaacatacaaatacacaaaggccagatttttatatatatatatatagtcacaatatatgaaaatagcactctaatgcacaatctccacagcaatgagcctgggaaaccaaaccacagtctgcaggcttcagacagcttccctacattttgtccctagtctcaactcagggccaaaagaaaaatccaaatatgcatcccaaaccaaacacgtaagatgccccacttccagatggcttacctccagctttcccatgccaagaatgtcctatcagagcatgtatagtatctttgcttttttaaattcaatataaggctttaccaccctcctgcctatctctgaatctctgaaaagtgcaagtgatggtatgtggaactataacaaactctgaataaatagtttgttatcatttaggtagttttaatttattttcacacatccttgtacaatgtccacaggcaacccagaatactaaactctagcaagtgtacccataatgtaggaaagtaaatagaccttaaaatcaccagttctgatattcaatatatatctaaccttggaaaagattgttaatatctctaagtcctagtttcctcttctgaaaaataagagtaatgtaatcacctaaatggatttggtgtaatgattaaatgtcatgatgatgatgatgatgatggtttctggtagtagctatgttcttcagatgggatggtaactgtgtcttgctgtttgctacctaatgtgagatagtatatgattttgtgtgtgtgtgtgtgtgtgtgtgtgtgtgtgtgtgtagtgtagcgtataatttcaagcatatacagaggtacacaaatagtatgacaaatctcaatggattcatcacccagttgcacaaattatcaactcatgggcaatcttttttatccatagtccttctattcacgcttccattatattttgtttgaagaaaatcccaaacatcattatttcatttgtaatatttcattatatatctttaagaaataaagactcttatgaaatataaccacattattatactcctttaaaaatccttaatatctaatatcaatttctcatgctatgaatctaatatgatgaaaagttcaacattgatttatatacacttcaattgtttccacacatttatggctccttttcttcatttctatttttctttaaaatggtgttcataaaaatgtatggttactaactggattacttctatatttttgacaaggggcagaatttggaatacaactgaattttgtctccattaatacctaccttcactacctttggtgaatattccttatatcttataatttcttgctattttaatatctaaacaacctagagtaggctgtgtaatatttactatttagctccttctagtacagtgaaggaattacaataaaatgatactatggagaatatgcatggggcttcacttaatcaatgtcataaatatccatttaaatattttcaaaatatttaccagttcccttagaaataatttacttgaggggtgatgagttcttgcttgtctgattcatttgtaaggttcagtttatttactgaggattatcgatgtacagttaccagtaaatttagaaagtatcctgtaggttgcatatttacgaaaagtccttccctatcatttatcatcctctaaacacatcctaaccacttttgctatcatcagttttgagcaattgattttcagaagcagacatttgaggggagtggctgaaagggaggtcgtttgagcattgctgttttatgagtcaataacccacctcaatgaaaaagaattaatttcactgaggtaagtaaaatgtccttttaaaaggataaaatgaaaatatcatacattcattctgtatagttacatcgttagattttctatttttaaaaatttcctctggacacactttattttcccaaactatagtaaataccacagcaaacaaaaatttttgcaagccttatggaattaaaaaaacaacacttagaatcaaaggacattcaactagtgaattattgcacataagtcttaaacttctttgactctttttgtgaacagcaggaacagtgaaattaaacaaaaaattattaaaggatttgtttccaactggataaaaaggaagatggtaaaggaaaaggaatcttctaagaaaactgtgactctttaatatcttaatagaacatatattagtcaaatgtaatattaacagaaatgtctcatttgtaccagtcaaacaataaaattggcttctagacgagatattttcattccataaatcttaggaaacgtaacttgagatatttagtaaaagcatgccctaaaacccgttaaatctaaatttaattttctgtggtattggctaagggtttgattatcttctttaagtgaataaaatcaactgttctgttaaatattttccaggaaggaaaaccagaagatataattgcaggagacaaggataacctcttcttgcttactgtcattaaattaaggtttagaccctcaatgcaataaaaaaaatcaaatgtcaaatctttcagctataataattttatttttcctggtttattcagtctgcctcagataaaatctgtaaaagcgaaaatgctctgagtcatacatttaaaattttaaaagttgtaaccacatcactcttaccagaattaatcttggcactgtgatgaaccaaggtaagtaatttttctctagcattaagattctcttctatgctaaattccagctatgttcaaacataaggatatcacatctaattattaaaactttgacaaggaaatgatagtagtaaggtgaatgactcattgcctaatactcagctgtcccatgtcagcaaacccattcattcttggcagaactggaggcatacttcagtctacaggtataccttggaatatcaatcaattagggattccttccaaatccaattattaccaacccctgtcacttccaccttctgagagtctctctaatccatcccactgctaataccccagttcaggcccccttcagctctcacctgaactgcaactagggcggccatctgagggatctcccgtttctgtgtctacccagccagcaattgatccttaactgaacaggagatctgtcttcccagagaacaaatctttggatggcaaacaagcaagagagtcacacacaaaatatttcacaatttagtttcaccatagtttatcatattatcgtcccctcactctcccctttctcactcccttcctattcagacagacacacatacacacacacacacacacacacgtgcacgcgcaaactccacattaaccctaatctcacaacttcccagatatagagccactttaataacctttgaaaccacattggactcattttcacattcctacaaatacactcacaaagcattgtaaatatttgttgtgtctattgcctctctgctaaactatgaatttcatgggggaagtaatcgtgtcttagtcttcatcatattaatctctttgataaatattcatcaaagcgaaactaattctaacaaatcaatgtaatataataaatattcaataaataaactatgaatatttaagtattcattaaatgttaaagatgccatttcgacttcatttaattttattggaatttatgttaaaatttgtaaaatatgagtaagaccttagctcgttcaatacaacaaaatacattctagaaatattaacaatgtaaatagattttttaaaaaaactatagaaatactagtaggaaataaaaagtcacatttatatcatgttggggaatggaaaagacctttctaagcatgaatccgaaggcaaccatcaataaaaagaaagcaatatcagctttttcaattaaaaaaaaattccatagcagagttatagcaatataaccttcagcaatgatggaaaaattttataggtacactgtctaatacagtagcttctacccacacataactactggatgcttgaaatttagctagtaagacttcctaactaaatttttaattttatttcattttaggaattttatttcatttaaacaattcaaattacatttaaatttcatagccacttgttaatggctattttttgaacagtgtggttctatcagtttaaataaaatcttctagaaagaaagtaaaaatgcaaaccacaaaactgaaaataaaatatttgaaatacacctattgaataaatacattatatcttcaaaacataaactgttcttacaaattcctcaaaaaattatcttttggaaaaatagttacagatgatatacaaaatgagaaatatagatggctaataaatatatgaaaagcattcaccactcactactaatcaaagaaatccaaattgaaacaatatactgactgctgtcacttcttcagcaccaccctatcttcacctcatttccattggttagatttgagtctatccattctaccttttcttaacaacatctttatcttccttaatcaattatttttctggcacccacctgacaaaaactgaaccttggataaattcaacagtccacgtcatgaactagagatcacataatagaaaaccatatgagacagtaaaaccacggataggtgtggtcttgccacctcattctcagcacagcctggacatcctctacatgttctttaccagttctttctctctctctctgtttctccacactggctgcttaaaccctttctgctctctcaaatttccaaccctgccatcttcctcctatgagctgaaggcctcaccactgcttcacaaagaaattaaagaccatcctagggcacggtggctcatgcctgtaatcatagaactttgagaggccaaggtgggcggatcgcttgaggccaggagtttgagagcagcctgggcaaaatggcgaaagcctgtctctgcaaaaactacaaaaattagccgggcatggtggcacacacctgtagtcccaactacctcaggaggctgaggcagaagaactgcttgaacctgggaggcagaggttacagtgagctgagattgtgccactgcacttcagcctgggcgacggagcaagactctgtctcaatctccaaccagtataaatgacacacagttattacctttctactgatcccttaaacttccccaactattaccacagatgcaatgtcaatatttatttcaccatttgctggatttcaccctttgtttcctatctcctcttttccttgtattttctattctcttcatctaatgcacccatccttcaagcatttaaatataccaaattctctcctgttttgaaaagacacatactgcagtgccttaggaaatcagcctcaaaatccgagctctaccattaccgctgtgtgatcatgtttggcccctgtcatgtttccctttctgtatctacaaaagtggaataacaacaacattccatccatagtatagttacgaacagggaatgaaaaagtttccacaaagcacttagcatggtccctggcatatgataacctcttggaaaacatcagcaatcattttcactttttgaaatgattttgagctctcctcagcttcatattctttccagccatcccccatcactctccttcctttcagagcaattcttttttcttagctaattttagatttaaagaaaagtttccaggtactacaaagagttcccatattccccttatcctggttcccctaaagctaatacattgcataaccatggtacaattatcaaaactaggaaattatcatcagtgcaatactatattaaattacaggccttttccggatctgaccagttttttcataatgtaattttctattccaggatccagtccagaatcccacattgcaactgtgatttctccttagtctcctataatccatagcaattcctttctctttcccagtcatgatctcaacacctttgaaaataactaatcagttatttggtagactcttcttcattgggggtttgtctgatatttattcattattaaattttgaaaacttacattttttagtaagaatgccacagagctgacactgtgtccttctcaaggcatcatatcaagagatcatgatagcagtatgtcacaggaaagtgttttgtaagaattatatcctctcactgactccatttcatttcctcttgcttctcaatctactgttcactggcctcagtctccatcagtccattgaaactgttctggttaaggacaccaagaactctcttgtcatttaaagtttctttaaaagaaacttctcaagcctttactcctagaccacatagtatttttgacactgctgaggactatcttctttacacatgcatttagctgccacaacacatttgcatgatttaccactgattttttattttatgagtgcttacctgcactcaggcccttccttccttcctttccttccttcctcttttatttttctttcttttcctctgtctttctccttctctccttccttcccttcccttccttgtctctctctttctttctttccctccttcattctctcccttactttagagatgggatctcactatgttgcccaggctggagtgcagtgtctattcacaggcatggtcatagcacactacagcctcagactcctgcggctcaagtgatcttcctgcctcagcctcaaagtatctggaattatagactcctatctcttagtgctttcctcagtcccctttcctggctccttttatgataaactacctctgaacgttgagagtgcttatctctgactacacattcttcctagattaatgcatctacatatctggttttacttgctatccagatgcagacaattcccacatcaatgccttcaacacatttctgtctcctagtcttcatcccatatacacaactgtattccaaacatctctaagggatagcctacaggaattacaaatggaacagatcccccaaccaactctactatgattctaaagttgagccttctaaaatatgatttattttatgccaccaaacctactaagccacttatacatataaacacaacaaagtagacagtaggtaaagaatgtcatatggtctttgaaataagattttattaatgcagtctaagcctgcaattagattttgtgatagtcacatcatataactgacacataagctgaccacaaaagaaaagcttctattttaaaaataaacatatagccgtagctgtttttccaatcctgtaattgtatgggtaaaatttaggacatgctacatcactctgtttaatttggtcctcattccagtctgacataatttgggatccaaatgcagtaatccaactagctgttaaattaagatacactgagcaaacactactagagatacagaagtgaggcagagtattagttgtcccttcaatccattcttctctttatccatagtattgcagtttaatctaggtccctggccattatctagatgtgaccctgtctaagataaatataataggggccacatatgtaattttaaaatttatgattgccacattaagtaaataaaggtgaaattaacttcagttacatatctggtttagccaatacatccaaaatattatcatttcaaaatgttatcaatattaaaaatatttagatattatgcattctttttttcattctacgtttctgcaatcaatgtgtatgttaaactcagaacatatgttaatccagagcagccacatttcaagggctcagtaggctcacttgaatagttgagaggtagagagactgcatttatggtacagcagcttaaaccttaactcaatgtacacaagagttgaacaagcaaccacattccaggtcctaaatttgccttctctcctagctgcaaatttggtggctggtggatttccatatttccatatataagataatgtgtttgtgtgtgtgtgtcaaagcagaggttcagggagagagaaggcaatctctcttaaatctgtatttgcataaaaataacacttttgtttagattccatgttaccagtcaataaatataggatatctaaaaattattttattcatttttacataaaactaaagaaactgttattcatattaaaatatggtcatcactgttattattattatttcttaggttgagataagcattgtttatccttcaattagtcatttcatgttctccagtggcagacagcctgggtgaatttatagcaatgggatgttgccaagtttgtttcaattactcccttagcattgtgtcacaaaaaaagtatatatttttatgtatgtatcaaagtgcacatgagaaaggaaagagtcaaagtcaatggcaaataagaaaccaataaataaaatgtactgtgctttaaaactttgttgatccacttcccaggaagtcattagtgtctaataatggcaggtttctccccactgcccattcctgttgactgggggaagggagccttgtgagtggagaagagggtatgctacctacagaactgtgttcacagtgttggtatacttatgtgtcctaccaactgtggctaagcccatggcaggctccaagctgtggatcattttatctttctatttgtcaggtcacagtcatgaccactaatggcacccatcccaaaagtatatgattcttcaggaaatacagcttgagataccaatggaagtatctttttaagcaaaaataggaatataagattttaaaaattattttcttcaccttcttggttagtgactaataaattttttggaatcttttggctttcatgaactgttagcagtcccattatattggctctttcctccctaactcatatgtggtaaaattaaagaaggaaggaaaggaggctgaatgaccattggtcatgaaaacctcaatattccaaaactctctcaaagagcctctcttcctcaggatagtagtttgaaaacagaaaatttgggaaggccacttgggataatgtttggtgtctgttgctgcatcagcgtttacaaagtgagtatccaaacatgtactttttttgttgtttttttcgagacacagtcccattctgttgcccaggctggagtgcagtggggtgacctcggctcactgcaacctccgcctcctgggttcaaatgattctcctgcccagcctcctgagtagctgggactaaaaatgcacaccaccatgcctggctaatttgttgtatttttagtagagacagggtttcaccatgctagccaggatggtctcaatctcctgaccttgtgatctgcccaccttggcctcccaaagtgctgggattacaggcatgagccactatgcccggccccaaacatatacttctttaaaatgcacaaaaactcaatgagtgttattttccttattactattgttatacctaactaacaatgaggaaatctaaggtgtagagacattaaatgacttgctcagggtcaaaagctaataagcggcagattaccaagatttctcaattcaagtccagagtttccaccatgaatagcctcagaatattgcaaaaggctatgctttaggaatggtacttaatagtgttaaaggactgggtaaaataagataacctaccaagaaaaaaagttgtaacttcaattgacaacttacaatatgaaaaacctaaacattggttaaaaaaaggaaactgaaacttttttttattattattatactttaagttttagggtacaggtgcacaatgtgcaggttagttacatatgtatacatgtgccatgctggtgtgctgcacccattaactcgtcatttagcattaggtatatctcctaatgctatccctcccacctccccccaccccacaacagtccccagagtgtgatgttccccttcctgtgtccatgtgttctcattgttcaattcccatctatgaatgagaacatgcagtgtttagttttttgtccttgcgatagtttactgagaatgatgatttccaatttcatccatgtccctacaaaggacatgaactcatcattttttatggctgcatagtgttccattgtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatttacccagtaatgggatggctgggtcaaatggtatttctagttctagatccctgaggaatcgccacactgacttccacaatggttgaactagtttacagtcccaacaacagtgtaaaagtttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatgtccttcgcccaatttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagtagctctttagtttaattagatctcatttgtcaattttggcttttgttgccattgcttttggtgttttggacatgaagtccttgcccatgcctatgtcctgaatggtaatgcctaggttttcttctagggtttttatggttttaggtctaatgtttaatttttgtattaattgaattaatttttgcataaggtgtaaggaagggatccagtttcagctttctccatatggctaaccagttttcccagcaccgtttattaaatagggaatcctttcccccattgcttgtttttctcaggttcatcaaagatcagatagttgtagatatgtggcattatttctgagggctctgttctgttccattgatctatatctctgttttggtagcagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatattttcttcccatccatgaggatggaatgttcttccatttgtctgtatcctcttttatttcactgagcagtggtttgtagttctccttgaagaggtccttcacgtcccttgtaaattggattcctaagtattttattctctttgaagcaattgtgaatgggagttcactcatgatttggctctctattggtctgttattggtgtataagaatgcttgtgatttttgtactttgattttgtatcctgagactttgctgaagttgcttatcagcttaaggagattttgggctgagacaatggggttttctagatatataatcatgtcatctgcaaacagagacaatttgacttcttttcctaattgaataccctttatttccttctcatgcctaattgccctggccagaacttccaacactatgttgaaaaggagtggtgagagagggcatccctgtcttgtgccagttttcaaagggaattcttccagtttttgcccattcagtatgatattggctatgggtttgtcatagatagctcttattattttgagatacatcccatcaatacctaatttattgagaatttttagcatgaagggttgttgaattttgtcaaaggccttttctgcatctattgagataatcatgtggtttttgtttttggttctgtttatatgctggattacatttgttgatttgcgtatattgaaccagccttgcatcccagggatgaatcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattagaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttcggagggtgtatctgtcgaggaatttatccatttcttctagattttctagtttatttatgtagaggtgtttgtagtattctctgatggtagtttgtatttctgagggattggtggtgatatcccctttatcattttttattgcatctatttgattcttctttttttctttattagtcttgctagcagtctatcaattttgttgatcctttcaaaaaaccagctcctggattcattaattttttgaagggttttttgtgtctcttcagttctgctctgatttcagttatttcttgccttctgctagcttttgaatgtgtttgctcttgcttctctagttcttttaattgtgatgttagggtgtcaattttgggcttttagtgctttctcttgtgggcatttagtgctataaatttccctctacacactgctgtgaatgtgtcccagagattctggtatgttgtgtctttgttctcgttggtttcaaagaacatctttatttctgccttcatttcgttatgtacccagtagtcattaaggagcaggttgttcagtttccatgtagttgagaggttttgagtgagtttcttaatcctgagttctagtatgatcgcactgtggtctgagagatagtttgttataatttctgttcttttacatttgctgaggagagctttacttccaactatgcggtcaattttggaataggtgtggtgtgatgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtcactgcacatgagatgggtttcctgaatacagcacactgatgggtcttgactctttatccaatttgccagtctgtgtcttttaattggagcatttagtccagttacatttaaagttaatattgttatatgtgaatttgatcctgtcattatgatgttagctggttattttgctcattagttgatgtagtttcttcctagtctcgatggtctttatattttggcatgattttgcagcggctggtaccggttgtgcctttccatgtttactgcttccttcaggagctcttttagggcaggcctggtggtgacaaaatctctcagcatttgcttgtctgtgaagtattttatttctccttcacttatgaagcttagtttggctgaatatgaaattctgggttgaaaattcttttctttaagaatgttgaatattggcccccactctcttctggcttgtagagtttctgccgagagatcagctgttagtctgatgggcttccctttgagggtaacccgagctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggatgttctcctggataatatcctgcagagtgttttccaacttggttccattctccctgtcactttcaggtccaccaatcagacgcagatttggtcttttcacatagtcccatatttcgtggaggctttgttcatttctttttattattttttctctaaacttcccttctcgcttcatttcattcatttcatcttccatcactaataccctgtcttccagttgatctcatcggctcctgaggcgtctgcattcttcacatagttctcgagccttggctttcagctccatcagctcctttaagcacttctctgtattggttattctagttatgcattcgtcttaatttttttcaaagttttcaacttctttgcctttggtttgaatttcctcctgtagctcggagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagctttccttctaacagacaggaccctcagctgcaggtctattggagtttgctagaggtccactccagaccctgtttgcctgggtatcagcagcggtggctgcagaaccgcggattttcgtgatccacgaatgctgctgtctgatcgttcccctggaagttttgtctcagaggagtacccggccgtgtgaggtgtcagtctgcccctactggggggtgcctcccagttaggctgcttgggggtcaggggtcagggacccacttgagaaggcagtctgccctttctcagatctccagctgagtgctgggagaaccactgctctcaaagctgtcagacagggacatttaagtctgcagaggttacagctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgccaccttgcagtttgacctcagattgctgtgctagcaatgagagagactccgtgggcgtaggacactctgagccatgtgtgggatataatctcctggtatgccatttcctaagcccatcggaaaagtccagtatttgggtgggagtggcccagttttccaggtgccgtctgtcacccctttccttgaccaggaaagggaagtccctgactccttgtgcttcctgagtgaggcaatgccttgccctgcttcagctggtgcacagtgcgctgcacccactgtctggcactccctagtgagatgaacccggtacctcagatggaaatgcagaaatcacctgtcttctgcatggctcacactgggagctgtagaccggagctgttcctattcggccatcttggctcctctgaaactgaaactcttataggcaaataacatgtctataagtaaattagtttcttgaatgttacacatttgagctgttaagcttgttttctgtttcattttaagagtttaaatctctgaaagtttggtagaatatatcctctattttcattttcaagtgtgaaagccatatcaataaataagtgcagacttatataactgcaaaaatgtatcttcaagtatttattgtgtacctactatgtgccaaaagctcagtgtgcctcaagcttggggacagaatcatgactagaactcagatcattgtccaagagttagtacgcaacatagtgccatcttccaaaaaaaaaaaaaagaaaaagaaaagataaagaaagaaaagaaagaagtgccatagtggactagatcccttatctactcaggcctgtgatctagaatgacaatagtacatactggaagaaatgatggttttatgatatcaattttataaagctaggaatgtgcactcaaacatcgtcttacttgtcttaacaactcattgtaaatgccttttctttgaattcatttaagccacacttaaacctatctatatattctgtatctaaactcactctctattcagatgaagccaacaaaaaaacaccccaatatacataataaaacactataaagttgagttaaaatagcaacttttttctatactacaattaatatgtttgcctactttttaaaaattgtttaacctagacttacacattatgtcatcaaacatagtcatagtactaagaagagattcagtataaaactactgttacaaaaagggatgagagagtagctgcaggctttcattttgctaaaccacatgactatccttctcaacagaatgtagaaacctgcacttttggtacttttattttacataaaacattcttctattagtttatttttctaaagcattttgcagttattccctggctaatagtaataaccaagaattaaaagctacagcatatgttgaatagctgtattacaccataaatcacatttactgccatttgttaacatgctgttttaatttcagaaaattcaatgacagttcatgaattttgcggaatctcaaaaataatgacatgattttatgttgaagactaaagggatgttgtcaattttaatgtgtactgggaggtcacatggtattctcaaatttaatggtaaagcaaatttagttaaccctgcagaaacataaggagtcttgaacaatcagtctcttggctagccaagggcaaatgaggaatgaagacacttacaagtttaaatccaacacctgagggtgctttgaaaacttttctgcaccaaatgcagctggtggaaagagatactcaaagggtaaggaagaggcggtacaaagatagctgataaaaggcaacagtcacagcagtagaaaaatttagacaactatttgcgagaacttatcatctgagtaatcattctttgcaccccaggtctttattcccaccctcaagaataaagttaactccagctatgtccagatacaggtagttttgcctaggatactagttatcttagtttgttcagtctgctataccaaaatgccatagatcagatggcttaaataacagacatataattctcacagttctggaggctgggaagtccaaaatcagggtgccagtatggtcaggctctaacctgatctgctctttctagcttgcagatggctgccttcttgctttatcacatgagagacagagaggaagcccgtgtgtctctttctcgtcttataagcacactaatcccatcatggagccccaccttcatgacttcagctaaacctaaacctcccaaagaccttgcctgctaatcctatcacattgaggattatggcttcaacaaacaaatttgggatcagggaggacataaacattcagtacataacaatggtcatcaacctttagggtgcctaagaaccacttggggagatttagtaaaaatgcagattactaatccttcaacatttgtgattctgattcattccatctgggaggcggacagaaaacactttcaaaagcagtccaggaaattctgatgtaagggtccactggccacattgtgagaaattctgtcctggcttagcttcaagcagaagggattgcttgcaaagtgcctgtgctgtgcctcaaagactgaaagaagtgtattcagagatcagactgtcctacggatggtaaaagccagaaccaggaggtgccaacagaggtgctcccacataaatgtcaaccaaatggtgctaggtaatatagatgtactcagtgtccaattcccatcctctcccccattgccatggcctttagaaaactatctttgacagagaggcaaaaggaaaacacctggctagaatcctcatatccaatctaaaaataagattttaagatagattttaaggggaaacaatacatgggaattcaattgtgcatatcctaatggagtcactctggccaatgagagctcaccctgagaaagagggcctctcccttacaatatgataacaaggaaaagtcttttgaaataaacaataatagtaataataacaataacaatcctatgaggattatattgaagtccatgtagtgtttttccatttatcagttccttttgtcttctgtgataaacatgaaggaaaatgtatggttgtaaatggtttcaactaacaaaacaataacattcagaaaaaagtcatcaggagaactgatttttcagttgtcctaaagataatgcagtgtagtcagattaaaaaccctgaattgacaaggctttaatagatttaacttctggggcttactttttaaatactgaaatcacaaacttcaacagcttcaaagtgttttgcaacaaacatataatgattattttaaaaacgattattgtttataagcttaaaaaggaagcagcaaaagaaacagcattataggctgggttggggctcacactgtaatcccagcacgttgggaggccaagctgagaggattgcttgagcttaggagtttgagacccggtctctgaaaaataactaaaaaattagccaggtgtggtggtgtgtgcctgtattcccagctatttgggaggctgaggtgggaggattgcttgagcccaggaggttgaggcttcagtgagccatgcttgcaccactgcactccagcctgggtgacagagtaaaactctatctcaaaaaaaaaataaaaaaaaaaagaaaagaaaagaaaaataaaacagaattataacactgagaattaaaattacttttaccatgtagcgtatttccctacaaaaattcaagttgtcctttaaatacaaatacatgaaactactgatgtttcaagtaaaataaaaatgaatgtcttcatagcactgtttgttattaagctatttccatactggatttatgcaagctatgttttactaaaagaataagcaagtagaaaataatgcataattcctacaggccactcttctttaaagatgaggaccttcttgataccaactgaaattgcctgtgtcaatgattccggtgaaatatgcctcagtaaagatgggactcaggaaatataataaaaatctgtcagccaagttccaagtgcctaggaactggtcatcactggcacattgtagagcagtttgataagcattaaaaaaaagtttgtagtgataaatgattaactattgttgaaattaaattgaatactttcatctttaaaatccatttaatttctttaaagccataaggtttttcaaaggttaagatttattatggattttggtttcaggtgattggtaagtaccagcctcagaatgccatttggcacacaaattgattccctcaggaaaactaaaattatgtggataatcccatctctatgtcctgtctctcaaaaactttagaaaattaattcaaaggacagaagtgtaggttgttttcaagcaaacaacttcaaagtgagtacatttttctcctttaaaatacacacagaaactctaaaagggtcaggccatcttcaagggcagaatacttgttcaacatctagatataggctgctaaggctgatgaatgagaatggaagtaagagaaaaagctgacaatcagtcaagggtatcatcccatatttttaaaaaattccttctttggtcagttcattccattttgatcaaaagcatcatgcaaccacttgtttaacataaggaaaaaaaatctcaaaatataagatgaatttcacattactgaagctcacagagaatgaaatacagtttttctagaaccttatattaatttcttggccaaaattaagtcctctcgaaggttaaaaaaaattgcaagactcatcagttatggcagccaacagatcaaatactcatttactcattgtatataagaaaatggtgtatttaaacattcaacaaataaataaagaaaacaaaaatttcctgggagcaccaccagaagaatgatgatgtatgttggtgatagccactgaacttgcagctgaatacctggttcaaggtggatcatgccattctcctaccttctgtgtcacttaaaagaaattcaaattccataacatagcccacaatattctgctgagctgccccctgcctctcttttcagtctcatcacctattctctcctcctcattcacactggcctcccttcaatctctccagttcagcaagcttcatcctacttatctagcactctctggctcctcccctgcctcgtactcacctgctgtctcctgctcatctttcaggtctcagactgcatgtcactccttaaattcagtcattgcctgccccacattctgaatcaggtgctctattttctttcagagtatgctctattcttcctttgaaacatttatcaacacagatgattatacatttgtgtaattattcatctaattactctttccctcattagaccataagatttctgaagtcttatacatggtaactagcacgtagtacaaactaaacaaataatattaaattaatgaaatcccagttctgacaattatattatcttaggtaagtcatccaatttctctgagctttattttcttatctataaatatgggcattaatctaataattttatatattttaacataataggaatatattcacttttgcaaattggaaagcaccactcagatttaagacattatttttttttcttacatcaagattatgaaccaaagaacttttaaattgatcattatagtcttcatttagtcggcataggcatatccagaaaggcctcacatttagtactaataaagcttggtgtttaaggaatattatagacaatgaataacaatgattccttgtaatttacaactgaagttgatgccacatcaggtatatcaaaatcttcgttaagactatttcctttaataaagtttatgctaccatgttacataaaaaggaatcaactggtattatttagttgttctgtttatatggactattttagcaatttagaaaagatgtagggtacatgccactttatatgcaaatatgccttgacaactgtatgaataaacaagaaaactgtaaatatactttaaaagccaagatgatacaaatggccattcatgagtggacttactgtctaagttatttttccaagagtggaaattcattcatgttgatacacgcaattctcacttcattccctcttccaatgacaaggtgaggagatctatgtctagagcactttttatctaagtgaaaggagccaacaagtgccagatgaacatgactgtggtctcatcttttttcaccttaacccactggcctaacgggcctggacagcagaagatttgtgatgctaaaagaatttacttctgcctggatattttagggatttgactcctgtcaggtattgcaacaaagtcaagtgattcaatttaccaggcaaggacaagaaatggtttcaggaaaaaccaaggtgatgaactattgagcatccagttcattagctgtcatccatcttgacatcttcatctttcaagcagtactgcagaaaatcaaagacgtgtagtgcttcccttaaaaaatctgagaaggaaaacatatcctcttaaagttaaagagactgtgaagcctatttcaaatggattatgaaagataaccattgcctcaagtctgaaaatcttgatagatactccattgtaaatactacctgtgcccttaaacacactaatcttaaaaataatatcattaaaatatgtactgcatgaactgctagagtatttttagcttattctaatttgatgcattgtgcattttaatatgcagtaatagttacatgacaaataactgaccttttagaaatagcatcttgggggaaaaaaaagactcaagaaaaaaagtgtttccctgaaacatcagccaataaaacatgggcagtaagactccagtgacatagccaagtactggtaatatcaccttccttcttttgtttctctgctctgcttattcaacactgaggtactgaaactctggggtttttgcacttatatgcagagtttcctggaattaaagagtaatgtaagcaaccaaagacattaaagaagtgattcataaccttccccacctactattctttatcaaggggaaagtgttttatttcaagttcttgaaggcccctagaggtaaaggtgaggtgaaaattatgcttttcttctatatcccacatactactttattaatgctaagaagcactgtaatgttgccttttaattctctgctttctgaaacactcagtgaatattattccagatctgtagttactaacaaacaaaataaaattaaagactcatacattgttctctcctgaatttgccatttaaaacatctaagtcaggctgtgaaagaaaatgttaactcacggctcacatcatataagcaactagaccacaaaacctaaaagattaccatggactctcagaagcctttgtagtcttaaattattggaggacaactaaggaactattcaggtgtacgctttgcccatcggggaaagccctaggtgcaggtgactgaatggctgcttctgaagaacggcatttggtatctgagtaagttcctatacctacaaattacttgcaagcccttcagcctgaaatttcccaatatattattaaaactcttattatctccacactacttgctgctaccaccactaccaccatacactgcatgatttttggccgggaactataccaggcactttacataaggcacacatgtaacacccgcatcaactgtagaaagtaggggcattattatattcagttgatagaaaacagaggcaggtaagatgttctaggcttctgctaagcaaaacatggtccatggaatagcagctacaacatcacctgagagcttgtctgaaatgcagaatctcaggctcaagtccctgatctaatgaattaggatctggattttaataagatatccaagtgatttatatgcacatgaatattgagaagcagtgctttgggtaaatggaatcactcagactcaaactcaggggtctctagctcaaagatccagatattaaaatagtcagctcttcctgaagatgcaagacatctaaagaatgtaaaacattgaatacattcacatttaggaccaagtttttcatcagctgagaaaatctgatactgagaattacaaatttgagacgagaaaacgatgacctgggaataacagaggaaggagatacctggtaagggaatagaagagagccactgggaaaagaaattgggcttaaaacacactttgtgcattttggtttgtccatttcagtttggttaagggagttcttagccaaactgaacagagttttgactctgttcccaaaactctcggctcacctgaagtggtgcttgatatcagacaaccttactggggagctcaagagtgcttaattgaattattcacaagatcactttctcatgaaccaaccactccatatccagacatccctttgctgaatgtacatacttattcttcaagttcttacatcaatcagcccaatatggagctttctagagatactaactgcttaactaagtctgataaatgaaaacatctgtatgggtgaaatttttttaatgcaattttagttgttttttcaccaccatatataataaatcaaactatattaatccatcaggtatccatctgggatcagttttgatggtattcaagcctgataggtaattaaaatgttatttccatgcaaattgcatctgatcttgaaaacagtttcccttaacctgaaattggctaaacatttctctgcagtcttaaattatccaaatttccaagcaaatatttttgtttccataatagaaagggaaactgcaggtcattcatgaatcaagttatcataattaattaggtttagctctattacctttttatttaaaagctaactggatactactatttatccttccttttgtattacagtatttcataactgactttcatagtatccactctaaaatttgttaacactttgatgatacagtattttcatcttttattggaaaagaatttattgctactttcaagcatagtttttttctcattcattatattgttatcataaccacgtggcttataaagatatgcagacactaatgttatatcaatacttatgtctttggacttttcatttaaaagttaattgttgactatgtatttttttattgtgcaaactttcccaaattccacaccatagcatgacttgctaatgaatatatttacaccaagaaaataaaatgaactttgtataagtttctaatataaataaaagggaatacttactttcgaaagaaagataatttcctatcaatttaataattttctttcattttaacggtagaaattatacaccaatttcatgtcacaaaagaggttagagcttgtttttataaacaatgtttgttagattactcttgcccctatcagaggaagatctgaaaatgtaacaaagaagatatatttcatttttgtgcaaatagacatgtatataaagattaaaggctctgacagagcctaaaaatgaagtcctttatttaatgtactagaataatgcatgcattggcagtatgccagctttaaaattgacatagaatgagccttaacttctcctgcatgattcactatcaggaccagaaagccattcagcaatgcttgtcatgtcttgctatataacaaaataacccccaaattttgtggcttataataacaacaaccatcttatcatctgctataaatgtgtgggtcaagaattcaggaagggcctgcctgagaaattatctgtgccatatggcattaacagaagtcacttggaggtattctgctggtggtttggctcctccagagagctcaagtcagctttacctacatttctgcagtcttggtggtaatggctagaagaatgggctcagcaggacaattgaccatagcacctatgctagcccctctgatatggtggcctcagagagtggggtatcttttcatagagtcttggatagaaggtataagtcttctgacttagcatcacaagtcccagaatgtcacttccactgcatttactgactaaatgtaacatagatcccaagacagaaaatgaacatgcattaggtaaaaataaaagaaatctgaatgaagtctggcctgtattttatttttatttattggattattatttttttttttttgagatggactctcgctctatcacccagactggagtgcagtggtgcaatctccgctcactgcaagctccgcctcccggattcaccccatcctcctgactcagcctcctgagtagctgagactacaggcgcccccaccaagcctggctatttttttttaaatatatttttagtggagatggggtttcaccgtgatagccaggatggtctcgatctcctgacctcgttatctgcccgcctcggcctcctaaaatgctgggattacaggcgtgagccaccgtgaccggccccagcctttattttcaaacaaatgttgttgagaggaataaatatgacagtgtggaataaaacagaagctcacacacctacattggcagaaaaagttagatatgatcaataaattgttaaaccatttaacgtttttgccagagaaagaacacaataatttgaagaaaaaatttaaatatggtttctctgcctacaataaaatggaatagagaagagaatactcactaaagagaacaaaggtcaaatagcaagagaaaaatacaaaggcacagccagctgtagatccaggaggacaacaggatggtcctgagcagaaggataccagaaagggatgtttaagaggcaataggatactgcaaaccagatgagtctttatagtttctttagctgaccctgaaagcaagtgatttctaagttacaaactgctgaagagaagaggaactcccacccaaaactatatagtaagaagaaaaagacttgctaaataccatttaacttctgaaacaggaaagaatcactacatatttgtgataggcagactaatgcctgccaccaaagatgttcatgtctttctcccttgaacgtgtgaatgtattatgttgcataggagaattaaggttggagatgggattaagatggctgatcagctggatttaaaataagaagattaccctggattatctcagaaggcccaatatgatcacaaagctcctttaatgaggaagagggaggcagaagagccagaccagagagcaggcataatcagaaagactccattggtcattgctggctttgaagatagaaggtgtccataagccaatgaatgcaagcagcttctagaagctgaaaaggacaagaaaacagattctccctagagccttcagaaaagaatgcagtcctgctgacaccttgattttcatccagagagacccatttcaaacctctaaactccggaactgtaagacaatacgcctgtgttcttttaagacactaaatttgtggtaattttttacagcagcaatagggaactaatacaattgtgaaaaatgaggggaattggaaggaaaaaaattaaagcatttaatttgcaaacaattgttcaaacatgataaaaatgataatgagacttacaaaatatcttacaaatgaaagaagataactttcctgaaagaagataactatccataacacataatgattgacataatcctgtgagggtcatgacaaatatgctctatgaagtgttgggatttcagcttcctgtttcatttcatgtcagttttggcagatctggacttcagtaactagcagtgtgcctagtacatggtagaagctcaataaggactaaatccattatataaactaaaggggactataaagtagaaaaaaaaactcattatcacatatggcttgtgagattaggcacatagcaaaggaaggaagagagaagagagctaaaattatttggaataaaaaaagaaatccaattgagatccaagtgaaatgcaaatacatttctagtgagacatttttaaccattgacgaagcttcttagtttcagttgggtcttcatagcatcctgcaaaaatgcatggcaaagatacagctgaacacccaccagctgaagctgggctgtgattgttctggcaaacacataacccagagtaaatattgtcttgcacgaagaagtgaggaggtggattaggcattgtaattaccatttgctgggtatttggcattctttttaaagatttaatcatttagatgagacttagtatcactaaaaaaggagtcaatatttctgtgagccagggaggaacagcgctgctgttttccttctgctcagctgttacatgtgcctacagaaagacaacttcacctgctacttttttattcaagacagcacagataaagaatcatgagcagtaacttctttcagttcttttttcttcctgaacacactgtgttctcatctattattgatcagaaagtgatatttaaatagggtggcaatttataaaattgcacagggatgttattacattatcttaattaattttacaaccagcactcactcactgtcctttatagtacatctaaagaattaatgtgctgattaacaatagccaagcagactcagatagtagctttcagataagaacttctgttaatcttctgcttgtcaattggaatctactgacataaattgctttaatctgagttcctggcattaagcatttatagaacaacattttgagacactgattattgtaccattcctttggggcagtgcccctaaattttagtgtacaaaagagcatctggaatttgttaaaatccaaattatttagccctttcagagagatcctaattctttaggtctaatgtgggtccaagaatctgtatttttaacaagcattctgaaagtgtctgagccatggggtgaggggtatgtaaccaaacttgttttgcaatcgtatataaatatggacaatatttttgctgaaacttttcttcttttctttaaatgtccaagtccttatgtacatgatctcttttagtcctcacaatgatcttgtgaagtaggtattattatttctattgtaacaaagagacaaagggtttagtcacttgctgtctgtttgctcaggctgccataataaaacactatagattgagtggctaaagaacagcagtgtattctctaacagttttggaggcttgaagtccaacatcaggatgccaccatggtcaggttctggggagagctctctttctggtttgcaaatggctgccttcttgctgtgtgctcacatggcatttcctctgcacatgcatggagagatagagaaaatgatctctcttactcttcttcttataaagccaccaataccattggattaggacttcactcttatactgtcatttaaccttaataagctcctaaaagctctatctccaaatagtcacattggaggttagggctccaacatatgaacttatttgtgagagagggcggaatttagtccttagcccttgcctatcacaaatagtaagtgggatccaggatttgcaccctaattgccctgactccaagcccacaccatctctaccttaccttgcccctcttgccctctgggccattagcaagaagtagtgatgggctactcagcaacagaggcatggaggttggttagatgaatattcagtcttccattaactgagaattgactttaatgtaatcagatcacttcattaaactttaagggctgccttatatctggtgactatgactattttattcctgcaactttattactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaataatctatcctctcctcactgatttttaatgccatcccattaatttgatgttttatatggtcagtttctgagatctctattctgttttgtaataaaggtacaaaaataataactagatatcttataggcatgttatggctattattgctactttgatttttttgaatgtaatatttttctttgcttctgtattacaaaaatattcttaaatgattcttatatacaacaaaattattacttctaaaatctgtcagtaagtgctcttggattttctatgtacatactcatgcaaccattttgttctttattttccattccctacatacttttcttaactttattgcataggctaggacctagctacaataaatattaactgactgcatgcatccttgtggaagaaagcagcatttttactactaatttaatgctttaaattataatattagtatatttagatgttctcttcctatgttgatattgaaaatttatatttagaaaatcgttcagttagtctaagatttcaggttatttagcataacatgttcaaattcttctctcagaatttaaaaatcttcactagatctgaaatgatatctttttttatttctcatattgcctgtatgtgttaatgtgtgctttttaaattgatcgattttgccatgggcttgtctattttaacatccttttcaaaaatccatcctttgtattttgttagtaatttctccattctttctgtttgctattgtattactttgtgcttcttcttgtatgcttttccccttcccactttcattagaggttctctgctattcctcctctaactgcttgggttgaaccttcttttatttagttccaaatgatctatttcctgatatgtacattcatttttggaaacttcaattgaagtgatcgctgtatgccacaagtttttatatatactatgttcactgatttagttacaaatattgtttgatagctatttaacttgcttcattaactcatgaattatttagaagtccatttttaaatttccagctatatggggaagttggggctattttttatagttggtgccacattttattaaacttatttcatggaattttgtgcttcttcttttgcagtcatctagagtaataataccaactaacatttttcaagtatttaccatgtgttaggcactattctaaacagttaatatgttttaacttgttaaagctcacaaacgcacaaggtactatgatgatcagtaatttacgaatgaagcatctgagccatagcaagataaagtaacttaaccaagtaacacagctggcaagcggcagtgctaagacaagcttagtcaaacccatagtctgctcctataaccaccacaaaaaaacctacctctgaatttagtgtgctcgagaaaatggatatttgcgttttcagagcatgcagtcatacacgcatctgtcatatcagcttcagtgagttattgaagtcttctatattttttctaaatattttcatctaatttattaatttctgaggtaaggtgttaacatctcctatttggatagattcatcttattttgttaatgttttgctttgtacattcattttagttcataatgcatatttgatatctttattaatatttctctttatctttactaatggttaactataaattctattttgtctgatattaatttactataccactgttttttctttttgttctaatttacctggtatatcatttttcatttttaattattatatatataaacatatacaaatatatacttggttaacttactttatcttgctatgtgtggctttttttttttttttttgtagagacaaagtcttgttatgttttccaggctgttcttgaacacctggcctcaagcaatcctcctgcctcagcctcccaaagtgttgggattacaggtatgatccactatgcccaggacatcagtacctttaaagattaccttcccatttcattcctatccatttcacagtttcactgtgatgtttctaagtgggcctggttgttccttcagtctgggaattcacttctctactacatacagttacctacttggctattgcctctccttcattatttctatactcttattctggaattcctgctttagattttttttattctatcctcgacagctctatttccatatttctaggtctacgtattccatcatgggtgatttctttataattaacttcaaactcactaattacttaattagctgtctggtccattgtttgtccaatctattgataattttatttctagaaatttcattttagttcttcataactgcctacgaacctttaagtctatacttatatacatatatacctatgtatacatacctatatatatatgcctatatagctttaagtctataccttttaagatatcaaatttattttttaatgtctcagattattctatatttctagacttgattatttgctgattctacttcagactgattcattttctgatattgcaattttttttactatgagctgttgtgtttttattttgttttggcagttgttttgcatgaaaccatccctacaagaaatcatttctatagtacaatcagtggtctcttctgctgggaccccatatatggtagcagttacaggccaagttttgcattattttctctgtttgggattcctacacactattgtgagcatagtgtaaattcagagcctactctggtacagggcacagatgtggtcttgccaacccatagccctggacaaataaccagttttctttcagcttcctaaggctgtggagactttttagtactgtgtttgtgagctaagcagaatcctagctctgagatttgttcaaggagcttggctccaattccaaacccagcttcagcatccagtattgatttcccatgtcaacttttgatacttcctgagctctcttcactgagtttcttctttgtttataaaacttggtgatttatcttagttttagcctttcttggtattggaatttttaatatcatgctttttccagtgtttacataattttggcatggaacaaagaacctttgatgtcacatcagttcttcatatcacttttggtgtttccaaagatcatccttaggctttattcttctaatcaagaaagaacttttattttggtaacagctttatagagatatacttcacatgtcacacaattcacgcatttaaaatgaacaattcaatggcttttaatatatacatagcacagctcatctatcaacataaccaattttagaacgtttttattacccaaaaagaagccctattccccttacataccactcttcaatcatcctgttcccgtcccttcaccatccaaccctaggcgatcactaatttacttttcctctttatagatgcacccattctggatattccatataaatggactcataacaggtggtcctttgtgacttgtttgctttcacttagcatcatgctttcaaggtttatcaatggtgtaacatctatgagtaatttatttttattgccaaataatattccattgtatgggtatgccacattttatttgcctgttcattaattgatggatattcgacttgtttccactttttggctaatataaatgatgctgtcatgaatattcatatacaaatttttgtgtgtatgtgtggtttcaattctcttaggtacacagctaagagtagaaccggtggaatatatggtaactttacttaactgtttgagaaattgccagactgtttttcaaagtggctatagcatcttccattcctgccagcaacgtaggacatttccaatttttccacatccttgccaaaactcgttatctgtcttttttataacagccatcctggtgggtgtgaagtggtatctaattatggttttgattttcagttccctggtgactaatggtgttgagcatcttttcaggtccttattggccatttctatacttttctttggagaaatgtctgttcaaatcctttatccatttttaattgggttgtcttttattgagttgtaatagttctttatattttagctacaactgccttatcagatatgtaatttgcaaatatcttctcttattctgtgagttgttctttcactttcttggtggtttcctttgaagtatgaaagtttttaatttcaatgtcccatttatctattttttccttttatttcttatgctttttggtggcatgtctaagaaaccattgcttaatccaacatcacaaagatttatactttttttcctaagagctttatggctccagatcttacattcaagtcttgaatatactttgactcaatttttttttttttttttttttttttttttgagacggagtcttgctctgtcacccaggttggagtgctgtggtgcaatctcggctcacagcaacctccgcctccccgattcaagcaattctcctgcctcagcctcctgagtagctgggattacaggtgcatgccaccatgcctggctaatttttgtatttttagtagagatggggtttcaccatgttggtcaggctggtctcaaactactgacctcatgatccacccacctcggcctcccaaagtgctgggattacaggtgtgagctaccgcgccctgccttgactcaatttttatatggtttgaacacagtggtaatttttaaagtggttatcacctgtaacagtcttctctaaactaaagatctgacaagaaaatgacatgatttggggcgtattatgcataattggtatcacagcaatattaggggatatgagacatcagccttcctgatacttcgatctctttaaaaagcatggaattataaaatcttagttcaaagtcattggtctcttacatatttccaggtgtgtgttttcctatggttaacagaactaaaaggagacattattgtggcaattttgatataaggaggtagtgctgtcccactaagaactaaacaggtcagcgagttctcaccaatctgagtcactagtatgaagggctctgaggaaataaaaaactcatttacataggctaatttcttacactgccccgatgcagccttgttccaaacattcgctgttgtgatttacaagaaaagaaaaaaagtagtaaattgggcactttcttacccaaaccactgtaggtttatttgacatttagttgtattgactggagacttttataaatttctggaaattgatgtcaatattttcaagtaatgaatcaccagcaaagaagaaaaagcagaggtgctttataacatggtaaatcccagtaagtaattcttgtctgcatttctttctatattgcagtatcaaaaaaatgagacattaaaggaggaagagagaaaacgatcctatcaaaacggtcagttggaacaaaaaataacaataatgccaacagagaaatgagaggagtgaaaaaagcagaggaaagccagagaagaacagaaatgagaggacagaggtgaaaggaggagacaagacaagaaacccaggaaaagatgttgtcatctacctgctttaaaaagtgtgcagtgtttgaaccagggccaaggtcttaagtgggattcaagcaaagtaataaatccataatgaatctaaaagtatttataaagtacctcaatattagtaacagcttacagcagaaaaaaatatatgatcaggacctaaggatactttctatcataaaatgttaatcagagaaaaaatgaagtgtgaaaataaaggtgtgaactctagcagagagcatggtaagacatagagcttggctggtaccctctgggcccccagctctcaggctggtgggtgagctgagtgctctcaggcacagggccaggcttagaccctgatggcagcaatccccatcctgcctgtgacctctccaagccagacccactgggccacagctgggcccccaccatgcccagagtaaacaacactactgtgtgaagggcatggaaggctgggaagaacacggcaaccccaacccaacaggggcatcaggagttgaaagagtgggccagtgtggactcgagctctagctgctcagcctcaggctaaggagctgtgcagatcacagatctgaggtgaccactgtgtccctagtgaacaagatgccactctgtactgtcccttaaggggcctagaaaatgagctgagactacaaaagttggttaatcaacaccagaccttgatgttggaagagagaaatggtagaacactgtgccacacttggccaacaggatgtgtctgccatcctttgggaagattaagtagacattaatagaagaccagtgtatatacacataactcagagatagtgcacgttttgttctagactaccacaataaagtgagacacatgaaatttttggtttcccagtatgcatacaagttacgtttacactgtattatattagtctgtgatagcattatatcagaaaaacaatgtgcatacctgaatttaaaaatactttattgctaaaaatgctttcagcatgagcttcagcaagtcactttctgctggtggaggttcttgcctccatgttgatggaagctgaatcatctgggtggtagttgctgaaggttggggtggctatggcaatttattaaaataagacaacaaagtttgctgcattgattgactcttcctttcacataagatttctctgtagtatgcaatgctatttgatagcattttacctacagaaaaacttttcaaaattggaattcaatcctctcaaatcttgccactgctttatcaactaagtttgtaggaaattataagtctttgttgacatctcaacaatgttcatagcatcttcatgggaaatagattccatgtcaataaaccattttctttgctcatccataagaagcagctcctcatctgttcaagtttgataattatattgcaacaatccagtcacatcttcagactccacttctaattctagttctcttgctatttctaccacatctgcagttacttcttcccctgaaatcttgaacccctcaaagacatttataagagatgaaatcaatttcttttaagactattttgccctcctcccatgatatattgacttatttccatgaatcatgattgttcttaatggcatctagaattatgaattttttctagaatgttttcaatgtacttttcccagatccatcagagaagtcactatgtatgggagctatagccttatgaaatatacttttgtaataatcagatttgaaagtcaaaatcactccttgatccatgggttgcagaatggatactgtgttagcagatacaaaaacagcattaatcactttgtacacttccatcagagctcttgagtgaccaggtacattgtcaatgagcagtcatactttgaaagaaacctttttttctgggcagtaggtttcaatagtgggcttaaagtgtttagtaaacaacactgtaagcagatgtgctgtcatctggctttgttattccatttatagagcacaggcagaggagatttagcataattcttaagggccctatgattttcagaatggtcaatgagcatacgctttcacttaaagtcacaagccgcattagcccctaacaagaagatcagcttgtcctttgaagctctgaagccaggtattgacttttcctcatagattaaaaaaaaaaaaaaaaaaaaaaaaaaaagtcctagatggaatcttcttctacattgaaaatctaatgtttagtgtatccaccttgatcaatgctcctggctaggtcttctggaaaacttgctgaagtttgtacatcagcacttgctgcttcaccttgtgcttttctgttatgtagatgacttctttacttaaacctcacgaagtaacttctgctagttattttcttcggcagcttcctcacctcgatcagccctcaagaaactggagggaattagggtctttctctttattaggctttggcttaagggaacattgtggctcgtttgatcttctatgcagaccactcagacttcctccatatcagcagtaagcatggttcgcttgcttatcatttgcctgttccttggagtagcacttttaattttcaagaattttccctttgcatctacagcttggctctctgtttggcgcaagaggcctacctttcagcctacatcagctttccatgtgccttcctcattaagcttcatcttttctggttttttatttaaagtgagagatatatgattcttcctttcacttgaacatttagaggtcattgtagggttattaattggccaaattccaatattattgtggctcagggactaggaaagcctgaaaaaagggaaagcaatgggggaacagcaggttgctgaagcagtcagaacacacacaaaatttctcaaccagagatagggttcgtagtgcccccaaacaattacaacagtaacatcaaagactcctgaaaacagatcactgtaacagattttacagtaaagaagtttgaagtattgtgagaattaacaaaatgtgaaatcaaaacactgagtgagcacatgccattagaaaattggcactgatagacttgcttgatgtagggttgccacagctcttcaatttgtaaaaaatgcaaaaactgcaaagtacaataaaacaaggcatgcctgtagcatatgaaagagctgcactcaagtttccccccattttttgagaggaaaacttattttgctatatcttggccttctgtatgtaaagaagttctaaggtatgttagaaaatcccacatcttgtaaatgtcttatttaaaaagaggaagaaagaagaaatcataggaaagaaatgtcttctgaaaatgacttttggatatggaattgtgagaccatctctagaagtgacaccaagagacacacaagtccatgttcactcactgggttttagaggagatggaaaagtccacaaaaatgaatagaatcgttctctataagcctatgccaagctggtcacattttgaagatattttcttattatactcattgttctgtgtatgcattttattcctaataagtgtacaaatagttaacaatgttaagtacttttctgaaatactgagtctttatagacgttccggagtgccttatacatgtttaaggtagtaataaaagagcacattttatgaataaccttgataaaattcatacgacatttgtcttttggaaatgaaataatcaaatcacctttctgagcagtatacattgtatgtgtgcactggttcagggaacaaggcagaagaaagaagaggaaaaggctccatgccagtcattttatagtaagccaagattagccatcttatcctgaatgttctgtgcattttattttactttgttctctatgtggtatacataatgaacaaatgagtcaattttacaacatcttgtctttctagttgttaaagagcctgccaatatatgaccaaagtagagtttgtaaactattttgtacattttgcgttatatggtaaagactgtcttctgaaaacaacttgagaatatgaaattaaatccatctctaagaattatagatacttgtacacatagtaaatactagaactgttaaattaaaagcaaagtgttcagtaaaagagacaactttgtggttgatcataaactaaaatacttttaatatatatgattcataagatgtcttacgtttgccggttctaaacatcctttatattttatcatttgcatgaagaatgtgcagatattgccagcccacacccagggaccctcacagagtaaacttgtgtatgtctataagtgatctgggtgtttggcttgtgtcttggcatgaaagctactcctgctcttgatctttgcatgtgcataggatggaaggaagggaagggactctgctgttctcaggagaacttcaactctatgtctttatttttgaggatgagcaaactcttcaaagggctgttctgccctatctcttattttctgctttcctaacctttccccatttcctcttcattctgaagtgctaagaacgtttgagaagctggaggacacatgcttagaaccatagggaaaaagccattcacattccattgtgtcatcagcccagacctctttgtcttacccagaggccacttcccaccaccaaaaggaatattaggagtattaattctttccgctactaagacgttgtttagggtaccctaaatagcagtcatcgaaataaatgaagcctctattttaaagttaaagggacactagcactttaagctgtttggtacagtgtttttaaagtatggaaaataacactcaccttcttttgagaccatgttaacatttttgaaactgtgcattattcttttcagtagataatacatttaaggtcagaactatgctagaatatccagattccctgcagttggtgttctgccactgaaacctcaaaaccagatactctcagcagtgtactgcatatattacacaggtgcatcaaagatttatcactcctcttggtccacctccgggcagcatttcatcatcgaagaaaataaactcatttgagccgctctttaatttttaaaatgaaaatctatatccatcaggcatatgtcatagtttcagagtaagaaaaagaagataacttttgtgaaatgtctttttttcctataaacacaattacaaagcactcaacttataaataacatttattttatattaataaaaagaatttagcaaattcccagtattatgctaggtgttcatactctctactccagtttaaaacacacacctgcgcatacatacacacacatacagttttaaagatgcatttttcctcttctggaatgtgttactattgcttcacctttgataactttcattggggagcacttttcaacttaacttgtgtctgcacagtacattcaatgtggctttctgatgaaattgacaggtcaattcaaaaacaaccatattcattgcaatttttttctattccgaacatgaccaaatccaccaagcatattagtttcccttaaaactaaagaactttttaaaatttaggcttgagagaagcgaaacttattttaataactgaaggaaaaaacggttgatgcttataaactgtgtatcagattttggcctacgtgttccatatctatattatctaatttaactctcacacacccttaagatagtaggtactaatattaattcctgcctgtgtaacctaccattcagagagtaaaataacttccctaaagttacctgaacccaggaaatctagctccaaaatcaaatgaccaatccctatcctatacaacctctcaagaatgagcacatgtagaggagaataagcagaaaatatcattagttcaaattaactggatgtaattgagggtgaataagccaaaaatgtgaatctctaagtacctggctttaccttttctagagttttctttgtcttgagccatattctatgttcaggctctcaacatggcaacctattgggctgagacagatagaaaatgcatccatgatctcaaaaagtaattggcctcacctatcccgaatgcataaaaagtctgctaattatgacagaattatgtggacattcaattgttttttaaattttatattctaagtcaatattttgtaaatattttagaattagtaagtagtgttattcttaatgggttacccctgccatgaatattaggaaaaatatatataaatgtaaaatttgcctgcatacatttttgtttctgaagaagtgttagtcactttcattctttaaatatcatttgtgttgtcaaattcccatgttttttagctttgccctctttcctgagtttcttctctaactgcctgatggaattcttcacctggatacccatcatgctttcagaatcaacattcctgcagcctctaaatcattttggattaaatgcattctcaatgattataaaggaggtgcatgactggggtaaaataaaactttttaaataataaattttctgacacaagttcagatgtgacttatataagtcattgaatcctaatttcagtcatcaaatatggaattcatccagtctactagcttcattttacaaacgaagaggctcagatcctgacagaaactgtgacttgttccagatcatcatgaatttgtacctggactgcaactagaatctttaatcctgatttttttaaataataatgatggctgttatttttccactgggcataccatgactcagatgccatactgacattttactttcattatctcatttaatcctcaacacgaccctgtaagtaagcatttttattcccatattacaattgaggaaagggaagctatgggaggtgaacctattcattaaggttcacaaagctagaagagtcagaatcccaaaccatgtctgtctcactccaaattcccttgcttcagtaagcttctctaggccaatgttccttctgcattgcccattttcttcctatgaatgcaaattacataaacatggaagtacatttgaccattttaattgtttaacagtccatgttgcaggaccttccacaatagaatcaatgtattaaaatgtgtaaatgaccacactttttacacaaatgctatgaatccttaaggttttccaatttataaaatatgtctgcaaagcatactttatgatgctttgtattctgtcagtaattggatgtcatatatttaaattctattaaactgcttattaaaatgtccagtgcctcttttcttgcatggccacaaatattgtcactataaatcagcacctttcaaagttagtttcatgacaactcaagatacttcaaactaatttagaaagtctcaaaataattcaaaaataattcatttagttaacatattttgtaaatatacatattctatatattaacttgaatgtggaataagtcaaggaagagatatcaaatgtctttaaaaggtattacaactgtaagtaatcaaagaaggaaaaaaaaaaacaaacagaataaactgttaaagggccagaatactaggaagaacttaaataggtagtaagcaatacatacttcctcacctatataatatcaaagagtttgggatacccacagaagggactgtgaaaacctcttagaccatcctccgcattggtgtctccttaaatcaatgggataaatactgaaaatcttgtccaatagcaatccaatttaagaagtcaccataggtatgaatagcaaacaattatatgttccccatcatggctaaatgtatcttgtgagccatctacaaaatcaattattcagcaattcagttcatttcattgagacaatattaataaaaggatcaaaagaactatcgtctaattatgtcatacacaataaatcaccaactatttatcaaaaactgttctttccattctacctctgtggttattgccttaggtcagacaccatcacttctcacctgaattaatgtattaagtttttaatgggtctccctatctccaatctcaccaatcccagattaccctttaatgatttcacattaccttgaaaataactaggcacttatttttgtgctctggtacaaaaatgcctttgtctgttgccacacaggccattatctcatggaaaacctgttttccagctgtgtcgaattcagtagtattcatagacccaacacaatctcttcttgtctttaatgtgacgtttatcctgaaaagagtgcttttctctcacactccctgtatatctggttggcttatccttgaatatcctactcaaactttaccttccccaagcacagctttccatgatctcctcaatgctgagctgcccttctctgtgctccttttgcaacagctgccaagccatttcttacatggcatttactgtctcctctcccagaacaatttcttgaggctagaaaccatgtcttaattatcttgtggcctagtatctgaatgtctgcaatatggaaaaaacgctccattggtgtttgttgaaaggatgaataaataaacatttcctaaaattgcctgatactaagaatcgctcaggtgctaattaaaaattcagatccccaagctaagatttatattgaccagtatgaattgaggcagaagattctgtacatttatcaagtatcccaaatgattttcataatgaggaaactgagagaatttaatcataacggataggaaaatctgtctttgcatgaaatttctctgtcctctgtctacgggttacttgtttttgaggtatccatgaggatactcctccccctttatctgatacctaactgtgctgtgcaagaaaaacaaaacagtttttcgtcatataagggcatgaggctaatctatccttagctcagaatataaactcagcaagggacttagatatgatttcaacattgtttgtattctttcagctagcgttttcaatgtggcctaaaaatgtcatgactcagagtacttattcgtagaattgcttcaaaattttatctaaaccactaaaatttcacacctggcattgaaactacctagtttgcctgcaagaactccacttacttgggaaatatacagtacttgctgagactaacttactgtgtaatgctttatcctataactctaggaatacaaactctttaaaaaaaaaaaaggctgttccatgttgcctctattcagcataccttactcctaatttcctgcaatattcttttcacctctactactcagggcaaactttttttctcaaagtcacaaagaagctctgaattaccaaatctaacaaatttttttcccatacccattggcttctaactaacagtatgagacaagcctttcttcaatgcccattccttgttggattcctggccttcctctttctctctctgcaactttttggtctccttcataaacgtattcttttgttttgcctgcttctaaatatgtttgttctattttggaatctaaacttgttggcctagcagtaaagttcttcaaagtttgccaatctgtttggatcttatcacactaaacacctctccatgtatcctacggtttgagctggcactcgtcagatgtggttttaaaatgtatactaattaaaattaaatagaataaaaaattcaactcctcagtcacactatccacatgtcaagtgttcaacagccactagtggctaccatattggacagaacgttcatacaacattgccttcatggacataagttctattggacagtgctagtctagacaactggactactcaaatttctcatctctacactttagctcattctattctctgtctacctgaaatgcggtccaccaaccatatctcttcctattcagatatgacttgttcttcaagatttattcttaatatttacctgtctccaaagtctttacttatcactctagctgaaagtatggcagcccacctatgaactctcaaagttgtttatactactgctcttccccatgttgttttgttctgtcattattggtgcaaatgcctgctttccttgatcagagatataatctttgaagagttgattgatagttgccaactgtcattgagcactttgaacatgagaagttaagtgcttgatcatacttctcacatcctcataactcccctgtgaaatatatgatgttttttcatattcacgttaaagaaactgggatttacaatgatgaaacattggacaaattaaggtctcaggacaggaggtcacggagtgatgagccctgaattactctaggtgggtttaactccaaagcccatgcccttacccaggggaacacactgcttcttgagatctcattcaccatgttaatgaccaccccacagccccaccacctaacgctaggcatgctccatttgtgaatgagtgaatagatgactaatactttatatgcttatggtcatttacaattcacaaaacttgttgacagccatacttgatttccatatgatttccccaacatctctgaggcagctccataggaaatgttatctccatttcacagaggctgagagagttcagagtcctccagaagctcacattgctatttagtaacaggcatagacaggacttcagcctgtgtgttctgccttcaagttctgccagcctttcttcaaaaccttctgtgagtttaaaactcatcaacaatcagcaaaggcttaaagagttgttgtatcttaatatatcgtcgtcttcttcttttttttttttttttttgagacagagtcttgctctgtcgcacaggctggagtgcagtggcaccgtctcagctcactgcaacctccacttcccgggttcaagcgattctccagcctcagcctcccaaatagctgggattatgggcacccgccatcatgcctggctaatttatttgtgcttttagcagagatgggatagggtttcaccatgttggtcaggctgttcccgaactcctgacctcaaattatccacccattttggcctcccaaagtgctgggattacaggcatgagccactgcacccagccttgagatactgtcttctaaaacttgccctttttattgtttaaaaaacatgatgaggccgggcacggtggctcacgcctgtaatcccagcactttgggaggtggaggcaggtcgatcacctgaggtcaggagttcgagaccagcctgcccaatatggggaaaccccgtctctactaaaaatacaaaaattagccaggcacagtggcgggcccctgtaatctcagctactcgggaggctgaggcaggagaattgcttgaactcagaaggtggaggttgcagtgagccaagacggcgccattgcactccagcctgggccacagagtagtgagactctgtcttggggtggggtcgggggagggggcagggaggaagaaaaaaaaaaaacatgatgaggcttaatggtttatgtctaagggaggggaagaggcaatttattcaagttttcagtgcttttaaatagccacatatttcaatctttatcatattgtttttgccctaaccctattaggataacttgcttacattaagcaaaattctgagaatgttaattagcaatttagctatgaatatgcatgattatttttaagtccactaatattatgcataggtcttatctgtaattatatctaaatgttctcttttttctctccctctctctttctccttcaggaaagccatttaaaacacatttgggaaatgtttgaaaaaattaattctattacccttatttccagaattttcttaaatattttatggctatattttttccttctcaaggcaaagccgtacatcaccacatacattatcatatttgtttacaaaatatgagagtcaaggaattaattttacaccagttaaataacagaagaaaaagttatactgtattttcttctttattatactaattttttcacatccttaaatggttttatattttgtggctatctgaaattatatttaagggcgagtattatactaccatttgtttcacatccaacttggagcattgcatatttgtgtagacatataaggttagtcaggggtgagagataggaggattaaactcatctagtttgcgtgccctttctcagtcacaatgcagtctttacaaacaattttttcctttaacagaaaaactgaaaaggtgtctaaaaaaataatttgccttaagacaacctttctaggaaatggtgaagatctgtttcaaacccaggcctgcctcatgccaaagcctatgaccttttcactattaatgaccaaatggttgaatgactgttaaataagtctcttgggtaaaacataaacgtgcctgatacccattcattaaaatgtttattagatgaataaataaattggtggatggagctcaatataatcagctcatgtgcctccacaccaaaagagaacattttcaaatgaacatgcaggaggaatacatgattacaaaaatgcttcagcaatgatttcgcttttataggattacttgtcccaagttcaacagtcttaatgcacatgcaatttgcttgaagtctataatgcccttggatttcaagctgaggagtctgatcatctggaaactaaaaattaaggatctgaaatattgttaactaaatagattgaactaaaattagcctcttaggacttaaagtgcttccacataaagtccaagagctagaaatgagaatgatgttctctacaatcaaatattgccttaattccaaatttagcttctgccacttgatctaatgttacatcaaggcatatgggccctctgcatgtgaagagcttacaccaatttaaagcaaatgcatcacatgggcaagaatgcaaattccaatagtaataatgtttctttcactatttatttcattccttatttttcatacttgttgccactttgtgaacttgcctccaatcactttacactggcttattttaaaagccttttaactgttctccttactgtcacccttttttcctaattccactgttcctacaaatggttgctagaaaaatcttccccaaacacagcttttatcacaggctcaaaaacctatcacaattctctaatgcctggtctataagactcttaaagtctttcccccttctcaccagcctagtctttccctgaggcagattccctattaagaagaaacaatattttgctatgccctgtattttcttatctgtgccttttggcatgctagtgctagtgatcctaatgtagagctttcaaacatgctttgaaaattatctttgatatattttcatatggcctctgtattagtcagggtcccagaaaaaaaaatagaattcatcccagagtgttcaaataaagagattttaataaaggagttatttgcataaattgtagacagacttaaggagcaaacaagatggcagggcacccaaaggatagcaatggtgagaatataatactacccttagggataaacagtcaaggaaaaggagcagtgtttccttaggagccctgcatcagaagaggtacagaggagaacagggtgaagggagttatatcctgaaaggacatgatcacggccagcgcacaggaccgaagtaggacatgaagaagaaatatcctgacctctttctcttcctgccctccaatatcctgctagagccttccataggccccacccaagataaacacagagagcagagagtcccagtcatgcaaatgacaagggtcagcttcgcagagcacagggaagacatggaatagtgttgagtgcatgggggcatggcaaatggagaacaatttgcacagtctgagctactctgtagccttctggaggatggcaatttctgagatatcccacatttggagtaagagaacagccacagacctcactctatgtgtcactttgagcaactttgcttagttagaagctatttccttacctttaatataagagtaatactcagtttgtataatagtcctggacatccaatgaaaaactgtgtataaaatatcttgtcccataagtgctaaatgaattgtaactactgctgtgactgactaaataaaaattatatatgtataagtataaaacctcttacaaaacatgtaataataaaagaatgagtcataaaagacaagaatcaatgagtgttaatggtcacctttgttgctgacctctaaactccatcccctggccttaacaaatatggcaggacatcttcaggatttggcaggcagacaattttatcttacactagtgacttggatgccattcctcttccttccactcagtaacagacggtgccctggacagcagtgacatctgcagccccaagggagaagggtcagcacaaattttaattttgcttttggtttggggctttaagtacacaaacaggttttttttttccctgtcagtttgcatctagcttcgcatctgacattttttaatgttttatgtatttggattgacctagaaatttatagcttcaggtttttgcttattttgctctgtctctaattcaacctccttgatttaaaaataaaagccaaaatataacatgaacaaatactctatttgtctgtatcactaagggggtaaggaagaggtcattctgctctttttgagctacttcttattacaatatattaacatttgaatatcttcaataacaagaaacaagaatactagggataacctataaaaacctgagtataatttgactcatcgctaaaaaaaacttaaaagctaagaggagaacatttacaaaaattgttatgttcactgacaaggcattagatttcagactaattgctgctatgagaaaaatagatagatacacacatacataaagctttatttttagaaggtcaagtatctacaccaaatgtttcatcctccagagttcagtttcagggaaatctctacaataggagagcctcctgatgtttgttgtggccacatttggagccatcaaaatttcctactcaggcatcccacagagaaaaagcatctacccctaagaatgtgaaatagtatcctcattactgagttgattactcatcaaccttaatagtatttgtaattcgcctttaccctggggcagttttcaaaggtcacagggaaggctgaaggctgtgtctataagacagtttgatcaaaatagaactaaaggctggcctcaggtagctatttctgagttggtcagaggacaatgaaaactacagttcatgcccaaatgttctccttggtcaaggggagactggctagacagagtcagatcttaagggtcatttctgattggcctccatccagagtatgacaacaaaactcgagaagcttcgcagataaataatgatgtaactaatttaggtgtttagataaatcattccaagtctcttttgtctgcttaggcctgattttcctgggctaggtaaacaccctgaatttacaagagaatgttcagcctcattttaactatgcaactggtagaagaagaagaaataggccttcttctattttgatgctagaaagacaaataaaacgacatgcataagtcatttagagtagtaaagcaaataatcaacaattcacaggattgaattgtatgataagaagacatatggaatttctcattctggttcttttctttgtcccttttgtaagttacttactcaaattgattacagcttttcaatctgtaaaaaagggatataagataaataatctctaatattccttctaactctataaaaatagctattgttttatgtatcaagaataatcaaagtattttttttagattgcagacctatgttctcatgagactgcatttcagatggattggaagcaacctaatatgtattcaaaaaccagcaccagatgaaaggactcagccagaatcatgcaaagcagaagaatcaaattcacagagacagactaaactttttaactaagactatcatgcaattatattgttggtatatcccatgtctattggttgtatatgtatccaaaaattaggtttagagatggatgatacacagattagataaactgataatcaatgaagaaatggaaaaatagacatttttaagcacattttctgaaatatcagatgtataaaatatgtgtattcatgaaagaaataaaattagacaggagacaaaacagataatttagcaagaagttattaagggtgaataatagtattcagatctatctgtcataaggccctacaaatactaaaattagctgtgatttttttctattagttccctaggattctgctaaaatcagcatcctcatgagcactggttaacactatggtgtaaatcatttgctgatgccataaattaaaaacaaaacaaaaaactatattcaaagtaactgagctataggaacatctccttaaaagatggaggcattaagagcattttccacaaccgagaactaaatgtcattcacctgtgaattaaaaaaaggaaatcacgggggaaaaatgagcagccagatcaattgcataaacctttgtcaaagatagaaatgtttatatgggagttctgtggctaaacaaaatgcaaacagccacatattttttcaaccaacaaatggatatcagtagcttaaataaactctttcatctttttatttttttcatccttatccttgctttaaaaaaatggaacacagtatttgttgaagattttatgcacatattgcatcatagcccaatttctcaaactcaaagtcaatttagcaaatagaaatgatagcagaaaaaacatataatgtcctgttgggaagaactgtctttcattgtagtgtgaacttaatgactgcatcacctaccttgaagtattttttaggtctagttattcatttaacaaaggattatccagtgccttctatgtgacaggcacagtggccacaaagataagcaaaaagatatgctccttatcttcatggagcttacaatttaataagagataaatatgcatcaaacaaccccacaaataaatgtacaactgtaactgtaataaaagctaaaatgagtatggtgcactatgggcatacagtagggagatctgacctaatcagagagttaagacaagttaggggccttgtatcctattcctggaatcttgctcatcagcaaacagctgaaggaagtatttgtaaggatagtatatccctctgtacatcccaaagtcctgtcctgtgcacagccactgactacatacctctgcatccaaagcagactcagctttcagctggccttgctgagagtgagcccagcatatcttggaaaatgaattcaccacactctggcacaaaccccatatcatccaacagcttcttcaaccagagcagctcagtcttggtccttatccatgaatgatggttgcagaaccacgctggctttacagggatctgggtaggatccattgcccccaccctgagtgtattcatagtgatgtgctatatggtttagaagccttggtaaataagtcaaggtagaactgtctcaacccagaactttcttcaggtaagaagtatgcttccaacagaagttcctaacaggaagcagctatcaccatcaaaggggagtactgaaatcattccaagactaacccccacagtctactcttttcttccctatcatctgtgcccctaaagcagtcaggagagttccctagccagacctaactcagtacttaaatatctttgataggcctgggaaacagaacacaggaagaaaagtcgtggcttttcaccccagcagtggaatctattcttgttttttgtagcatgagatgtttacacctaaggaacagaaagtgaacttaaaatgtctttaattaagaaattaggtttaaatgattccatataacaaatctgatttaattttaaatttttgaatacatttactcattcaagaatggtttcaaaccctccaggggtgagataaatggcaattctagctatcttctaccttcaaatataactttcctgaaataaaaacaggaaatccaatttgtaatcacaataaagtttcttatctaaatccaaaggccagtttttttccccttggaaacataagcgcctgaagcaggggctgcattttgatattctttgtggcacttggcacagtataatttctatgaaggtgccttgtaagtagcctggggtgattatggtggtgtaattttcatcacaaccacagataacccaggtaactgtgcaggtacaatgacgttcagcttaagtggctttgttccaaacaagggcctctattgtaaaaacaaagcaggtgttaaaacatagagatattgaagataggggtcattttacatactaacatgcactgaaaagtaaatctgagcttccccacattattgccaggaattacggtatacttaagatgaatccattaagtacacaactggacaaatgatgaaatttcatgttagcaaaattcctgacatatttcacacctcttactctattaaattacacttttttaacaaagaaaagctttcctactgctacacattttcaattttttctcctatgtatttcatattaaaatttcaaaataatttgatcagagatctagtgcacaaaggtgcctaagtgaacaataatcaccaaaaacacttgcaatggctgcagtagtgggattcccatcagtgatgtcaacagtgatgccaagaagacaaaagaagagggaaggagctaataacaaaatccatagaaaacaggcttcattaatttctgaacaggctacataaatccattaatgcctacagattaataacatggtcatataaatgaagttactgcctacgtgttttctgaaaaacatcattgctaattcatcttatactgtcaaaatttctttatccaaaatgtatatatttttgagtaatatcttctcaagaaagtaatactttcttgtaatactcaagaaataccctcaattcccaagtactacagtttatatgtgaccagtttttgatataataaaatatataaaatgtaaagttaaaccttagatgtctatctagtgcttattctgagtggcaatgaaataatgtaatagaacacagcaaaaggccgaaagaaggaagagctgtattttgggagtgcagagaagtattacttcagaaatgtgtccagacaaagaaaactcattcaagggacgtggataagggccaggtggactaaggaagaggtaatctatctgggtgtctcaaaaaggaagttttcattctggaatctgaaaagaggatgaatgcacctgaaaatcaaaccagcagagagtgtttcaagaagtagagttagagagaaagaatcaactagagataggtacatcagacataggaaaggaaacgtgtagctaactgatagcttccataaagacaaattgaataataagactgtgtatggtttacaaatgcaggcagtatttttctcgaggtgtctttgtagtgaatctactatctttatatttgccatgttaaagatactactgagctgcccagagagcagtcaaggaaaaagatttttggccacagggctgtggtccttgagaaatcctggagttcctgtgtgcttaggaagttatcagaaacagaacatgttgtgagtgtctgtgcttgaagtgaaagaagggagatattgagaacagcaatgagtttgcccctttttgacaaatcttactctctgcttatttatatcaaattatcatcatcatcacccttatctccagtgattacccaagtctcttgttcacactcctccaaactgtctacatatacctccccctcgcaatacacactgaagttattaagaattgaaagaacaaattgtttgcccatcctcataatcatctgtcctaaaaggtcatttaaacatttaatcaaacctgcagttctccaggggaacgtgtgagtcatgccgttcatcccacacactcaagcggggctttgtgtcagtcttaggaatgatgcagactggtcccacaaagaaatcagtcacagggacattttctgtcattaggcagagaacaaaaagctaacagtttcctggactctactgaaataaacttttgcaccaattaatgaaacccctatggaaagcatcatgccagaatccaaggaggctgtccatgtattgacatgcaaactaacactcctgcaaaagagggggtaggtgagcatcctaagtcaatatgaattatttgtttttctgctactttggatcagctataccactgctccctttcacaggtacaaatacacaaaagagggcttctgtttcataaaagtggctctgacaaatgacactcctcagggtgctgaacccaacactggcagccagcccattctgtgccctcagcctgccagtacttttcacttccaaagctatcagcctgcttcagacctatgccttcactctgactagggacaaagaaaagatcacagtggaaatccttctgcgtgctgctaataagcctatttagagtcaatgagaaagcctcattttgcaccaccaataaaggccttcaagagtactactgaatcagagaaaccgaaatgtttctatgtactccctgtcctcattttacatcagcctgacaggtgacactcagcaaaatatcgaacaggatgacctccaagtttccttccttctctaatgtcctctggttctctgttggccagtaggatttaaattttatttaaattatctcatattctgatggattcttgagccccttttcagttttagataatctccctgtggtttgctgaattggcatatctggagtctaggatctctgttggcaaagaactgaatattgctcccatccaacagcttagctagcactgtctattttctttctgaaagagatctgggtaggagacaggtgcagagcatctttccacctcccacagaagggctagggaaagctttgttgtgcatgaaccatgaacaaaaggataattcaaaccagcaataatgtccttaataaaaaataataatcattttcccaaatgaaaatctacaattctaaccatttgatcacagtgatgtaagcaaacaagcctgcagctaaaggttatatatgggtcaaagatttaatggaaagtgatacatgggtggaatgacatcacctatttgtcagaatactaactcctctaccatatcctatgtcggcccaccgttggggtgtaagggaaaggtgcataaagagataagtacccatttctaaacataatgcaagtttgacatttaagctcaatagtttagctatagagcgttttggtaacataaaaagaaaccagagcaatttgagtgacctttgtgaaagacaggcataaaggttgcaaccaccactctcaccaccaaaatctaaaaatgcggaaaataagcatttatcaaaatttctcagagactatgttacccacccaagattccacagctaggatgcagtgtttgagtgtctactaacaaggctgggaattattaaacacagaaagcataacagaaacacttagttcctcttgggtcttatggtccagttgataaaacttccagcactttgaacagattttcacttactgcaaagaaaaatgcttagctgaattattgtctatctgggttgcaagtagcacacccccaccatctgtaaaataatattttggtagactagagggcatgttgttaaaggaacccaaaggagaattgttttgataaagttagggacaatctctaatatgtgtgttttataattctgcaacttatgtagaaatatatctgaatgaaatgttgttgaaaagctgtatatcattttaattttaataaatcaaatcacattttatattcactgactgagaagctggtacttaggaaacctgtgagaaattagtttaataatttgtgtgtattgcaaatattgaccttctgacttaattcagaatttctatataaaaacaaaaatttaattctttaatatcttaaaatgagggatgctcatgccatgttaaataaatcatttccacttatatttaatacattgtattagttaggatgcttgcagctgcaaatgatagaaaatccgatccaaaatggctttaaaaattgttgttctataggtctatcaccctagacttctgctgtccaatatgatagtcattagccacatttaaatgtaaagaaatcaaagttacatttacatttaagtgtaaagtaattaaagttaaatacaatttgaaattctattttttcagtttgcactagccatattccatcaagtgaccaatagccacatgtcactaatggctgctctattaaacaatgcagatatggaaaaaccttcttcacctcagaaagttctattagatagtgctggcttcaaagaaaaggaagttgttaaatcagtaagcaacagtatctgttatattccctatgtagcaggcaataatctttatgcatattatttcctttaacttcccaaccgctctatgaggcaagtattattttaatgtattagtctggactctaggttgctagctaaaaatgggaaaacataattaggagaaccttgaactatctcacatatctacaagaaaagcctggttaaggtcctcatcaccatcagaactctttccatctgtcacctttattctgttgcacaagtcaatattattcttccaggtcagcttcccccttgtggtggaaacttcccagcctcatatctcacagcctcaaactactgcctcccaccccctgagagagaataatcttcctcctttcactcccattttagatattactcggaaggactctgataatttagctttagtgaagagctcagtgttaaatcaatcagttgtggctgaagagacacaaaggagaggatcagggttgtagaatagagacatggccagaggggctccacttatggacagtgaaaacaatttctacagaaactggaatggcagggtcctctccttcaacatatttctgagtcctcaaggctctatctcaggccctctgcaatttccactccacatactttctggatctgtctcaccaagtcccattaatatactagtgaggccccaattctctgtctcagcaagaccttgtattcttagcttcagactcacataaccaagtaacccttcccagacatctgcagctctatatctcataggatccttaaactcagtatctcccacaaaattcatcatcctccttccccctcttccccaatcattcattatatcaggaatgctctttcaatcaatgaccgaatttcccattccaagaatcaaggcatcatccatgatttgtcctctcctttaacatgcaattaattgccaagccctacatatatccctaaaatgtctttttattaatatatccatctacttctgtccattcctagtacagtgcaaccatcataggctgggccactatcatttctggaaaattactgtagtatctcatgggtctcccttcctccagtgttatgcctcaccaatacattatccatactacagccagaataatctttctaagatggtgattctattattctgcttaaaaccttctggtgcccattcattgactttcaaaacatttttcaactgcctcttgaggcatataaagtgttatatgatctgtcccttgcctaggtctctatccttactctcttcctatccccctctcctagtctctacaactgccatcctttctcttgcccactggtctttgtgccaccctctggttaaaataataatactactgataatctctttttcttaattctgctcatattttagtctcaacttcaatgacaccaatcttctcccctaggctacatcagttctccctgctatatgctggctattcgcttaacacattgcattgcaggaactgggctaaattattcaccttcccaattagactgtaagccccatgaggacaataaccatttttgttttgctcacgaacatgtccttgacatctaatagctagtgcttgaaaaagagcagaaaataagctgaatttaattctttcatttaatccacaaatattttaaggaagcctatttgtgccagatgccacccaaggcactgagattcagctgtgaatgaaacaaaatctcttcctatatgaagctcatgttcttgcagggtaaaaaaaaaaaaaaaaaaaaaaccctaataaactaataattttttagaaaatgcttaaattgtataaataaatatagttttaatatttgtataactttttacatttttatttttactttttaaattttattattattatactttaagtttcagggtacatgtgcacaatgtgcaggttatttacatatgtatacatgtgccatgctggtgtgctgcacccattaactcgtcatttagcattaggtatatctcctaatgctatccctccccaaaccccacaacggtccccagagtgtgatgttccccttcctgtgtccatgtgttctcattgttcaattcccacctatgagtgagaacacgcggtgtttggttttttgttcctgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacatgtgcgtgtgtctttacagcagcatgatttatagtcctttgggtatatacccagtaatgggttggctgggtcaaatggtatttctagttctagatccctgaggaatcaccacactgacttccacaatggttgaagtagtttacagtcccaccaacagtgtaaaagtgttcctatttctccacatcctctccagcacctgttgtttcctgactttttaatgactgccattctaactggtgtgagatgttatctcattgtggttttgatttgcatttctctgatggccagtgatggtgagcattttttcatgtgttttttggctgcataaatgtcttcttttgagaagtgtctgttcaaacaaatttacaagaaaaaaacaaccccatcaaaagtgggcaaaggacatgaactttttacatttttaaaattgtataaatgaaacctttttaaatgacattttccattatgtactccaagttgtcttttcattattctgttacctcattagaggtagtatggaaataaagtgctttcccctcaaatagtataaatgtaattttatttttttagaaaaacaaaacactatggagtcatggcatttataatgaagtaatcaaatattccaattaaatattcaggtaaccaaatattccagttaaatattcaggtaaccaaatactccaataaaatttgactgattttataggacacaggactatatgtgtttctagaatcatattcccatttaaattagcatcgcagtcaggaatttaaagacaaactatcagaatagtacattttcttcttaaattacagtaaaagcccttttataactatgttgagcttttccttttattaaaaaatatcattccaacaattaaaatatttatcaaatgcatgccaagctaggcaccatgcatcatatctacatcactgtaatgaagaacaggaggactatctggccatacattatagaccaattaattaacttaacagatatataatgctaagcatatgctaagtcctgaggatacagaccctgcttactagcaacttacaaactattgtctgactattatcttcctcacaaaatataagctccttgagggcagatgtttagcacaatatagagtttaacaaatgtcataagtaataaaaaaaaatcaagactcttcggtagtcttgatttctcaattagccttagtaagctctaatcacacttagtcttaatttctcaattagccttagtaagctctaatcacactttatgtctcctttgccctactgtatccaatcctttgttcagctagttcttttgtttagctatgttcctaagaagttgtggtaattctcttgtatttcagcaaatcatatctatgagactctctcaaatcctctgagttaaaaagaatcccaagataaaacatagagaagaaatattatttttgaaatatagtctcctgtatttatctgctttgtatcacttttagaaaagaggagaaatcaagttttcctgatattgaatcatctatacattgttcctttttaaaagtttgtttggttttaatgaattggttccctcaactgaagtttaatagccatttaaaggaagacaatttatcctaatgtttctgtatttttctaaactttctcatcctctctggcccaagccttaccatagtttttcaaataattggtgatcaaaaatgctgaactgtcacctgtttgcctatatactcttttccatttgtgagttcttcagtgtaatattccagagattgtgtttattcagatacattcatcttccaatcaatcaagataatgccagcttctgttgtgggttttgcagaaaggatttcctagactcctgaattcattttttctctctgtagtgtgagcatttttctgttttaaattattttctgaaaaaatgtgagtatttacgtactcgaaattttaactagaattgcttcccttctaaaaatgttagtttctcagaccaaatgcatcaatctgactccctcagaagtcaggcggttcacaaagagggaatacttcaccttaggtggccaagaaaaaaaacatactggcccatataccaggaaaaatagtagaatgggtcagtgcaactcagccccacttcggtaaagttcttcagagcaggaaaggatgaaggaaagaagcaagtatcaaatcagacttcagtcctatcatcgttaggtagctacagggctttagacaaccaacttgaccagatgagcctcaatttccctttctgcaaagtgaggaaactgagctaaataatctctaaggacctcttcaactcctccactctatgtgtatttacgattgacagtacagttttctaagtgttcagaatattttttgtttctgagatggcaaactttacaatctgctttgcagactttgaagatacaggtgcatctgtgtacgtttctttaaatttagtaatttagtaattaagcttcccactttcaaatttactaatgagaaaaacacgcacacacacacatatatacatattactctgttattatactttactgatttgaatacatactcaagtaagtatataaagctggctactgattgcatgtttttgcattgacaatgtataggtcaagtcttgtttagacgatcttctgtaagacaccttgagtttatcagtaacctttagcacagttgaatgtttattttgctaatttagcttcaggtgctatggttatcattacaaactaactctaatattctctgttactcaaagtataccctagagctcaccaggatccatgtcacctggaactcatcagaaatgcagaatgcctacctccagagttacaaaatcaaaatctgcatgttaacaaggtacttaagtggtttgtgtgcatgctaacattctagaaatgctgttagacatagtgcttcccatattgctttaaaatagatatttttctttaagagaatgaataaatgagtaaactaactctaatttagcaatgtgaactgctataattcaatgtcattggacttagagttatagaacttctagttgatagtttctcctattttgttttttgcttaatgttgtcataggtctactcttatacaaggcaaggggccagggaactggatgtaaaggtttacgctgttcaagacccactagcaaaaactacatgtataactgaaaatcaatgtgaagaatattaaaatatttactactttataaaggattaggtaataaccaatatgttatttttgcttcactttatagttggtgattaaaattccaaaatgtattccatcacacataaagtatcataaagagcaaaacaggaaaatatttttcaactatgtggtaaaatatctaatataagtaaataataaatggaggatataaatgtcaaggacaaatccaaataaaagaaaccaggatcctggctgcagctctgagattaacactgtgatttgtcaataattcactttacttctctgggttctagtttcttcactagaaaacaagagattgattcttattttacatcccagctctaaattctgaaatctagtatgtctgaaatcaatgcctgttttgtcatctcagatggatctattgaaattcaacatgaaatctcagaaacagcataaataagtcatccttggatttctgctattttacttgcgaagaacaagagcatatggatggctacctggtagtgctcacgtaaaggcattctccccaagagttttactctaggcaaggggacaaatggggatggcagaacgcattttaattcaggggaacctacctgggttatctttcactctgaatcaccaaatcaaattatgtaaattcatcccccttgatgactacctacttccttcatatggtctctatgcgtcctgagtgaatacgggagagcttatacctttcataactttacaaaacagaggattgctgagaggtagttataattgaaaagttacatagttaatctagcaccagaaaataaactgacaggtcttccagggagctaattattgaggctgctatttggttcactgacaggattgcttgtttgtgggaagaaacatatttgtgcgttgctttttccattaccgctatttctatcatcataaataagaatcaataggccattttgcatagcatatgctcaccactattttgtatctgagtgtcagctgtatgcaggctaagcagcagtgccccagtctcctggctgagaattaaaacccagcaaagaaaacacctcaaattccacaagacagtgtatatgtctttgtgagctccttgagagcaagggaggtctgttgtttgtctctctatctgaagcacagtgcctggcacatggtgagcttcaaaatgtataaacaactaaatgaataatgaatgaatggatggatgaatgaaacaaaggaaggttttaagataggatatggaatcaactgtatttactggatcagtcaagggatgtcgttttgataagcacagagctatttataattcgtgatggagacaggaaggaaaagacccggcctgagtccagagggagctggcttttgtttagcagcttaacccacatactcaggtctctacaatattcactattgggtcctcactatagaagacaagaaatcagaatgacagtcatttaaaaagtaaagcaaaacttctgaagaaagactctactgccaatgagaacattgctggacaaaacaaggtcaagtaagggactgatcagaggaaagataggaatgagaaaaaatgaggcaatgaagggagaggaattgtggcagaggactgagtggggaaataagtgtgtgaaaaatgtgtaaagacagggagaggatgaagatgcaattctcaagagagtctgtgggtgtctgggttttggagagtggaaagacactaagcctgagagtacaatgagggagggaggaaggaagggagggagaggtcagataaaagtctataaaataacacccatcaccactgataacaagtataaaagagtccttttttcttctcgagaaagacaaagggaattttaagtaggattaagtagtagtagctttcagaactcagcagctctcagaagcaataataactacataaatagctaagtggatggtaggaattacctcacttggaatttggccagcaaatcaaaagttagcagtaatatcacatctttttgaaagctttcctgagattctagaggggaaaattatctcagaaaactgtttctactgagtaaatttcaggaagaaatgctcctcactgcttgaagatgttctatctctggaaaactggtaagacagaagtccctccctgctgggaagcactctctcatccaagtaaatacattgccaattttgcccccaatggaagcaaataattacgttcgcagatcaccgtcgcctaatgtaaaatgttactcaacacatataacttaacctaccaatgatgttctgaatgaacaaaaagggcctcatggatatctcactttcagagagtgccttaactttttgacttattgcaggtagttaaaatgcaaactttttaaggccacattttaaagcactttgcaaacgctggacacctctactcgtgaatatcctgtaaatttttcctttcaagtacatttgaccactaacatgccagatcatcttcccttctcccctaaaacagaaatgaaaactgggtaaaatggtaatttgggagacaaatatcttctcttatcatctgaaaactgtcatatgttgcttttttaaaaaattaaattagtgttatttgttttccacccagagacaagttattttggtatcacccacaatggaatttgcatgaaaatctgtttactgacccagttccctaggggtgcatttgccctagcacttggagtaaacaccattttcattgcactagaaatagttctaattggacaaattgttataattttagcaacacccaaataaatcaaaggaattggaggcagacatgccacagaatctggattcggccacaaaccagttcagtatttgtgcctgaaataaaagtctagtcatataccacctacagatgctaaaggaacagctacatacctcaactgaacttagaaaatatgatttttttattgtactttaagctctgggatgcatgtgcagaacgtgcaggtttgttacataggtatacatgtaccatgatggtttgctgcacccatcaacccatcatctaggttttaagccccgcatgcattaggtatttggcctaattctcactctcctttcaccctcaaccccctgacaggtcccactgtgtgatgttcccctctctgtgtccatatgttctcattgttcaactcccacttacgagtgtaaaaaaaaaaaaagaaagaaaatatgagtttggagaaactggttattctgaaaacagcctattaaaaagttatgtgactggttaacagtgtgtgtgtgtgtgtgtgtgtgtgtgtgtatgagtccatccatttcattaactggggtattttcactaatacagtctaaataacaggaaatgaatttaaagagaatcaaacaataacattcagaactcaaagttaagcatagtgtaaaatatatctcagtggaaagcatgtaagtgcttaacttaactctccttccaaacccatctataaactgccactttgtattttccattcatgtatcctcctctccaagaagctggacctttttactgctgttcacgcacctacacgtcacaccctactccatgcctttgtcctgctgactccccatttcttctcatcttggatgtctttcccaaatccttgtcatcaaacactcatctcctccacagagctttggattttacaatgtaaacttacatacattttctgaacttccctaattatctatatccaaatttagcatttaattatagaactttcctctctgattacgtatatgtttgtgtgtaccttcttttcccccaaccaaatcacatgatttaaaggtaacattggtctttaatgcctctccttaaagtttccatcaagatcctactctgcatttattctctttcactagttatcccttctttttttttttctgaaaacatgcttaaatgtgccctatcctaaagaaatctccaattctttctcaagctctcccaccatacctactttctttctctcaaaacttcttgaaacagcatcctttcctccacttctattctgttctctctcaacccctctaatttggttacccaggcacacccttatctctcagctgcaagtccctgcagcactgaaacctcacgcacctgtctttctcctggagactgagacaaccttgactcccagttcatctccttcccccaagcccagcattctcagtgtcctttcctggttcctgcccttgaattctcagtcatcactcctcatcttttctcagtctcccatggcaattgcatctctgcttttgtctttaacttcaaaatctccaagacttcctaatctcaaattttagtgaactgtctgtggggtcccagaccttatgctgccacctgctggccagtttcatggggctatctcagaacaaaattcaagtttattcccaaacacctaaccattctatttattttatatttcctctgttaactaattacatcaccattttcctagacctccctgatagaggtttaacatcagcatcctccatgatttaacgatctttgccccagcatcaaccactcagctggttgttatataaacacaacactatgtagcgttagataaatataacactacgtaccaaagcgtctgtcctgtgtgttacatccctagctagcttttttgtttgtttgttttgttttgttttgtttttttggagatagagtctcactctgtcgcccaggctgggtgcagtggtgcaatctcagctcactgcaacctccacctcccgggttcaagcaattctcctgcctcagcctcccaagtagctgggactacaggcgcccgccacacgccgggctaattttttgtatttttagtagagatgggttttcaccatgttgcccaggctggtctcaaactcctgagctcaggcaatatgcccacctcggcctcccaaagtgctaggattacaggtttgcaccaccgtgcccggcccctagttagctcttcttagaccatgatggcctgtccccaggatactggatgagtcctcattgacctgcctccattttctcccctgaaccccaatcctcttcacacttctgccaggcaaatcttcttgaaccgagtgtctgagcaattctctagatgaagagcctcaagacattgtgtcctaccggtagaataaagcccaaattcctcaactctggaacttctggaaagaacttcaagactgtgcatggtctggctccagactatcatcaaagcctcagctgtcatcacgcttcctctcgcgatattcactcttgctccaacctccctgaactattttttttttcctttactttgaacaaaagagccttactctggcgctagagcttgtcatgcattcctgtcatatctttacatgactgaccacttcttgtcactcaggtcttatctcaaatgtcacctcctctggcgaggcatactcagaccacacagtctaattaccttcctcctcctaatacccaggttagtctttcacagttaatctgttgtatttcttctaagcacatctcagcatctgaacacatctgttcatttatgtttattatggagtgtccatctccccacactcaaatgtaagcccgtgagcatgaatattgcctttcttcactcaacccagctcctggaaaagtgcctggcacatggaagcctgaaatcagattcttccacagtgtggcacccatttccacctccttgttctgtctctgtttatatgtctgtgctagcttttagtatattacatcttttatttgaacagctatttccaaagaaagtgaggaggagggaaaggaggacatatcaaagtctgggggtggcagggtagaagaaggaatgaatcatttctaaaacacacattcaagttgtgtagttttcagtgtaaaggatttgtgcatttttgttaaaattgacccttatatatgttgtatgtttttgatcctactataagcagtattctttaaatttcattttctatgtgttagtttctaatacgtatattaaaaatgaatgtttatattgacctcatatctgtaaccttgctaaatttactgctcagttctaagtaactctgtctcaaaaaaaaaattatgcgagttttttttctatgtgcacaatcatctgaaaataaatatagttttaatcatatattcaaaaatgcatattcaatatcattattatttttaagcacaagctatggaaagtaaagcatctaaaaatcatacatgttccaggatagctgctatgcaggatttaagaaaataatagtattatagaggacagcgattaaaatagttgaaaaatactgtcttatagcaacttatcatgatacatattacattttgaacccctggagagcaataccatgtcttatttgtctgtattccatcaaacctaataaagtacattttccaaagtagacaataaatgtttcccagataccccagtactgtatgcatggtatatgttcaataaaaacttgctgatccattgaaagaaccaataaacaaatttaagtttgttgaatgatcagggtatgctcagccctgagacactataacaaaaagacacaaaaaatagaaaatacattcatcattatccatatagaaaaacgtaatttatcaagtaatgaaaacaaatgaaaatgaaataaatgcaccacaggaaacatttgagtggttacctgtgcatttctttatatgactgttccttttcccatgtgatcctaacttgcagccaaaattctcctcccagaattctgcaaaccacacatttcttcgattattggcaagagttcggcttctaaagtatcgatcaaatcctatttcaaaggagaaaggtatgattttaatattctttcaaaattaaatattgtcagaactttcgaatggacattatattctgatcactgcatgaaaagaaaaaaacaaaacacataacaaatgagagaaagccagtagcccataaataaggcctctcttatggcaaaagtcaaggaggatcaatggacaatccccccacaccaccaccagtacccaagcacctggctctatgaataagtacaacaggaaagcctggtgtcagcgaccttcttaaaccctctcctactctactactcccagaggcagcaaccagtgacttcatgctgaatcctgaatacttagaacccaacttaaacttgcctcattcttttctctttcctagcatggatcaatgttccagactttcctgtgtttccacatacttcaaaatttctccttcctatatgttctgttttcaggtaattcaataaagcaatcatgttaatgtcatcttatggagtcatgaactcaagtgtcggtttgctcaggtaactactttattgaagggagaccccctggaaataatgccttactccagaggataatgttaagatgggaatttcagtcactgtcaaaccgactggaaaagatgtttagaagatagactgcctttcaggatgctccaagtctttcctgttgcatttatttatccataggataagcccagcatcatatatattcattttctataaatcaagcatttccctccaacaatgctataaccaccataaatacccatggaaatacgcaaactcaaactcaaagtgcaattactaacataatggaaataactgactatggtctttttcttaaaaaaatataatgggtcctctttcctaaatacatacacacacacacacacacacacacacacacacacactatatacatatatacatatatatatgtatatgtgtatatatataggtatatgtgtatatatatatgtatatgtgtatatatatatgtatatgtgtatatatatatgtatatgtgtatatatatatgtatatgtgtatatatatatgtatatgtgtatatatatatgtgtgtgtgtatatatatatatatatatatatatatgcatatgcatgctggtttaaatactggtcttgacaattctgccaccaaagctaaaatttgtatcaagtcatcagtaatgagtgcatttcctcatattatgatactccagttttgcctttgagttcagatccaactggaataaaacaaattctctatggtgcattcttaccatcaattgatgctcgtttgggcaaaattgtcacagccccttctgcaatctcctcttgctgatagacaggtgctattttggatccccaactatctgagccaatccagagaaaatgcccactttggtttagtttttttgctgcttccaatatcctcctacaggaataaaaataaataatgcatatcacatgtattaaaaataccacaattatgaatattacaagaccagatttaggaagttgtatacactcagtaggtcactgtttaacaattaagacgatcattctaactgcccgagtcttatcatctcctaaaaacaatatagcagagactaactccaacatatgttaattagccttatccttaacctcattcacatcattctgtctatcacctttgtttgtcttatctcatttggtccccaagttttactctgtaggtatttcagatttacaaactagaaggcagtctgttattggaaggcaattacaagcttttatgttgaacatgaaatatgttagaaagaggatatgggacacaaatctgaccctacatacagaagaaaagtaatcagcacctgatgtcatcctcattggcaaacataatcactgctcgagcattaggtgtttctagcaggcgtttgataattttttcaaattctccaggtcttggttcacgtgggattttctgtgactgagcaatgcaaacaccacctatttaaaaaagaagggaggtggtgattcagaaagagcatttatttaattagcaaacccaattacctactttataaaagcacatacttctgtatgaatattatttctcaaaatatgtgtcactctcacctattaagagcaattgtttgtttgcattataatatattcaccaaataaatgacaacaattattaatcagacatgggtttctttcccaatatttaaacattatttttgtggatatagctaagaaaaccaaggtgtataagatgtgtgatgagagtcaaaagatggaaagaagaagggatcttttgatttatgcaacataagccaaaggacaagtgacagaattaataaaagtatgaatatgtcttatagttgagacccttattaagtagcaaagtccttttgttacttttatttactggtagacttcttttaaagttaatttcattgtatagctaatagaactgcagcaagatcctcatgcatcagcatagcaatgtcttatgagacaagtggtcttcaaggctatgtaagacacaggcaaaccccaaagatgccaactttggattgacatacatcgccactatgaaaatcgaaatggcagaaataccatctcattttcactgcaaataaaaagacagaacccttcttttggcctctccttcttaggcaatgaaggacaaaagagaaaagtatagaaaagatctctgcctctgggctggggtaggaggagaagaaagaggttcccccagttgcagtgaaacagagataacattctgaaactagatgagaaagcaatattagtaataggtttcaactgcattatggtataaacagtatttttttttagtcagctaagaattaaatcaccatttatagcattgcttcagtaggcaaaggcatttttacttccaaacaattgccaatgcactcagtcatccaactgttattggatgccattatattctacgcactgggctcaacattggaaatgcacagtctaatccaggagttaccacctagtctgggaaataggcatttgaataagttaccatggaatagataataaagtatataattaataggatacccaatacaatcagaacacagaagaaggagtaactaaagtgcttgagagaactgaattttaaagagcaaatatatatccacatggggacaaaagtggaacatgtctggtggaggccaaagtatgtaaaaacctagcatgatcatggcctatggtagagactggctgggtttgaagttggaaacaatgaccaggtccaacttgagaacggctttgttagacatgccaaattctgtaggctgagtgttcatatgttaaaacttaatccccagtgtgaaagtattaggagatgggactgttgggaggtgattaggtcatgagagtggagtccttatgaatgggattagtgcccttataaaaaagactccacagagatttcttgcaccatctgccatgtgaggacacagcaaaaagacactgaaccaggaagagggccctcatcagctcttgaccatgctggcaccttgctctcagaccttcagcctccagaactgtaaaaataaattactattgattaagccacccagtatatgataatttttattttttattttttagatatgggggtgtcactctgtcacccaggctagagtgcagtggccagatcatagttcactgtagcctcaaagccctaggctccagtgatttgctcacctcatcctccggagtaactgggattactctgcacatgccaccacaccgcactggtctcctataataatttattatgcatttcaaagagactaagacatcaaataacttggactttattttgaaaacaatggggatccattaggttcatcagcaggagaaatatatgctgagctttatgctttaggtagactttcaaagaagaaacgtctggtagccaaatgacagatttccagggtgctgtgatcggacctaatatgtacagcagatgtatgagtaactggtgccagtatataaaactatttttcttttaagttagagaacattcaaaattatgcctgtaatagcaggactcttagtaaccttacaatttgcatcccaggggtgggaattgcccataatacacagattgggctgtgtcactacctgcagttagctagtctaccgatatactaccactagttgtgataattgattcattccttcagtaaatatttcttgagtgccccgtatctgctagatactgtgtgggtgctgtggacacaatggtgaataaaagaaattctctaagttcacagaattcagaaatattgtgggtaactcaggcttaatgcaaactaaaaagaaagaagaagaagagaaaaagaatggagacgagaaagaagaagagcaggagaaggaggaggagaaagaggaagaggaagaaggaggaagaggaagaaggaggaagaggagaaagacaaggaggaggaaatggaaggaggaggagcagatggaaggaggaggaagagatggaggaggaggaggaagagatggaggaggaggagtaagagaaaggaggaggaggaggaagaagaaaggggaggaggaagagggaggaggaggaagaggaaggagggggaagaaggggaaggaggagaaggagaaagcagaagcagaagaggcagaagaagaaataatacataattataaattataataagccctgtgaggaagagcaaaggaatttaatttagattgaggactgctcagggaaagccaccctaaagttgtgtaatgtagttgagatcaaaaggatgagagcatgggaaagggcaggaaagggccaggggagtcagtgaatgagggtgagaggagtgggcaacaaaaatgagatggagataagggtccaattgtgtgtggctctgcagggcctgtggaagactatgaataattaaatgcttaactttctcactaaatgtttctatttcttcgatctttgagtggcccataggaatatgtctcatgtatgagcattgcactccacggaagaaaaatggatgacgatcgctgatacagagggcagcctgaagtgggatgaacaggaggcaatgagccaagcaaggaggtattggaataggcagtgggaaatgatgactgagccagcgctactggtgctggggaggagcagctggagctaaggcagaatctctgagttagaatcaatggggctttgtattgatttgatgtaagtagggaagcaatgggaaaccgctaagtatgactccaaggatttggtctttgtgaccagttatgtgatggtatcattaaacaagtgggaaatccaggaggataaggaggaggaaagaatgattttgattggaagcaggttgtcttcaaagtatgcatggaatgtcaaactgaaaaagtgaatctggagctaaagagagagaagggaattgtaatactttcgtcaggggctgataggttaggtatttgaagtgttgtggggcaaagaggtcactgagagagaatatttaaatcagcaatagaaaaggtgaattatagaactctgaaaaaaatcaggtttggagaaggaggaaaggagtgattaaatattttgagaaaacttttggaatgaagtctagaggtaagttgaagactatgtataatttatttaaaatgcaaacaaaccaacctccgtgagtggaaacattaggtaactgcaaaaatgtaacatgaagtaacactctatagggaacaatagctgtttcaaaagatgactgcccttttaattaaattgccatgattacttaagcatcccattaaagacatgttatatgctgagtatcattctgagactgactctgtagccataaaaaattaagttctgaaaatttttattattactgtttcagaagaagcaaacaagcaatccaaacatagtttagtctgaattcattgatttatttattcaccatggacctattaaacatttttgtttgtaaagagctgagttagctgagttgaattttaacatagcttaaatccatttcactttttgctattcccacacctcacctcatatctttcaacctggtcagtttgaattttcctggaaagaggcactggactattaatctatttaagctgaacaaatgcttgtagagaacctgttccacatggcattgtgctgtttggtgcctgtgtatattttattaaagtgtagataaattatttctcaaatgattgtagttagaagactgggattatttccttaaccctgatacccattcacactttctttcttcatatcagtcaaaaaccagacagctaatctgttcataagcactcatggtctactatgtttcaggagctacagacaaagaccgccagtcctcagcagttatgatataattgaatgacaatatgtacacataagaaatgtcagacaagggtgtaaattaggtaacacagataacagcataagatacaccacagttcagtcataaatgacaaataggtcatcccctaaaatagtcctatgacttcataagaggaagaggttattatatactgttagaatttggtttaaaaaataaaatgaaattcaaagattcagacctcaaagatacgttttccatacaatactccacatccattgcttgactttttaaagagactctgtcttgatttaaattcctggggtgggtgggaggaagagaagttgcccttcatcaaagaatgtgtccaccacatctattcttccatgtctcagtctgaaagattactaattgtgtacaatttaagggactttaactttcctattctgcaggggtgttactgttctgtaatttttaaagcttagtacttacaggcaaaatgttatatgaaggaatttataattggctgttttctagaatttcctggctagtttccttgcagcctgtgtattttttttccttctggttacttaacaataatttaaagatcatttgttgaatttaacactttatgtatactttacaatacacatgatcactcctttccagtctcatttactcaatgacaccatctctattcctaatggcagaacttgaaggtttgcatcatgaccatctttctgataaggaaaatgagaaacaggggtaccaacggcttgcaagatactgaaatccaggttcaaagccagatttgtctgcctctaagtctggacttcttccatcatcttacccatccacaattgactatacctgtggcttaatggtttagtgactgcaaatgattgatggataagataaagcaaatttaaagactctttttttttttaaaaccctgccagttgtcccttgtaaatctaattgacagctacataaatacagtccttctgttatcctaaataagagtttaattaaaatacttggaatctatgcagattatagaagtgacttaaagttcttcagcatatagccagtctaccctccaaactttccaattgtttctgttgatgcatgttctcaggaagacttttctgaggttcttgtcttccacttctttcatactgcagcaatcataataattttaattttacttttttttgttacttctttttctttttcttcttcaattagaaatccatgagtattgaaccttgtctttcaaatttatcagtataccccaacatgtatcactgcgtttggtacatagacttcaacaaacatttgttgaatgaataaatgcaagacttgtgacaggtactgctaggatagagaaatacaaatgagacagtgctgctttcaaagacttctccatcaagtaggggaacaaatagctacatgtaaatatatgtttaaaagtagatgtcattaaaagaagtaaaaaaaatatttgggccatgacaattcagaggaagttgtcactgaaatgggatctgcctcccaaaatagtttttattagggtgccatgaattagaatactacctaggccttagtgtattcatctgtagagtggcattagaatttcctcatattgatacaagagcaaatttgtaaacaatgccatttcagaatttttacccctttagaaggctgagacttgtgggtgagtggtcaggtgtcacagatatgagagataaaaggcttgtatgtattgatttgctagtgcatagagatggtggaatgagaaagaaaatagacttgtcagaagacctgagagtggccccacataatcttgaaaagtctctcatctctcagtttcctcatctctgtaatgaggttcataataactatctctcaggtatactgtgagaatccaattataaagggtaaattcctatgccaatgtagcatattattattagtgttaataacagtaataatcatagccagacaagaatcatcaccaacactgagagatacttgacattcagccctaaaacacaggtttttcaacagatcatatttttgaatcttcaccattttatgtgtaatattatcaaacatcctaaattctgaaaagtgatacttgctcacttgcctgtgccaatagatgaaatgactagatttcactcttcatcattgttgattacaatgtgatcggggcaattttaaggtgagagaatgagaaaagttatttacattcttctcccatcccccagttcctacccccaagaattaattctcctttcaaatggattccataagtagtaaagatttggctccaatatctgagttgaaattagaatttaactctttaataaaatggttaaaactattaaaatattaacgggtgccaattgttaagcaaaagttgttatggaaacaaccacatgttctgtttcattcaaacatttgtgctacctttttaagaggctggaatctaatgtgttgagataataatgttggactctcctagaagcaaacctcagaaggagtttgaaatgcacaaaatttgctcttggcatctacctgatgcagggctcaggggaagcagagaaatccaggcagagaaatccagctggctgtggcccagtgacaggctgctgacaccacaagaagttctgaggctagaatggccttcagagttgctttaaaacaggccacaaaggccaggccattatacctccacatcaatcagtgcgatgattcattttatgtatcagtttgactgggccacatgctgcccacatagctggttaaacattatttctaggtgtgtcagaaaagattggctgggcggggtggctcatgcctataatcccagcactttgagaggccaaggcaggcagatcaagagatcaggagatcaagaccatcctggctaacacagcgaaaccccgtctctactaaaaatacaaaaaaaaattagctgggcatagtggcaggcacctgtagtcccagctacttgggaggctgaggcaggagaacggcgtgaacccgggaggcggagcttgcagtgagccgagatcccgccactgcactccagcctgggcaacagagcgagactctgtctcaaaaacaaacaaacaaacaaacaaacaaacaaacaaatagagaaaagattagcacttgaattagtggactgaataaagcagattaccttctccaatgcaggctgggatcattgagggcctaaatggaacaaaaatgtagaccaaggttgaatgaactcagcctgactgcttgagctgggacattgatcttctcctgctctcagtgcctctggctctgaggcattcaaactacaccactggttttcttgggtctccaatttgcagacagaagattgtaaaacttttcatcctccataattatgtaagccagtatctgacaaaaaatctctttggttctgtttctctggagaaccctgaccaatacaatgaatcatcagacttgggccactctggaagaggggaaggtgaacttggccaaggcagctctctgtagccagggcattccctcacagggttcagagctgaaggctgtctgcctatagcactcccagaaataggaataacaggtcatgcactgataggatcttgaaggtcaattcaccatatgtacattagtgttaataatgtataattgaaatttatacaaaaatgaagatatcatttttctgaaacaaccgtagactattgtttgccttataaggcaaataattaatagaatgttattatttaatgttaaaacttcctttcaaagacgtcttgttgcacaaacaaaggcaatctatacaaatgatagaaaactggaattgtagcctgcacaagtaggagaaataggaccttcattctttctggtttttcaataaagaagttttgttaaaacaatctaaaaggataaagaattatgtttttagttgttgctcatttataagacaaaaatctctattaataatttagtaggagaaaaataaaacaagaaacaatgtcacagcaccaagttccaactgtgatggaaattgaggattaacttattgggatgaaattacttacaaagctgtgtatagaatactaagtgtgcatttttaaaaaacaacatgactacagtattatcagtatctcaagttggttcacaatttccatcaaattaaattctacataaatcaactcaagtctgtggttatataatttgttagagctacacgacagaccttggttttggtgtacaaataagcaaacaaaattaccattttatcagttgttaaagagaatgactagactattggttaaaaatgattagacttacagtttgaccataagaaatttgcctagaattaaacatcttttgatctaataaaaatgtgatacagcccatccaccattatttatttcttatgaacatgccttcagataatagcaatgagcaaaacaaaataaccaggtgtttttttaaggcaatagaaacacataaactctctaccctaaatatccttagcatcatttatatttccatctttctgaagacataagtgaactaacaatttgacctaaagtaattggtcctttagtggtagttgagtaaaatttgttctatggtttaaataagtgtaatcacgcctcctgtaacaatattttcgcctcctcatgtggcgtacaactgggacttagcaggaaagtgcacaacatgaaactgtaagtttatcagcttaaagtgtactttgcaaaagagaagatttatctcacacatcactgtaaagaaaaagtgttatctctaccaacatggattaaaagagcaaaactgcacttatatttatgttcattttctctttctcactttcaaacattttatactttttcctctatcaaatgccatgtggaatcttaaagggactctgaaaagcaatgcaatgaaggaatggtacagaagaggcatgtgctaccatgcatagggaaataaagacaatccactgtgaaacgggactgcaacagaagcagacacttctcaaaagaagacatacaggtggctaacaaatatacgaaaaaaatgctcaacatcactggtcacagagaaatgcaagtcaaaaccactatgagacatcatcacacaccagtcagaatgactattattaaaagtcaaaaaataacatgttgatgaggctacagagaaaaaggaagacttacacactgttggtgggaatgtaaattagttcagccactgtggaaagcagtatgaagatttctcaaagaaccaaaaacagaactaccattcaacccagcaaccccattacttgatatctacccaaaggaaaagaaattcttctaccaaaaacacacatgcacctatatgttccccacagcactattacaatagcaaagacgtggaatcaacctaggtgcccatcagcagtggactggataaagaaaatgtggtagctatacactgtgtaatgctatacagccataaaaaagaatgaaatcttgccctttgcagcaacatggatgcagctagaggccataatcctaagcaaattaatgcagaaacagaaaacaaaatatttcacgttcttacttataagtgtgagctaaatcttggctacacacagacataaagatgggaacaatagacactggaaactccccaaggatggagggagtggggcaagggctaaaaacttcctattgggtactatgttcatcatctggctgatgggatcaacagaaacctgatcctcagcatcacacaagtatacccctgtaacaaacctgctcatgtacccccccaatctaaaataaaaatagatgcttttttaaaaaagaaaatcataattaaaaagaaaaggaccttggcacagagagcccctctcctgcctgtctgcagatgtactctcagagagatgctgtgatctggaggtggatcgggtctaggtaggttcacagggtcagcgtccacgctgggctctcactcagccacaactcaccaccgatctggaggtctgctcagaggaacagaggagtggggtgaatatgaatctcgtctctagggtcagacttcctaggtccaaatcctggcccttctcttcttagctatgtgagactgggtaagtgaggtggcttctttgtacctctgtccctcatctgaagattgagaagatggcacccaaatgggctttgtgaagagattcaatcgacactcaacacattacgttttcctcagaaaacacctgctagttgtaaattgtttaaaatcaaaatcaacagcccccacacagaaacagtgattgtctttcatcaagtgatattcacctgcattatttctagaaacctcaaatttcattctccaagtatacacagaatcacaactcatactagagattcctcaagggggatatagagtcggctgcagaaagctgtatagttagaagaaaaacttatgctcaccacaatagaaatgaatgtctgatatgttgcctcttcttacctcttcctttgaattagaaatgtctaaggagacatgggtacaggaactgggaaagagtcagagaaacaaagaaagaaatataaaagaagagaaccaggaaggggaaaggggagaagagaaatggtggcgggggagaatgaaagagaacaagagtagaaagaggagagctgagagagaaaacccagtccagaggtatctatggaactgggcagaaaaggaattctctgtagggtcaaaaaagcaagtgcaggatgaggaacaattggagaaggagcacttgactaggtttaaatgaatgtcattaatgtgttgtgtgcatttgtattttctttggattatgttttggtgagtgatttgtgatctttatttgttctatttgtttttgccatttcaaattaggttcccagactctgcagcaaaaaatacaacaggaagatttcaaaagagaaagctaactccttctaaatgctcaaatgaccaatatgaacagactctctgacatattttccagcccattgcctggaaaaaccattatgacaaagacaatattgaaatcaaagtgagcactgtttaaatttcttacctgttctggactttaaaacagcattagactttgaattaagcccattacagaattaataatttcattatggaattgcagcagttaaacaccccagtgtatttctaagtctagtgaagcctgatagctgtgaacactcattggatgtgtgacaaatacgtgaataaataagaagccactgtttcctgatatagtgaaattatctaataaatagataagcatatccatgttttaaaaccaccatcattcagaaaaaggcaaagtatcttggtatctgtgttatatgtgtacatatcataaagtcatttccaaataccttctgcagataggacattctcaacagtatatcaacagcagctatgagagcttataatctatgtgcactcttctactcagcaccaagtaatatctgattctacttatcagcattacccgaattctgcaatgtattagctttcaaacagtgaggggtctttgctcaaagcagcattttcaacagatacagtggctgagattctcaatttaagaaagaagaaactgatagcagaaaggtcattattattttagccaaataacccttctgagcaagggttgtacaatgaccatggtacggcagtaaccaaactaggaaatgaacttcagagaacaaacatcagcacccaaagcatttaaaaactcagtctttcaaggaaatgcaagtaacatgtagtgtttccctaggtaatgcaagatcattccctataggaggatttgatccatgtgtttagtacataaaaaggttaaaaatgcagttacgtttttaactttttggattcagatagcactaaaaagaaaggatagtgaatagatatgttttggatagcaagccatctaacattttcttgggctccagggatgatcctatcctggcctcccaagtagctaggactacaggtgtgtgccaccatgcctggctaatatttttgttttttgtggagataggggtcttgctatgttggccagctggtctcgaactcctggcctcaggcaatactactgcctctgcctcccaaagtgctgggattacaggtggaagccaccatgcccagcataattctttgaaggactcttgtcaaaatacattttggactagattttattcaaaatagaagacaattagtaccttgagatgcaaggacctcctccaaccacacacacacacacacacacacacatggacacgcacacacacacacgattctattaccttttccttaatgaaagatctacttttagaacaaatcgcaaataataatatatttgaacagaaaaatactatttcactaatgttttaatatctaatttcagcttcataatatcctaatgctatcaggttagtagggtaaacattataaatttatttttacatggaaaaaactgtccccaagatcacacagctattgaggagtcaaatgcaaaccttgtcaacctaatcctaatagcaaataattactgtactttgctattatctctcaataattgtctccttggtcattaggttgcctcaatgtacataattaaatacaacatcaacaggtaaggtggtatattcaaaatgcgaacttcaaagttttacatcatcaaggctgcacagtttagataaatgttttttggtctggttcaagttggacagaaatttcattgaccgacatcctctcaaaagagcctattgcaagctattttctccataaacccgggtctgcctgtcatcactcatggagcattaactgagctcttgctacatgctgagctctctgttagaatctgaagttacatgaatgaataaaaagacacagtccctcatcttcaggagataacagtaaacaacacaatatgtaaacaaatattacaatttgatgtgagaaatgctatcatatagggcagcctagggacaaaagaccaagaaaatggaatttggcaactgtaagtaagatttactggttcttgccagcggccttggaattacgtagccagagaagcataaaaaatagttgtatgatacattgatatgcatcagaatcaacaagtcagaaaacatttcataagtgagattatgcttgattcagccagccaaaaaccagaaaaatctatttctaatggatactaccagtccacagagatgcatatttcctttgacaatgttgtcattaaatatgatgtaataaacaccctgctttatgtacaaaaggagatttaatctaacttttccacaataagaagcagacaactcatgttactgtagaaggaatacagaaaaaaaattaagttagccattaaaatgaccactggaagaggaaatagcaacacatcaatcctaagaatgaaggatttcagctggactcaataaaatgtaatcacaacagctatctacaaggctttactttaatgataaaacacatcagaacttgtgagaataggtttttaaaaatttattcctattattggaaattctgaaaatgtgcaagccaggtcaatattgcattatttaaagatgcactgtcaaacaatcttttactgaaaccaaaaacatctacattctcagtgttataggaaatatagccggtgttttataacattctgcattaaatggtattgtttatctaagggggttcttagaaaagaacgttaagctttcaacaatcccaacatcacccaagcacaaaaatgaaaaccgatcagaactgcaaatgacaaaaggataacaatttgttacttcataaatttctgtgatataatttccacaatttccattcatgcagtgacttctagataaaactcattctccttgcaaatgcgttatagcttaaccatatataacatgtaaatatctacaagtgaaaagcagcttagcttgtttaaaaaaaaaaagatcctggaatataaacagagtaacagaagcactcgttcaagttcactcatggcatgctatcctcttctcatccctgcagtggagcacacccatgttccctctgcatgaccctgggcaagatgtgtaacatttgtggctatcagttccttcatttgtaaaaagaagggtgcttgacaggatgatgtcaagatgcctttgaatttcaacattttgtgtttctatgaatataccacatagctgcctcccatgagtactgtgaattatgtaagttctaatacgggaatagaacatcatgttaaatacaataaattgctttttgaaaagcctacaggagatgaactagagggtacatcagaaaacttttccaattcaaaattataaatcctgacttcacaagtcaaagaatgactggggatcttaaaaactgattttttgttagagtattggagccttggtcaggtgctagggatctgatgaccagttcattgaagcattatagttctcttgtcagttcaaaaaaaaaaaatgaaaggagtgttggggatgggctgaagatgaagacaacaatggcttccattttactattcaataatagcctcgcttttcctctcctcgtccatttctctctcctatttcttgatcctgctcaactttccctttctctcccttccctttcccttgtcttactctgtctttcccattttaaaaacctgaaaatggagatgagccacctgatacaacaccctttcaattacttccatcctgttactctgagactcactaatagcagcagcaaaaaaaggactgttgcatggcctggcctcttgctgagcatggaaaatagaacacattcatttacctccatgttataaactgaatgtctgtgtactcttaaaatccacatgttgaagccctgcccctctgatgtgatagtattacctttaggaggtaatgaggtttagatgaagtcatgagagtaagactcccacatgggattagtgtccttaatagaagaggaaagatcagactgatctctctctgtctctctctgtctccattcaccgtgtgagaacacagtgagaaggccattgtctgcaagccaggaagacagccctcatgaaaaacccaaccaggctaacatcctaatctcagactttccagcctccagaactgtgataaataaatgtctcttgtttaagctactcagtttatggtattttgatttagcaacctgagctaaaacactctaattcctccaaatacccaactaagttgtctactataaaaaaaaagaggggaaaagaggagagaaatgtcaccaatgttttgaaagctgaaaagcagatgattaccaagttgcaattgacttaccagaatagaaaaagctcagtgagagcccacaaggagtggggctggggatgaggccaacagaaacaaagctggtgttctacttaacatgatgaaggccctggagtggaggtaccagaggctccagaaggtggggttgaaaatggagttggttgaaaatctctaaagtcccttccctcaactccagtccctctgcacagaagatcagagagtcattttctatagaggatgaactcagggacatcaaacacagctgaagacatagtgagtttctatagaataaaagtctgcatgctgaatggatagtccctggtcccctctccctgtttagcatccagactgcagtagcctaacttatctccccccacccacccctgcccccactaaaccccatacagaaaattggaagagtcttctctggagaatctggtccaagggtaatgacatactgatacttacatggatgtttcccaactaaatgaccaattccacctgctcgagctaaagtaaagcccactggccaatgaatttgtcctcacctccaaggctcacaaacaccatgtcagcacctcactcttaatatcacagcagacatttgagaggagcctttaccgtgaaagtcaggaaccaaagcaaacagaagaggtaaacttagaggacaagaaataagacatacatagataacttcaagattattaatatcctcagagacaagaagtgtgtccatgcaacaagaataggaggctaaaagaatagaaacattcagagggcaagaagaagctcctagaaattaaaaaggagatgatagaaatatctcaatagataaggtataagagcaagtagagaaaacatttcagaaagcaaaacaaatgaaaatgaccataaaattggagaattcattcaagaggcttaactttccaattttgaaatccccaaaagagaaaatagaggccattaccaaagaaaaatttaagaatatttctcagaactgaagaataagaacttttggattgaaaatagttataaaataccagcaaaaagaaaagaaaggaaggggaaggaagaaaacctatatgaaggaatattaacacaaaattttaaaacactcgtgagtaaaaaccaattacagagaaggattaaggctcagaatggtttcaggattttcacagcaataatgtgaagtcagaagaaaatggagcaatgccttcaaaattataagaaaaaatgagttttatttgaaatgaaaagaaagcaagttaactatatatcaagtgtgtaggtagaataaagtctatttaaaatatgaagaaaactcaaaaaaatcatttaccttccatgcatacctttttttaggaagcttctcagggatggaatgaagctttccaaaccaagaaaggaaacaagaatgaacaagacccagaatccaagtagcagggaattcaccacaggagaaggaaaggggatttctcaaagtgatgatgaagagaagcagagttaacagccatcaaaggtccaaagatcatcccacccagattagagcagggaaaggaagcctccagaagaatctccaagaagaaaagaaactgaatggatgggctgtttgaggtgtttggatatactgaaaggatatgtacagttctgtcaaagtttgaggatgaattgataagttatatagaaatctaagcatatgacaaagcaagaaatgattaatttcaggaaaaacaaaatgtttaagaatagaaatggtattttagtacactagattaactgcaacatcaaatgcagaatcatgataatacaagcactgaatactaattaaatcagaattatgatacaatcctactggaaagattggaggaaaggaagtgtatgtgtgttcatacgcacatccatgtgcaatgtgtgtactgtggggagttaagtcatcgtcttccgtagtagacaatcaaaatgaaagctaaaaaaaaaatcaagaaatagcaacatgaaaatgttttgtgaaaaatggagacaaataccagaaaaagagctaaaggggttggaaataattgttcttggggatcaagattcaaaagcacggggagggcagtgggtttctgtgaagtccagtagcactatatacaatatcgcttgggtaaaatacatgtttggggccctgatttttaaggtcattaagtggaagtggggatgatatggtttggatgtgtcctcacccaaatctcatattgaaatgtaatccccaatgctggaggtggggcctggtgggaggtgattggatcatgtgggcagagttctcatgaatggtttagcaacatccacccttgctactgtacagtgagttctcacaagatctggttgtttaaaagtatgtagcacctccccctccctcccttggtcctgctcctgccatgtaagacacctgttcccactttgccttctaccatgagtaaaagctccctgaggcctccccagaagcagatgccactatgcttcctgttcagcctgcagaatcatgagccaattaaacctcttgtctttataaattacccagtctcaggtatttctttataccaatgcaagaacaaactaatacagaggaaaaaagagtttaaagatagcaagataattttagtcctgtatgttagggaagcatcttctgtaaccaggtttctctttaaaacatttctccacctttatgcctgtgactgtattatcttatgctgattgcttatttgtttgtttgttttggtggcataataggtgcttgtttaatatttttaggaacaaaatccagaaaacaacctgcattgactaaaataataagaaccacatgaaaatccatgttgcctgggtttaaagcatctgcttttcatgtaagtcaacactaacctactaatctgtccctaattggtctgatacccaaatgtcaaaggttcttttcagatatatcagtaattggttttaataacaaataagacctatcatttaaccaaaaccactactgacactttatctggatattgtttgcaatataatattatctttgttgctataataaagaaaataagagtcctctcacatacagacataattattacccaactaatcctttttaagcacttcaagggccacaagaaaatgaaattcagtggacaaaatggcttcagagaacagggaaacacgtgagaacccagaggtaggtatttgcagtcatgtaccttggcagagtttagtgtcctagctatgaagtatgcgagtttataactttggtaggtgttcagtagtgtttcataagaaaagagagtagagtatgaaatatatcagtggctgtcttccaacccctccagatagagcttgaaactctggcatgagtgcttttaggaagagaagaggtttgagaaagcttcttggcaaagtctgaactaacccattcagattgaaacttgatgagttctatttgagaaataaatcacagattccattaatctgtgattcaaatacatctacatgtattttttaatgtatggtagacactgaggctctggaattaattacctcacagttctccagaaaggatctgagtggtttcttttccaacagcaaatgggccacctacatctagactccttgctgaatgaagagactccttgctcctcgtcatttacacaagagaaaggagaatcaaacatcagcaatagggggaatggtctcacactgaggcccatgcctggcaaggggactgtatcccaactgacagataatttgggatgcaagtgatgaaagaaataaaaggtattggattcatagggcattccttcattttaataccaaataataaatattcattttaaatctcacggatttcaaacatcacttgggcataaacttgggaacaatcatgtaactcaaaagatgttaagttattttcctgcattatgtcattctacaacagggattagactgcataatccctctggatctcatggatgtcccagatacagtaactcgtgcaacatcaggttggcacattgtcttctagtaacaggtttttctcaccctctaccaactcatatccacaatcctcacatgggtggtattgcctgcctttttgcttttctttctttccttcctccttttctttccttcctttttccctccttccttctttcctcccttccttctgattctctctctctttatagaaaaagacactaatcttagaagctgatgacgtcagtaagaatcaggttcttatctggctctaattgtacacagcatcatgcaaaagaatttaatgaacttaggagcctctctgagcttataatgtatataagaagttgaatgaggaaaacgaaggagaaagaggtcactggcccttataagaaccaaatccataggcagataaatgctgcttcacaatactccaggaaaacaagtccccagtgaacgtcctggaaactcagcaggcaagaccacaatttatgtgagaccaggagaaaaacaggcaaagaagagacacacacacagagaaagaaaagatatagaaatggagggaaggaagatggtggttaataacttcaggtagaatgtgacagaagagagcaagacctcaaaacaggaactttttcttcatgttttccatttgttattattaagcatgaaaaactccccaaaatagcacttgattcatcattttcagagctatcacaaggatttcttctatttttctgcagaatagttagcattcaagttatttttgcatgggtgccacagcacaacatgggcataaaactgtgaaaaattaaatagctcaaaagtgtaggtgggcttctgtgaaatttgtgctgaatgaatttttagaaagcagaatgcagtactagaattgctgcacatgtgttctattattaaatatctaactcttctaaattgggaaggataataacaagcaatctgtgggaaagctgaagatctaaacaatacaattctgaaaccaaaataaaactgatttggtattttttacttttttaattgttaaaacatcattgtggagtaatagtacaaagacataaagaaaaatttctaaaaaaaatattgtccatattcctatcatcccagcattaaaaattattatttctttcagtctttatccacaaaaatccataaattattaatgtgcatgtactttttgtgtttggtttcccactgagcattatcatgctatcacaagagaagcaacagaaagaacatttgattttgaacctaagatgtggtttaagtcttggcacacagtcattccttgtatagtcctcataggaatcattttcttagctacctaatatcccacagaattgatgtaaccaattttacttactcttctccttcttcttggacatttaggtcatgaccaatatttcacagttctaaatatcactgcaatacatatttccctgatatagctttcttcttatattctgttttctgtatccttgatataaattcatggcaggttgaatgtatttatagcttttggtacatagtgccaaattgttttccaaaagatttataccaatttatacttttattagaaatatatgattatatagcagacttgccaatattgaatactgtatggttaacgttctcctaatgtaatatatggaaaatgatatcccatcatactatgtaagtgttaaatgttacccgtattatattttaagattattagtgtaagctatcaggagttctgaaagttaataaaattttaaattatagctcatagaaatgtaaaagactatagatattatttaacctagtcttttacccatagagaaatttttgcagcaatatctttgatggagacctgataattatcttacacccctcactgtgcttaattgccctcattcaatgagtcactaagtcctactgtttcaaaccccaaatccctctcaagtctactccagccatcattatctttctcctcactgccatggccttagttcaagccctccttacctctcacctgggttactataataacctctttgccagtatttctgcctccagttcaatagttgacatactgtatgtggtctaaaatttcaatctgatggtgaacgctacttctctgtttaaatacttcaatagcatgttattttcttccaggacaaaatctgaacttcacggcatagcacacaaggctcttcataatttagctcagacttcagtcttatctcacatcagtaactccacaaccatctgccaccaactaatttcatgctcttacaaaccttcatctggacatgtcctgcaagatgcctttcaagggtccactcctccaggagaccttcccaacttcttgtcttcccagcattggttggacattcataacctcattcaaacagattataaacctctaattggagcatttattccattgcactgtgtttgtctagttccacattttcccaaccagcctattggttctttaaggttagaaatgtacttttaactctgtatcttcagtgtcttgcagagtgtgaacccttagtagtggtaaatacatgtttgttggattaaccaataaataaatgaatgctccagtctctgttcaacgtcttccagtggtagtaccttatcaaacagtccatctcattttttatttttattatatttaaaaacaaaaatttttagaagcaaggtctcactccatcacccaggctagaacgcagtggtgctttcacagctcactgtaatctcaaactcctgggctcaactgatcttaccacatcagcttcccaagtagctaggactacagccatatgccatcacacttggtagtatgttttttttttctttagagacaaggtctcactatgtcgactaggttggttttgaactcctggcttaaagtaatcctccctattcagcctccaaaagtggtgggattataggtgtgagccaccatgcccagcctgtttattgtgactttaaaaatcaaagggctcttttaagtttctgctacttgtgactggacaaatggtctgttaaacaaatttaaaagaaaaaaacaaccccatcaaaaagtgggagaagggtatgaacagacacttctcaaaagaagacatttatgcagccaacaagcatatgaaaaaaagctcatcatcaatggtcattagagaaatgcaaatcaaaaccacaatgagataccatctcatgccagttagaatgctgatcattaaaaagtcaagaaacaacagatgctggagaggatgtggagaaataggaacacttttacactgttggtgggactgtaaactagttcaaacattgtggaagtcggtgtggcaattcctcaaggatctagaactagaaataccatttgacccagcaatcccattactgggtatacacccaaaggattataaatcattctactataaagacacatgtacatgtatgtttattgtggcactgttcacattagcaaagatgtgaaaccaacccaaatgtccatcaatgatagactggattaagaaaatgtggcacatatacgtcatggaatattatgcagccttaaaaaacggatgagttcatgtcctttgcagggacatggatgacgctggaaatcatcattctcagcaaactaacacaaggacagaaaaccaaacactgcatgttctcactcataagtgggagttgaacaataagaacacatggacacagggaggagaacatcacacactgcagcatgttggggggtggggggtggggggcaaggggagggatagcattaggagaaatacctaatgtagatgacagattaatgtgtgcagcaaaccaccatggcacatgtatacctatgtaacaaacctgcacatcctgcacatgtgcctgaacttaaagtataaactaataatgtgcaaggtgcccaggcatggtaactcacacctgtaatcctagcattttgggaggccaagatgggtggatggctttagctcaggggttcaagaccagcctgggcaacgtgatgaaaccccatctctacaaaaaacacaaaaattaaccgggtatggtggtttgcacctgtagtaccagacacttggggggctgacgtgggaggatcacttgagcccaggaggtggaggctgcagtgagccaaggtcatgccagtgtactccagcatggacaacacagttagaccctgcctcaaaaaaaaaaaaaaaaaagtgcaaggcactgttaaagcatttgctggcctaaaagatacataaaatagttcatcttgtgtgacttactaaatataatatggataccatctttgacatgtacattaaatatgacgtctacccttataataataggaggaactacaaaactattttaaaaagaaagtgtgaacacttttagggaaaaaaaaatacgtattcaagggtgatgcagaacctcaggtccaatctggctgtatcagagaatcctcttgcaggtcagaaaaggttgtctgaggaagcaaggctggaagcagactgtccacaggcaaaggtgttgatgcatttaatgggctctggcagctgctttcacacatactcagtatggaaggaggaattgaagtagaaaaaaggaggaaaacgaaaggaacaagaaaaaggaaatttgcttaaaggaattaataagtaagcaagaagaccaaggggaagagacattatatcatattaattctataagcataaaaaagcttaaaaataagatagtccaatgccaatgtgatttaattattatgttgccccatttgaaaggaaatactgccttttgtaatctgtctagtgctagccagtggaactttctgctatgacgaccacattctatagctgtgctgttgaagacagcagccactagcgtcataggacaattgagcatatgaaatgcagctagagtgactaaaaaactgagttttaaatttatttttattttttattttattgtatttttttgagatggagtcttgctctgtcacccaggctgcagtgcagtggcgcgaccccggctcactgcaacctccacctcccggggtcaagcgattctcctgcctcagcctcctgcatagctgggactgcaggcacaggccactatgcctggctaatttttatatttttagtagagacggggtttcaccatgttggccaggctggtctcaaactcctgccctcaggtgatccacccccctcagcctcccaaagtgctgggattacaggcatgagccaccatttccagccttaaatttaaatttaaacagccacatgaggctagtgtctatcctttttgaattctgtactcatacagaatgagtacagagaagaattctgtactcatacagaatgagtacagagcagaattctgtactcatacaagatttaaaatataaagaaacttaaacttaaggaggacctaagggacaaattcccctgtttgggagataattaaataatatttgtattggtctttgcaatttatactatactttcatgtatttcattgaattaataagaatatagaagctaaagatgaatgtggagtctccatcaacagaggccataagaaaggaatcatagccctgtgtcttcaccaattagaatgtgattctcatggagcaaagcccttactgagctatattagataggaaggagacaacagtgattaagaatgaagactctcagccagactgcctgtgctcaaaacccagttcctatttcctggctgtgtgatcttactgaagctacttaacttctctgtgcctgttttctccttattttaatggcaatagtagtagtactgacctcataagagctgacatgagctatatgagctagcacatgcaaaacagctagaacagtggctggcatacaaaataaattgctcagtgttggttagaaattaaccaagggatcggcagtcctacagaagaggaaaacctcttttgggaggacacactgctctggtcttgccgagtcctccttctgactgtgatatgtttttgcctcaggaatgtcagatgaggtctcagacaaggttctagacaagggaaagcacaatattaaacaaataataatgatgggtcttcaaccaagttttcatttcctctgataatccaattccatcatcctatcagcctaattgttatcctatttagttttcatggccacttttccttctaacttctaatgggttacaaaacatagttaagattatgagctgataattcctatcaattattaaatgttttcatgtgagccgagtattataagtgatattcatagtcagaattcttggagaccgctacttttcaccttgcaactgaggtgtattttgtattcataatccttgctctttgctatgccctggcctgttcctgaactctctctttgtctgcttttccaagcctcctctgtccccatccatctggcactcacataccccctcacttctgcttccacctctctccagcaggctcactgcttggtgcagatggagagatacttttgaagttttcaggaaatcctctcaagggcagtgaaacaatttgtctgtgagcagagatgatactgaatgcattggaatggaggtaaaatttagaatatccaagggaaaaatgcgttagttaaaatagaggatgatttttaaaataattttcaggagtaatgggaaataaagattttcaaggtgtgccagagctaacaaaccacagcatatgacaagagctcctacaattgctaagaaataaaatgcaagaatatattttattctcttccaaatacaaattcaatgatgtgctttgaatcagtacatgaaaatactcaggttgcaaagattctgtgaaaaatggtaatctctaggggcttatgcattaatccttacctgaggcatgcttttgcatgtttagtataaattattctttataaaattgcactgagcataataggacatgtagcttgtaactaggttaacaaacaatagattaatagcatttcatatcattcacagataactaaaaagtcaaaaacccaaaatattaataaagaatttagaaaacattacttcaaatagaagtcaaattcatgttttggaaaatactagtattatctcaataatttcagagggcagaagtctcaccaagacaactgaacaatgtaaatatgtctttataattcttcattttctagtttgaagttgtaaaaaaaacttcataggaagaaaaacacagtctcctgcaacaatgtgagttactaatgagtccactgcttcctcaatctcacacaacattctagacaaatgcctcagccagtgctattgagtgacatcagctcacattgcaatatattttctgatgtgtataataaattacaaatacttaataatttatcatggttgctttgagagcatcacacagcacttagcatctaactcaaaataactattgcccttctcacaacaaattccaaagccctcatttttctacttactatgctaattaacattccttttaatcttcttctttaatttatcctgtaaattttaaaatagcatcttagaaagaaacttaagggtaatcttgggtcaaccttaccagtgcaggaatctcactagcatctctaaaagatggccataaatgattttttctattctcaagactgttttatgttggttggtaggttgactactttgtttagtttgcctttgctatgagtctttctttagaatctattaagttaattgtggcattcggacatttatttaaagggcagtggaaaccaaagtgtgtaaaggctaatactcctcaatgccaaaagtaaggaagttaagaaaggtcaatcaatgattaaattgtttatcattagttaatataaaataaaggatgtatttttagctgacaaactaaattcaaggttggcactacacaaaaaaaatcacagacaactgaataaagaattaccacagtattagttatttaagacacgttcctgtgtatccatggttgatcaacacacaggattctgagaaaaattattttataaaagcatggtgctcaccttaaagagtacactatcttgctagagaaaatagacatacatattaaggcatattattgcattcaaagggtagcaggtaaataatatacaaatatgcctagagactacaaattaagtttaatgaaatgagttaagcactttcttctctccactttcttggagaggttcaggtcttacaaattaggatatgtgaaaaaagaataatagtcccttatagccaggcaggggtgaatattataggtcacataaagaagaaaaattcaaaagaactctcagaaatgaatttgtgtgattcagattgtggaggcaagaaagagagagatagatggattccctcaaatgtccgattaagacaagattggctatgaaatgaagtagagatctcaggttgtggagttatatcatatcaagaagcagtaagttaagagagctgtcagagttctagtggctgaaacctatccctatccaggaaaggctaaaaccagaatgaggatgactctgatagtgaaaagcccaagattctttctctaaggaattatgtgtgctgactcctagaaagacccatcctctcacagttacaagaatgacgccttcagcatcacaaacacagctgcaatgtggcttagcccccagcagaatgcaattgacagaaacacatttatcttcctctcctccagaaaatatttttaaagggactggattcaaagctacagaaaagcaaggggagggctcctttaggttgtacagtcaggtgcgaagagcaatgcaggcaaatagtacatcctggaaagagttaagaacatagattaaggattggatgaatgttatctggaaatttcctctagtcaggtaaaagctgaacacaccaagctctatgacttggtccagtctctgttccgttcacacttcactggctacttttaactattctctatgtagccttctctgaacccacatttaccaatcccaattaaattctcacagcacctggtgttcttagcactaatcacagcttataggtcaataactctggacataccggctgataatgtaggaggacagtggggaagtcaagggctctgtgctgtggagagaaatgctagggttcaaatcttggttccaacaattcctagttgtaaataaatgtatttcatacctcataatgttattgtaaagattaacaaccagtacatgtaaaggatgcagaaaaatgtctgtcatgtaatatgtgctcaataaatatggggtaacatcatccatggacccatgagagcaggaaccatgtctgtttcattctctatcacctctctgggactagcacaatgtttgggaagtagcagagcttagtgaatacatgtggagggcatgaatacttaatcacttcattctttgctacccattaagcccttgatatatttgttgatacatgtttactgtgtctccttattccccagttgctaggggtaagacattgttccttttgtatgccccacacaactcttcatgatgttgatacttaaacttaaccaagttctttcccaaatacttaaggagtcagatttagagaaatgtggatggaggcaaaatcccctggagttctcaactgtgctatcaagatgcttctacattataaaatggatataaaaatacatagctctagtatatatttaagaaggcaaaaaaatggtttattcctctaacttatcaactgagagtctttcagccacaaaatgtaattatttagccccactctaaatcattcataaaaatgttcagtgatgggtctccacagcatgcttatgactttttaaaattgattttaataatggtgtacatggaggttaaaccacagagttaaaaatgaacatactggcaatatctaagccagagaaatagcaatacaaaaaaattgaaaggcaaatgaataaaatatatcttcaaatgactggcaatattaaagtcaaaaaacattaaatagtatgagattacacttaagggtcagagacagaaatctcagattctttgtacctgtagttagggtcaaaagagagacagtaaacacttacatgggtcaaatgagacatgggcagaaactagaatggctggttggtaggactggatctaaaggaggtagtcttttctgtgatataatttctagctttctgagagagtctttgccttcataagcaatattacttagcataaatctcacagttagagcttaatttctttgactaagatagtgtatgtttctcaaagaggaatactttgactccttggaggtttggagccatgtgtcaaaagattgtgcaaagccacaggataaacatagcttattttcctgcaaattatgtttttcttaaatattggaagcatagggagatgaacgttttaactggtagtaatttagatcattcgtttatttaacaaatgaataaattatgctgtagaatgcaaatcttgtacatgtaaagaatgcagaaaaatgtctgtcatgtaatatgtgctcaataaatatagggtaacatcatctatggacccatgagagcaggaaccatgtctgtttcattctctgtcacctctctgggactagcacaatgtttgggaaatctcagtagaatgcaaatcttgcattctacatttttaaaaacaaagcatgaaactacagagaggcatcatgtttgtgtagatcactttagggtacctagggctttaggttgaagagggaaacttccatggcaaagacgcaaaaacaagagggaaaggaaatgaaggacacaaagacacagttcactgttttggctgagacccagaactccttagctcagaactactaacagcaaaggtggcagagataccatggtagagtctgcaaaatgcaaacttactagaactggcaatcttcaacacctaggcaggatggcagcaactaaagctcacaaaacactagaaaagtatgttatcagagttgaggagatgctatgtggacatgggggaggagaagaacaatttcaaggtctgaatgagacaaaggccagagcatcagatctgcagttacttgtcaactcactgaatggtgagggatgcaaaggcacaggtgtgcacactagcaaggttcagaagtgaattttgacaattgtgtgttagagatgataacagttcaactgagatgacaaggaaattgcttatagatgtccacatgaacttaccacatcagaaaacaatacatatgtatacctttgaaaccacattttccaaccctactcactttcccaggcttgatgccacctctgtgttttcctcctcctctcatcctaaataaaccttgttcctcaatataaactcagaaagcagtttcgtctataggttcagtgttttcaggggcagcagagattcagacagggtaagctcatcatttttacctcttcattcaccagcgtaagtgtgcttgctctcagacaaacattaccactaccaagcctgaattactctatctgggctggcaacaatggcagtattaagaaaagataaaaaccatctaaatcatgctgcttggaactagttataaccacctttccagacacacagatacgtttccatgattaaagtataatgtggttggctgaaaggaactcagaaaatgatcgatatttgaacttaaaacgtttgatcacttgtcctgtgattttttttcttaaaactcaactcacattgtatttgtaagaacacagggaaagagctgagtaacaggacctagaggagatttttctttcctatcacttttcatgatggataggctccttaggaaagagaaagtatttaagggcttgccacgactccagtcatgttttaacctcattttataacccgtcaataggattgtgttacagactatctgactccccccactatccgctgttcactctcccttttagttatagaattccctgaattttatttaggcaaatggctatcccactggagactacacctccctacttccaacagccttctttgcacctcggagtggttaaaggactaagtcttggccaataaggtataactaggaaggatgtgtatacctttcagctcatgtttcctaaggacaatgttcaccctccactttctctcccacttgccccttcctgcagactggaatgtgagcaggattgtgggagccagtttcagtgctgcagctgagagcaacccccggggactcagcagagtaacaaacagaaggaatcggggctttctctaatcaatgttgcagagaagaagtacccacccatcctgggccacctacccaccttgattgagaccattgggtaaaaaagaaagaaatttctagcttgtttaagctactttcacaaatctctgttacagcagtttagcctgtattctaatatacagtttctacctagaagtgggtattgccataacaatatctgagaccagggtcacaggctgtaaggacagagatacagatattgacagctggaaagctgaggactcctgctagaaaagccaactttttctgttccccaagcagtacaaggtaagactgttgctcagagcatccttcaagaatctcctatattctcctaggccacacaatggcagccagttcaaacattcaggtagggcaggcctggatttcccattcgagcctattgcttcagatgacctcaaggaagaagcccttaaactgagggagttaggagtgggctaccaaaccaataaataagctacaaagccaataaatcaaaaggtagttaaaaactacagccaaaggctactttaatgtggaactggaagcagacagactggaatttttgcgggtattacattgccaaagaaaacaaaaacctggctgacagagctagtgactgttgaatcactaaaccaaatctcaggttcccaaacctgcaccagtagaaagcaagctgtacaaggagggaagctaccaatgagggcatattatctaacacccaccacagatgtggccacaaaagacagaggccatcaaggacaatggacagggagttatacccagagagtgagtttggattggccaagatgacctaataaagactgccaagtagttcttgcccagagaaatgtaataacaacaacaacaaagcgctaactcctactgactagattatgctgtttgcctcctcctcttttccctttccaagtagggatttcatggcagataacttgtcctttagtgccggggtcactggaggcacatccaccctgatagagaggcctagacatatcccagagacctggactctcagctgggtgcagtaaataaatgggctttggtttgcctctttgggaagaaggtgggcatatcctctacgtgggatgaagggtaggaagggatacttagatgctagggagacaagctgtgaacagagactattcattatctcccatgtccattcttctcttgtccttttagataaggaactaccagaaaggtggctcagtaagagcctacatttcataaccccctcttgtagctaactagacatggtcatataactacattttggccaataaaatatgaattttagccaatggtatacatgtttataaaggaaattttttgtccttaactttctctgtcccttccccttctctgtcccttcccccttcccatgggccagaatgcagatgtgaaggagggtgccaccactgagcacatggatggggacagttgcctggggatgcagagcaatgagacagaacctgagtttctggtgacttcatggagccaagctgcctaccctccctgaaatgccttcctaaacaacatctatgttgtttgaagtattacattttgacatctaatttttacagctgccaaacctgtaccctaattaatataggagaaaattggaaagcaaagtggtttgagtgcaaagtctatatattgtgtatacatatgcatgagctaaaggtgaggacctagaaactgtcactttagaaagaagaggtggttataagataaagtagtaagtgcattaaaatccagcattcctcaccaaagcatagctaagaaaatccatttgaataagtaaaactatattcaacttgaaaacactttatcttaaaaaaagaattgtaaaattaagacaattttcttctttttcaatagtttaaagctaatagtaaaatatcacttgatcaactcaagaaggaatcccataaagttatctgaattgataaatggttacatgtgcaaatatttagtaacaaatatcagaaaataaaatcacatagtatacaggcagttaagtgctctgattctgaaaacagatggatcgtttatacatcctagttctcccaattacaggcaacctgaccttcagctacttacctagactctctaagcctcagctgtctgtgcttcagtttcctgtggatcaaatgagataatgtacaaagcacttggggcaatgcccagttcatagtatgatttcaattaattttgtctaaaatcattgccacctgattgtaaaaatatctctatcaatcagaagatgggcatcttaaccatcattgttctatgagactgacctctttctcaggttggcaagccataaaatgcccagtgccttgagttttaatgaaagacaccaattcaatcagggcattcactcatttaccatgtgtattgataccttagcatgaaaagcatgatcaatgtgataaaataaaaatatacttctaggtttgagaagccaattcccatgtcacccttatttagctgagtccacctaaataagaacacccagtctttgaattatcactccctaattgactgatattggacaagtctccacatatctttgagactaggtttcctcatctataacatggaaaaacaatatctccctcatgggttgctatgggtattaaatgagaaaattcaagcacctggttactactatgcctagaaagagtaagcattcagataatggatgacggaaactttattactgctatagttatggctacataaaatagttaaatacctcatcataagaaaattgtgcctgcatgtatttgagacccactggttgtagggtaaatgctttgtgctatctgtctcatcatactgatggcccatactgaccacacatattcattctctcccaatctcagtagataccaaaatgctatttttgcaagcctgttgtccagagatgggatgtattcatgaaacacagacttcctccactctgtgaagtcaaatagcttgcatgagattgcatccacaacattgtttcttattagtgtcacattctgttcaactaagttgaccactgcaggctaagtgataattacagcaatgtgtgtcatccagtatcctccaaaacttaatgattttacaaactaaaagtatatctgcaaagaaaatgttatcttaaccttcagggagctgattgggacaatcagtgtaatcattttaccaaacatccagggtggaccaggggcctttatctttcacctgtaacatgaagatgaatctgaaactaaagcacatgcttgaaactgaagggaaaatgagtctttttcttttccggattaaaatagaaccttcccactaacccccacctgcaattccaattatttatcccatttctatcagggcagaagctatttagcatggcttatttaatccattgttttatctttattttttaaataatcaattttgccctggctaatgcatttacagtgtttcctcttgcaggtttctgatatagtcaccacccaggtctgacctagttttctaagctgatttttctcagccatggagcctcttgctgagtggcttcacagttcatctgcttccattccctaatgccatggtccctgagaccatcttggccgcatatggtgggcactcactggaatggttaaaattgctaccctcttcactgaggcctcagaggagtatgtaggtccaactcacactgctcagcagtgtcagagctaagaccagaatccatcaactttgttgtcaccatgtagacaagagcccttgatcctccatcactcaaaacaaaattaaagatgagctcccaattgaagtgttctactggtaacctcatataggcacagacttattccagaactcctggttatgctataatatcccttgctgtcttctatgattgtcatttggggtcaatttgttgttgttgttgttccttctcttcctttgaggatgcttttggatttgtccagctggattgtttggtccttggctggttgtcccggctaagagcccagcctggagccagtgcccactgtgtaagcaatgcagatgacattgtcgaaaaagggactctgtagagcattgtttgcttagttggcccctttctagctatctgtttgcaactaccttgataaaaaggtgctgataatgagggacagagttttatacattttagttaatcatctccgcagcaggtttttatacaggatggtgatcaatgttgaaattctacctatctgcccacactgactcattagtcatgagcatttgtcatcatacatggggacttcccagtgccctgcactgctttggccatgtgcttaggaaacactgggccaaaggacatctatccagtggacgttttcaatctcagcagaaacaattctaattctgcacttcctgaaataaaatcttgccataatcaaagcaagaaaattaaatcccttcctagaaataaaatatacttatttgaaagtgtttcaggccttgcgcggtgactcacggctgtaatcccagtactttgggaggccgaagcgggtggatcatgaggtcaggagatcgagaccaccctggccaacacagtgaaaccccatctctactaaaaaaaaaaaaaaaaaatacaaaatattagccgggagtggtggcgggcacctgtagtcccagctacttgggaggctgaggcaggagaatggcgtgaacccaggaggcggagcctgcagtgagcggagatcgcaccactgcactccagcctgggcaacagagcaagactctgtctcaaaaaaaaaaaaaagaaagaaagaaagtgtttaattagcagacaagttcgtgtcatttttttaaatagttaacttttacttccagaaaaatagcaaacaagataatactcaaatgcaaccgtggttgcagaatctataaacccaaaagtctgagagatttacaaataatcaatattataaacaaaaatcacatctacctagaaacatttcttttaaaaaaatctgctggcaagtccctccactcttacctcaggtgggccataaatattttcttccaaatatataggataaccagaaactttctctttctttaaacaacaaaaattggtttataattaaaatgcactttggcatacctttctgcaatattttcctcacttgagttggagtaaaaacttgagagaattagcaaagcctgttaacctcatgaattgggtagtgaatttggcaaggtgacttctccagactttcaaaaagaatcaggcaggaaaactactttctggatgttttgattacatgagcaagcaaatttccaagcatctacactcccaataatcaagtgatagtatggaaggccatcgttactatattgagaacgtacctattttttaagtgtcaaaactgcccgataatgaaatacttgccgtgtggtccaagataaccacctggcaggcctacatgctattattttttttccattctgcatgtcttttgtcctctcttctttatatcacttgcccacttcagactatgaaagttgcttgagggctgagcccatattgccaataattcattataattggaagcagtgggtgcttaagcactcattacctgacaaggaacatcacagtaacaagctcagtttagaggtcagtgttaacaaggccaaggtcctagacctgagatgggtggatgtggacgtttgctctgctccatgacaataagccaaataccttggtctgtgctactgctcgcccggcatgcagcagggaggtgcagagcatgaggagtatgtgaatgtcctagtccaagtccccagtgcagctaggattggagaagtataattaaatattgctcagcccagaagaatcagggtgtggtccaggtcagaaacaggcagagtgaagatgagactcaccggtgctaacctttctttcctttgctaacacattcaagtgacagccacacttccaccagtagcacagactcatgagaactggtcattaaacagagagtactctcactgggcaggtgaagggggatatgtccattattgtgagaggttcatgttttgacaaaaggatcctgatactgatacccaatactgagttgaaattcagtcaagtagagcggcacatatgaatcacttggggatcttattagaatacaaattctactcaatatgtctcaggtgggacctgactaataagctcccaagtgatgccaaagctgctgggcctttggctctctctttgaaaagcaagattctagattttatcagatcggcaggtgtaagggaatcctggaccccatgaaactggaggttcagaaacatctgaagaaactgacaaattactaatggtcagagtcaccaagttttcaggaatccagagatcacaccagtcacaatcactcaaaagatgccagaattcagtcccaaccagtgccctgggtttctgagtcccttttttctctctccactacccagagcaagcagccagggactgtgggacacatggcagagccctgatcttgtgggcacaggcagatcaaagtagctaaagatgatgttaaagagacaggtgtggtaggcaccaataggaggctaggaagtcaaggtcctccaatctcagacccctgtcttaagggtaagatcaaaggctggcacaaaacttacagatcattttatacaaaagttggtatatgcttggggccttgtgggacatcttctccatatcaaatccattaaatcattggcccagactccatttgtctttaacaggaaggaatagctcttggggtgattcaaggtgaaaccttatccatttcttccctctctctcattgacgccgtgtatgtgcaaggtggtgaggcagccgaaattaggactatagagtccttcatgttcacagaacaagtgctgcaaatgggtgtgagtcagccttgagctcaatcgagagtaaacagacaaatttacattcatatatggatttagacatttgtcaaatatttgctaaaagagcatttcacttgtcgaaggaaggcatagccttaatatttttctttctttctaaaggactcgtttcacccacgtgcttgatgaaagtttaaatataaaatgcctgagatgaaaatgtatattaatatttttctgtctttccaggtagatctgctgacctccttcttgtgctaaatctattaacaagcaaataaagctgaggtccttagatcagtactatagccaagagatactaatagtacccatcaaaatcagatgttaagcctgtccagagagctcctggcaacctgagagactaagctgacatgggcattcctctgaccaccaacaatggaaaacaggatcaaacatatccaaaataaatcttataatgtgatctgaaattaagagaaagataggaggttctcagaagccatgaataaatacagaagtaaaagtcaggaatatgaggtggacctgggctgcatgcgacatcccaaaggtgtatttttcaagaatacaggccctagaggctgggcctggagtcctggccttgggctgtggcccagcagagaacctaaactagatacttgacccatgagggctgcacaggctttgaggagaggattgggaaacccccaacgcagcccagggggctgaagcaaagcttagtttctactgtaaatatataaattattaaagatgttaaacagtagtcaaaaagaggtttagaagtgagatttgccagaatccatcttaaatttcaactgttccagaatatagaaaaacaaattagccaaagtttctgttatgacctcaatacccaaaagataacataaactaagcaaaaagagaaaccacagactgaaagagaataagtgaatgtaggtaagacacagataactagtctccaaaatacataaagaacttacaaaagtcaggaaaagaaagccaaacaatcccatataaaaatgaacaaaggatatatattaatacttcactagcaaaatgattctaaaatctagtaagtagattaaaagatgctcaacttcaataataatcagagaaatgtaaaatgactaacaacgtgatgtcatttcacatccaccaggttgagaagtattaataactcaactgtgagttaagatatggggaagcttttatatccttctggtgggtgaggaagttggtaccaatcttttggggaagagaatgaaaatatctagtaaaggtgaagatgcagaggccatagatctataaattacatgtgtagatgtttactctagggaaaccctgacaaaggtacacagggagccatgcaagaatgtcccctgcagaaatattcacaatcgcaaaaaaatacaaaacctaaatattaataaataagcaattaataaatacatggtggtatattccaatttatagcattttatttctttataaaaggaaaatctctatgttacaaatatttctattacttaatcagagtgatggatatagaagtttttatttgtgttttctgtattttaaaacattattttatacaggttgagcatccctaatctgaaagtttgaaatccaaaattctccaaaattcaaaactttttgattgccatcatggtgtcacaagtagaaaattccacacctgacataagacaggttgcagtcaaaacacagtcgaaactttgtttcatgcccaaaattgttaaaacatactgtataaaactgccttcagtctatacatataaggtggacatgaaacaaatgaatttcatgtttatacttgtgtcccatccccaagatatgtcattatgtatatgcaaatattctaacatttgaaagaaattgaaatccaaagcacttctggtcccaggcatttcagataagggatatacaacctataattaacatttaaataaaaatatattataaagtctacctagagctatacattttgtcaagggaagttatatctccccatccctatgtagagatgcacacataaaggcctggaagaatacacagaattattaatagtgtaacttagggaagaaagtagaacagtagaagaccaaagaggaaattttccctttactctgcctaattctgtgtttttcacatatttatgaacacatattcatgtgttcaatgtgattgcagtgaagcctcaattaatgtccttcctacatccacaccctttgccctgtaattttgcattcttccttctgattctggctggccctgtgagttggtttggcctacagaatacaaatgaaatgttgatgtgccaactacaaggttaggtctcaagagactgtcatggttttccttgatctccctcttgcagttagacttaaacactcttagaaaaagtctggacttggctaggcatagtggctcatgcctgtaatcccagaacattgggaggccaaggcaggaggttcacttgagtccaggagttcaagaccagcttgagcaacatagtgagacccccccatctctacaaaatattacaaatgtagcccagtgtggtgccacctgtggttggagctacttgggagactgagatcagaggatcacttgggcctaataaattgaggctccaatgagcctgagctgtgtgccactgtacttcagcctgggtgacagagtaaaactcagaaaaggaggggaggcagaaaaggaaagaaaaagtcaaaagaaaggaaagaaagaccaggacttgccagctggatagtgataaaccatgttcaggagaggctagttatcctagccaaagctattctataccaacctgtagatacaagagtgccaagtcatgatcaacagatctgcctacctgacccacagtgactacagacccaaactgagaccagagaaatatccagcagacctataaactcatgagcaatagtaaatgcttattatgttaagccattgagttttgggatggttttgttatacctcaatagttaattcatacattcatcagatgtaaaatttttaagagtggaaaacaggtccatccatttgagaaaaggtgacctgctgattcatacctagacacaatatataacaattccaagcctttatgattcatgtcatcattagagtttgacatcagaacttgctctatattgcccacacactgtccagtttcttatctggaagatgtgtccttcatcttccatgaagctggagccccactaactgaggcttaagtgggttattttagcacatcttctagcatggtgtgtcatgtcaagtaccctttatgaggcttcatttactcttcatttaccctttgtgatgctattcaaattgatgtaggaaaaaagacaacaaacaacaaattgtccattaacttgtgctgcatttggcaggaaagtccaagccaatatgaacataaagagtaatcaaaggtgtttaatatgtcattaagtattctccgtactgagccaactgtgaaacagaagcttggagagtaacattaatactttgccccttgtatatattatcagtcaatattattcaacatattgttttagttgtagagatcaaatgcttggtgcagcagaagggtacaaactggagactccagaggctgcattctgcttcagaccagtgctgggattttgagcaagtaacttaatttatattttaagtataacttgtttatcttaatgtatatatattgtatatatatgcacacacatacacacatatatatgtatgtgtatatatatacatatatatgtatatatgaagtaaagaggctattggacttatttcttaggttcctcccaatatgaacattccaagagcctgtgacagtgaaacaagccccgaggccttcctatcataaaacaaccttttcattccattttggtctccatagatttcagtgtcctttctctcagtcgaaatcactcacttcaaaaacttggactaacatcaagattttagccagaagcaagctgaaaagtagttgccattggagactccttaatacctcattgttaaactggctaatggtgctctaaggatgagccgttagaggaaatggtcaagatcttcatctcaagggtgaggaagctaaggtcctgaaaggtcctgtgatttgccaaatgtcagacagcatcctagcaaagagggtaagttctacttttaaggtttgtgattccagatccatccgttaatccactcatgtaagatttgtcgaacacttacagacactatgctaggcgctagggatgcacagttccaagacaaacctgttgccctcatggagctcacagctcggtggaagtaaaaaataagagaaacactattgaatcttgtcacacatgattagacaggaatttatgggatgctctgagaatccagaggaaagaataccttactctgcatgaagagacagggaatttttcatggaggaggatataattgagctgcattttgaaaaataaggagttttgaggcacacaatacataagaggaaagggcacagaacacaggacatgcaaaggcatttaaacacacaaatgtacacacagatgtgtttgggagactgtaagcagctggatatgcttccatctaggatgcaggctgggaatgtcaggaggcataaaggaagaaataggcaagaacagatgatgccaaggaaaggagttttgacttttgtctagggagatgaaggagccactaaaagacaggtagcaggcatggctatccttgctttcaacagacagcatgtccctaaagaagagaagatgagaggacccagttaggaaaggaaggatagcagtgggcggctagtccgtgcctgctgctctttcctctagtctctgttggatttccttcactccagcctcaatgtgccattcatcatcaatgacgccatcccctggggaagcgctgtagacactcgggattctcagatgggccagcccaaggaccacagcctactgccactcatggctggctcagtgcgtaaatgctgtcctgaacccaagagaagcatgaacttgggggaaccccagagacccacagtaagattcaaccacagatgagtgtggttgagtgacactaaggtagtaaatattctaacagatataggttaaatttcaacaggtggtttactaacttggtaactgtgtgacttcaacaaggttatttcacttctccaagtctgaaggtcctcacctatcaaatggagataacactaacacctaccttgtatcctggatttattgaaagaaattatgcaattaattatatttcatctgtgcattcctggaacatggcaaatactcagtaatccataattataattattaacatttagcatcatgcagtcaagcaccttgcctatttctagagaagcttggaacctgagacatggtcctaaaagaactctcctcaatatcacactcccattctctcccctccagagacctcgaagacaaaacattacatttaaaggcctcttccctgatccacagcagcatttcttagattcttatgaagcatatttaggttaagataaataaaatatcagatctacccttggagtagctaataaaaaattttaaagtgattttcttccttctacctccaagaagaccctcttttaaaaggtgcaatgagtaccagaatcaaaatatatattacaggtttatttttcatatggcaaaagcagtatgcctatctctgtcctcgaatatctccatggttttgtgagttaagaattggagttaagaatgtccctttagatggaaactttgctgaaattttatccactcatttattgcccacatgagtttaaaaatgagaataaagctagatcttttacatcactggaaattttcttatgtctcagcaccatccagaatgttggcaatattaacagaccagcaatacttcttgcataatggagccagaggaataaggaagggtggggaggaggaagggagcagaggagagctttgggagactttccctgactaattcttcttcaaaactgtgaaacttacaatttctaaaaaccatagtcatgatgaaaatgcctcctttaaaactgcagccttagaggaagcctgtaggcttctgtcgagtattttagatcaaagacgtgggtttgaagttgaggttaattccctcactttgcagtaccactaaaatgaacatcacaaataaggcctgaaaagcaatggctcgattccttgaattaactctatcgtttctaggtaagtacttggaaaacactgcatttacaaaatatatagctggttgaggacccaggtgattcaaacattaaaatttactgagatttctgcttagtttgcctgtctgcttattcaattttgtttcacacttgattaatcagaccttaggttgaaatagccaaatgatctgatagagctttctggtaagaagaatagtactgcagaaaaatattcacaataaaaattgagatgaatgattcaggtatgtggaatataacattctgtttaaattatacatctgttgtcaaaagatacatactttgtaaataagtatagaaaattatctggaagaattggtactagtatattaacagcaactttctctggttagtaaaattggggatcattttcattttatttttatctatttctctctctctctcagtatcgctttgaaataaagacagctatttttttaattccaagtgttttcaattgtgtatataaaccaaagcatcaaaaacttcagcttagagtaaaaattagtacatttaagagcaattggaaacacaataatgattatagccagttttagcttccatgttccataccccatgctaagcatttcccatggcttgtctgtaaccctatgaggtaggtattcttatcattcctattgtataaattagagaaacttaggcatgaggatgttaaataacttacccaaattcaccgtactagtaagttgtaaaagtcaaaaacttttggtggtccagaccatctgattaacttctattttgttctacctggattgatcctaaatgcagcagctacatgtagcagctttgtccaagtcttttttttttttaactgtcttattcttgcttcttttataataatattaaacttccttagtctgttaacgtggcacacctatctgcaagggaaagtggtacataaagaagatattgtcatatatctccaaaatggagtacaataatgctgtaaaaaagattaatgaagatctctttgaattgttacaggctaacttccaggatgtactgttaaggtaaaaaaagctaagtgcaaaagagtatctatattatgttactccttgtataagaaaagtgattataagaaaacacatacataactgcccatttgtacaaagaaaatatggaaggaactcaccagaaactaaagaaactatctacagagggcaggtgtcaaagagctggaaagaagacggaaatggttatgtgtatcaagacaggatggagtgacagatactgccttgggtgcatcattttgtaaagctctggctcttagaaccacagttatgattcatatttttcacatgcccctaagcaatcaacaactaaaactaacaatgatgaggatccaaaatgcaatacaaaaataacaaataagcctgttacaaatgagttacaaaactacactgaaaggatggggaatagtaacactaacctaaataactacagaaaacagtatcttgactggataccatgaagctaaagacaaatacaaatgcataaatgctagaatttagtcagtaaatatgtttctcgcaggggcataggatagcaattctaaaactatgtgttcactagaatcaaacaaagaagtaaacatatcatggaaaataagcagatttctcactatttgagaaataaattacaaataaagacaggaaaaagctaaaagtgaaccctgagtttacagtatttagtataaattgtatagtacaaatggctttaaatatctatatagacatatagataaagaaatatagaggtgtgtatatgtgcaggttattcatatgcatatatttcctggctctgcctgctgagaaggcttagagcaatgacatcccagtagtaataagcacatctagcatgaagatctcagtttctaaacaccattctctgatttaaaaaaaagaaagaaagaaagaaagaaaaaagcttggacaagtgattgatttcaggactagagcaggaggaaaaaaataagcttagaatatagtgtgaagcaaaaaagtaagaaagtgttcaaaaaaataaataagggcttaataagagagcacaaacactaaatgaaaataagctcctaacagccaaagctggaacaaattaaacaagttaaataataatattagaatatgacccataaaaccaaataaatatatataagttcatacacatggatataaataatctattatctaaataggagagaaagacagctcttccatggctgtagaatcccaattaatacatgttgaaagaaagaaggaagtggaaaatcaccattaagcaaacaccataataacaattgtaactagaatcaaaatccatggatgtatgctgaaatcatttgttcacagtctaaagagaaacaggatttgcacagtcttaaagcatgtcccccaagatctttcttaacagtaggagaaaagatactaactataaagtggagaacccagcagaaaccaccttaatcaagtggtcatgatcaacaccaccactaataaaaaatattggcatcacaaatcccatgacatgatgtgctgagaagaacacatcatttctgtggaattcttgccaaaaacacataacctcaaaccaagcatgagaaaacaccagacaagcccaaattgaggggaatttggcaaaataagtattctatactcttcaaaaatataaggtcttaaaagttaaggaaagatgagaaactgttacagatttcaggagactaaggagaaataacaacaaaatgtgacatgggatcctgaacagaatcctggagaataataacaatgaaatattgatgaaaaaactggtagaatttgaataagatttttgtttaattattggtattatatcaatgttaatttctgggttctgataattgcactccagttaagattttaatactgagggaggctagggcagggatatgtgaaaattctccgttccatttttgcaacttttctttaaaagtagtttgaaatttaaagttaaaagaaaaggtattgcctttacttcaacataattaaaaatgctttttggaaaagtaaatctcctttgaagagaaagaccaggttgggggagaaaaaaaccactgatgtgaaaattataccggggaaaccacactttgttaagtttccacttttggatacttatgatgacttaagaatctatatcaacaattctgtcccttgaattcaacacactgaggttttattcctcagctataatcgatcttaatttttcagtttcaacagaaagacatctttccctcttgcaaagaccgtggccttaaaaagcttttgtcatttctcagttgtttgcaactccaacagtgaaataccgccactacatttgatttttggcttaaagaaactctattgctaagatggacgacttgggcagtgtatttcacttttgtttgctgatgtgttgcatttatttgctttcacttatcaagaaaagagccaagtttttttttcttcttcttctttttctactcctccacctcattctctcctgtttaaccatgtgtgtcagaaggagagctatcaaaaggaagctatgcaagttaatcagtcagggcctgagagtgcccaggaaccgtttgttacaacagcaaagggaatgaagcctccaagcaacaaactaattaatacctctctcttctttgaagaaaatgacccaatattgaactccagtggattatacaacattttaatttactatctgctaaatggatgactactttataatatgcatttctacttattcatttactgacaacaccagtagtcattcaaattgaaccccctggccaaggtctaagagaaacctaactaggactagaagatatttaatatacactattatatactcatgcctcttgtttctaccaaacgagatgccatatggaaagaatgttgcacaacgctggcacacagagcagccaggaacttttccttgttgctttcttcttccctgcctctacttctcttcatgttgttattggtaaactgtttgctaagatgtactttccagataacaattcagaaaacaggtaggagacacacacccttagaaatatcaaaggcaaacttccttggaagtcaagtgaaaaactgctgaggagttaaaaaggcagcatggcaaggtcataaatctcactttattgccagtcacggggacatgaaaatctgaagacccttaagcctttcccctgaatcctaagacagtagggctacatgccctggaaataacttctggctcaaaatggactctgcaaataatccaatgtgttcctagggttgctaagtctagcaaatagcaatatagggtgtccatgtcccaggcgatatttgggacatacttatactaaaaattatttgttatctgaaattcaaatctaacctgtattttaattggtatttcccttcccccttatgagaaataggtgactaatgctacaatttaatttccagacctggacttttatatagattcattactttctaactgtgctactgaagcaatttaatgtccttactgtacatgtcctcatctgtcaactgagataataataacaataactttctcatagagtggttgtgaagagtaaatcaaataatctatacagtacctggaatatactatgtattcaatacatgcttgcttttattgtaattactgcagtattactgtttgcattaaaaatatttgttgaaagaggaaacaggttaataaacaaagtttagattttatcggaaagacagtatctttgctaagcaaggtagagaaagaagaagagtctgtgaataaattaagaatctctaaattacactgtaagattttcctgtaatccccaaataataattactgtcaggcttcagaatgaggagagcttgcagaattttcttgcagtgttttacacatttcatttttcatttcaattcagaataaaaggcaaaagaataagagtgaaacaactaagataagcccaaacaaaaatgaggaaaaggtgtatatgtaaattaagaacacatttattactagccttttttaaaaaaggaatgacagtgacctctagtaaaatatttctgtctagaggcaagattacccatgcctggataacagccaatgtttaagctcttctcttagaagtgtcctatctacctctcccaccttcatttcttcaagaagtcagctaagaacccatcaacaccaatacaaaggctgtaaaataacattttcctcttggctggatgcaaaaactagaactgcagaaaagttctcaataaaaattgtttgaatcgctatcaactcattctttctgctgactaggaagttaaataaataaataaataaaagggactccaagtcaccagttacgccagcagtttgcaaaaactattctctcttttgcaggagcaagggtcaacataaatgatttattgtctttatagctagtatttataggtatttgagggtgttccataggctcaaatgggttccttttctttatctggcctcaagagattaattattcctgtcaattcaaatctatcttcctgttaacaaatcccaatgggtcttttcccctactcaatcagataaactccagattctaacattttaatgatttttttctgcattacagtgctgcttaattgtatagtgtttaaagaatatgtggatctcgataggagtttttttatttccttaataagagagcctgacaactttgtcaacttaatgagtacacactgatgtttgctatgggggattttcctagtgattataggacttcttttctagagatgatattcccattttaaatgtttttttaaaaaagaacttggatggtcaagttcaagagtgagtaaattaaatggcaccctttgcacatgtatatgtgatgtgtccaacagaaagcacgaatttgacgtgtccaacagagagggaccaattttggtatattatcaactacctaaaatataaacagcactttaaagctttgggaacaaaaatgtatatgtaaaatattttaatctatgtttatcactctaaaattgggatactgtcagttttaagaaaaaggagaagaaacatgcatatatgaccacctttaatgtttgaaggtgtccaaagaggcaatgatgagaaaaaaagatcatgtattgtggaattacaaggatccactatatcacttactattatattatttctctgagcctcagtttcattggaaaaagacaaataaccaagcctatctcaccagttttgtttgattacacacagcattatgaataagaatagtgtctgacagtaggtattcaataaatgctaagtttcaatttgctctttttcaacattcccttttttttattatactttaagttttagggtacatgtgcacaacgtgcaggtttgttacatatatatacatgtgccatgttggtgtgctgcacccattaactcgtcatttaacattagatatatctcctaatgctatccctcccctctcccccttaaaatgaagagagaactgaagaggctacaacttgacttctttattattttctaatactttcattattaacctgacaggaacatgaacagggaaaaacaataagcacaaaataggaagagatcaatagcttgtgatgagaagacatgaatcttgtcagaattcagcatagaacacatgagaagcaaactttattctttcaacttacaaaatttatcttttcttctgataatggaacatttcactcaatacagagccgactattaccatgaattagttataaacacagatgtagaaaaagaaaaataatctacgcaatgaaagaccttctaatgagtacatgaatgtttttcaactctaggtaacaaatcagaagcccagggacaggaccacggtgtgaacacttttttaaagttccacagctgattctggagcctaataaagttagactactacactggtacagacatagatgctgcaatgtatctactacattgatgtagagggagcttgtgcctggaaggtaaggaagatctcaatcacagagttaaaaaaaaaattaataagcactaaagcatggtaactgaaaaaaaagtcaaaaacctttaatataaaagtctcttccactttcccccaacaattacataaccatgaggtctcttcctgatggcagcagcagcctgtctggagcagctgtggcagggacaccagctgagtggggaaggctccgcaggaataggtgggagccccatcccctaccgagttggagtcccatgcttctgggcgcagctgcagccacccagctgcagctccagactgggcatccctgctctctcaggggcatgggagtaccccacgacccccgcaggctcagaagtgcctgctcctgatccctggcctctctctgctcccagcaccggctcgagtgcagagtaaagttgcagctgagcccaggcactgttgcaactcagctgggtatgcgtgcactgaaagcagcactgacatgccaggcccctgctgcctcagccccctctggactttgggcaccaacaagcataggagggaggctgggggatggcggtggctcagtgtgggcctgcaggcacccctcggcatgaatagcctgggtaccacgaacagaggcaggaagcagacaggctgagagcagaaaggggtggatcctcgcccacttacaagccagggatgccctgaagcccgggggcagggctgcccattccaggtggagtccgcagccagaagtgacaacttaggtcctttttctgggcccatccatggccacccatggaccaaccagcacacacttcctcccttctgtgcccataaaaactcctggactcagccagtcttagacagacattgggattaccaactgcaggaaggagccacctacttggtgtctcgggtctcaggggtctcctcaacttgttgaggtgacctgcctgcagaaaggagctaccctcctgagagctgctttgttgctcaatgaagctcctctctgccttgctcatcctccagtagtccacatacttcattcttcctggatgtgggacaagaactcaggacccaccgaatggtgggactgaaagagctgtaccacagacagggctgaaaaacgccccccactcaccacattgcaggcggtgagaagagctgcagcccttcggggagcccagacctaggggctccctgagccaggggctctgcagttcctagtgtctccaagctttcaagtgccaccacgttccacttgcccaaataccagtgcccacagcagaagccgcttgcggtatgtctggtccagccgcagccttgcacagagctggcgcctggagctgcctgccccactgcggcagccagcgcgcctggctgtgcgcagtggctggatccaacgctcgcttgttcacacaccccctgccactcctcgcccggcccgcccttagcaggtgtgggatccagactggtagcgtgggccgagctcagcctatcaggacaagtgggcataacaggccctgtgggagcaagtaatactcaggcagaaggcaccacccaccactgaggcttccggctggcaaagtgacaccccaaggatcctgtgacattcccttaaagaataatctaaagggaaaagatccaaatctattattatattaagggttttctctacttcttccccgctctcaatctcatgtgcagatataccaaataatcaacactctacccagtttatttcatatataagtacattcagtaaagctgcccaatgttatcaaaactgtgaggggttgtaaccatcacaaaggatatacttaaactcatatttcattttgttgactctctaacaagcttcagaaacatggaaaaaatttaacctgggtagaaggaaggagaaatctggaagataaaaggagatgaggccaatgagctttaacagagtaaccctgggaaaaagactttgaagcagagagtgaagactattagctgtaatacacagggtcttgtgaatccacaaaaattttaaagactgacttggtagaacctataattgaaagaaaaacaccacaataataagaggcaataaggacagtctgcagagagtagtgcccaatgctacaatactacagaaagaaaactacaattgaccaaaccagacatggaagtccccgagctaaagccacattagagaagtagaagagagggatagaggagtgtttagaagcaaaatttggcagcagtgaacttgaggaataaaggagatgatttaaagactatttttgattgcttatttgagagataataacactgtacagggtttagaagtcatggaaatttatatattcatcatatttagcttgaacaatggaaatgggactcagcttttgcaaggaaaatgtatactttctggggttgacaggtgcagagatttcaagcaaaaagggctaccttcaagggaaaaaaatctaaaactcacctgcaaaaatttgcttaccaattattacttaattatttgcacacatttattttttcctttaaaggaccctaaattccttgtggtctttgcatcccccatgattcctagtaaagcagtaggctcagatatcttgaatttaatttgatcctaagtcataatttgatcagaagccatctggcctgggttctgaagtcagataaacctaaggcaaaaccagtttcatcacttgttagctgcatggcactgaataaattaattatcctctctaaactcagcttcctcatctgtaagagccagttgttgcaaagattaaaagagataatgtgtatgaagtaattattacaatgcctatcaaactgtaagcattagaaagggtagaatttattatttttgttattgagctctttattttttcttcacacacacataatccatagcacctgatgctacacattcatcagccagccagaaacccaggtaaatcaatgaaaaagaaaacgacactaatcaatcttccaatttttctactctgacaagattctggcaactagtggtgagggaaaaaaaagaaatctcctgcaaatatatatcatctttgtcatcaaaacagactcaggtaaagtcacaattagcataagtctgtacaaatgaaaaccaatttactaatgcaatactgttttattcaggcttcttcgaaaatccaggggaaaaaaatactccctctaaaaaacacaattcagatgacttgggttttgaaactatgcagaaaacagaaaaatagttttcattatcaaaaggtagacaatgttttgtttcaacaagaatgaacaaacaataaactaacattatggcccaaagactatactattcttagaatgttggtttagaattgaataaaacttattgtataaagtaatatgttcaaaggagatcctatcaggggagaaggagaggcaatcatctttattttgggcagacataagaaaataattttgtagccttagactaatacctagatttggctttgttctagacccagaaaaactatttttggatgctatttccccagatacatgtaaaaaagatttgaattcaaatatgcaaatggtattggactatgtcattttgaagcagttaagtttttaaaatccaggctattcctgttttgaaagcagtgccatttaatattgttcttttcttgctattcccactttctatatgaattgagtgggatctcaaatccccttgctaaatggtttagcaatacttaaaattcagcaaagaacattcccaccttcaggagacacctctcctttatcattatggatgactgacatataaacaaatgtgatgcccagaactggagtcagttctgctcttgaaaatattcatacatcaaacaattctccttcttcattttcataaagacagttctgaccatattatcatagctaaaggacaaagtgtatagctctcaaaactcaattgatcttagttatctaagtcttactttaaatgaagataacagaaatcctttctctatgtaaaaaggttaagcttgggaaaaaaaagtgaaagattttctggttcatcctaaataggctttggagaaagaattgctaagtgtgaaactcctcacctactgcatttcattgatcaaagggttttgtaaaacaagcaaatgcagaattttgagaggcatttaaagggcttgtcttttggaagttaataccctttgcttaatttatcattgatttccattctcttttcttctcttataccatcaccgtgtgtaagtgaatataacaagagtctcatttgtctagaataaagcttgaattgtttatgctacagatactcatggggcctgtaaactatgggatgtgtgcgttcattctagtcctgtcagcaccatgggatcctactatgtgccacactctgcttaagtggcctgctgctggctctactcctgcctcaccacagagcaggtgctctcagacacagcagatcccaagaacggatgctttgtacatgttctgttttcatactatctctccggcagcatatgagtagaggcccaggagcctgaaggaaagcacttgtgcccatcacaagcctcgtgggaggagagagagaagtgcttatttcttcacacattttttgattggacatctgatagtcaggcaaagctgaggcctgttctccagttaaaggagaatcacccagtactgctgttcctcctctctcaactgtactggttctaagtatttctctgtatccagcatagaggagacttgatccctccaatggctccaactagaaatgaagcagctttctttgctgttgccatgggctcccttctcccctctcctaaccttcttccctacactctttctctcctccttccaaaccctgggaccagaaaaataatattgttcatatatacaatgttcattttaattacattttctattatacaaaactaactgtcctgctcagaatgcttttcaaccttgtaaaaaaaataaaacaacaattatgtgctaagcaatacattttatattttctcccttaacatccctgtaagggtaggtattagggtcaagcaaattgaggcttggatagattaagtgacttggccaaagtcaaacaatcagtagtagagacactattcagaccaggtatgttcaaatgccaaagcccagctttttacaatgcccccatgctgctgcatatggtcaagatgtgaaaagcaaagcaaaaataagattatagcaccaggaatttgttgaatacaaatttgtttcccttcaagcttaccagaaaattatttcaatatatttcaacaaaaaacaaacactataaaattagttaaagtagcttaaacatttgatttgtattactgtgagtagaacacacagaagtttatgtttaaatgaatactggcaatggagtagaatataatgcaccttaattgatttatagatactgtgccttttaatagctcagttagcaatttccaattttaaccaatcctcttcaataagagcttgctcaaaacacttaacattgttttctttgaatacctacagctagagcaaatgttgcccaccatgataacatgatcagctaagcccgcagtaaatgttttactaccacaacccacatatttgctctggccagtggtttgccctataggtcagattgttcccgtgcacttacccgcagaaactaagttttgtgcttagtactcaagacggttatgttctctaaagtcttcaattctgtagtcacctctccactaatgaaaacttagagatctttgaccctaacttctcttcctatatgtctctgtccaactttgtaaatatacatatacattacctgtgtttacatcaatgaatttattcaactattctgcatgcaaaccaaataactcactgagttttgtttgtttgtttttcaagacaggatagactctagtttagaaaaaaatattttacttgccttatcgtgagaccataatgacaaaaataaggctctctatattatcaatttctctttattttggccagattcaagtgactattcatttccaattgcatattctatttcatttttgcatatctgataccatacaatcatcagtttatttctgtttccataatgaacattatttcttttcttagcccagtaatttccccaacacatgcaatcaataactatcaattgaatctgaattattttaaatatacataactagaaagagatgacatgattatatatttagaaaaccccttcgtctcagctcgaaatctccttaagctgataagcagcttcagcagtctcaggatacaaaatcaatgtgcaaaagtcacaagcattcctatataccagtaacatacagagagccaaatcatgagtgaactcccattcacaattgctacaaagaaaataaaatacctagaaatacaacttacaagggatatgaaggacctcttcaaggagaaaaaccaatgctcaaggaaataagagaggacacaaataaatggaaagacattccatgctcatggataggaagaatcaatatcatgaaaatggccatactgcccaaagtaatttatagattcaatgctatacccattaagctatcattgactttcttcacggaactggagaaaactactgttaatttcatatggaaccaaaaaagagcccacatagccaagacaatccaaagcaaaaagaacaaagctggaggcatcacactgcctgacttcaaactatactacaaggatacaggaaccaaaacaacatagtactagtactaaaacagatatatagaccaatggaacagtacagaggcctcagaaataacaccaaacatctacgaccatcaggtctttgacaaacgtgacaaaaacaagaaatggggaaagaattccctatttaataaatggtgctgggaaaactggctagccatatgcagaaaactgaaactggaccccttcattacaccttatacaaaaattaactcaagatggattaaagacttaaatgtaagacctaaaaccataaaaactctagaagaaaacctaggcaataccattgaggacataggcatgggcaaagacttcatgactaaaacaccaaaagcaatggcaacaaaagccaaaattgacaaatgagatctaattaaagagcttctgcacagcagaagaaactatcatcagagtgaacaggcagcctacagaatgggaaaaaatttttgcaatctactcatctaacaaagggctaatatccagaatctacaaagaacttaaacaaatttacaagaaaacaagcaaccccttcaaaaagtgggcaaaggatatgaacagacacttctcaaaagaagacatttatgcagccaacaaacatatgaaaaaaagctcatcatcactggtcattagagaaatgcaaatcaaaaccacaatgagataccatctcacactagttagaatggcaatcattaaaaagtcaggaaacaacagatgctggaaaagatgtggagaaataggaatgcttttaccctgttggtggtagggtaaattagttcaaccattgtggaagacagtgtggcaattcctcaaggatctagaaccagaaatatcatttgacccagcaattccattactgggtatatacccaaacgattataaatcattctactgtaaacacacatgcacacatgtgtttaatgtggcactattcccaatagcaaagacttggaaccaacccaaatgcccatcaatgataaactggattaagaaaatgtggcacatatacaccatggaatactatgtagccataaaaaggatgagttcatgtcttttgcagggacatggataaagctggaaaccatcattctcagcaaactaacacaagaacagaaaaccaaacaccacatgttctcactcataaatgggagtagaacaatgagaacacatggacacagggtgggggaatatcacataccaggtcctgtcaggcggttggggggtcagaggagggatagcattaggagaaatacctaatttagatgacaggttgatgggtacagcaaaccaccatgacacgaatatacttatgtaacaaacctgcacattctgcacatgtaccccagaacttaaattttaaaaaaaagaaagaggaaacatttgtaccaaatattatagaaaacatagacactatcaattaattggtcagaaagtatttattaagcaattattttgttaaacactgtcccctccattaaaaatatatctagactagtgttctgcaatagcaatctgatacaagtcatgtatgtaactttatatttcctagtagtcacattttaaaaagtttttaaaaaggttaaaagttttcattattatttaaatttttagtataataaagttattttatttgacccaagatacctgaaatatcactttaatatgtaataattatgaaactattattgactggagttcctacaccctctctaccataagggttttttccctaatatatctttatttccttattttctcaaaaaaattcagtaaagttcagtatactcctcctctatgaagccttccctgaccactggcatccccactgaccccacactctgagtcacttggcacactgtggacattagtaattacacataagtaagtgtaattagcttctcattacacttatgcatataaataaataagcagaaaattgagtgattttttttttcttgccagactgtgagctacctaaaggccagtccatgtcttttcatcttcctgtctccagtccctagcacaatgtgtggccataggaagtattcaaaaaatatcattcaaattatataaaaacagaagaaatagcactctctaaaaccaaaagagagccaaaatatatctccataagaatataagaaatgatttatgggtataggaggaggtacagagatttcttttgttgctgttcttttttttgttttgaggcaaagtctggctctatctcccaggctggaatgcagtggcatgatcttggttcactgcaacttctgcctcctgggttcaagccatcctcccacctcagccccacaagtagctgggactacaggcatgtaccaccacacccagttaatttttgtatttttagtagagatggggcctcactatgttgtccaggctggtctagaactcataagttcaagtgatccgcctgcctcagcctcccaaagtgctgggattacagtcatgagccactgcgcctggccagagatttcctcaagttgtttgcaattatttcaccttaaaaggaaaggaaaacaatagtaggcatcagcttgcatgctggaaattttcatacagaataatattatgatgaccttcccatgaaagagagaaagagagaaatatatataaagtgatatatgtataatgatttctatacttagatttagggagtagacatgttttattctaatagcaaaataattaaagatactgttatactggtctttaactggcccagccagaaaactttttatttactaaactcatcttctcaatgaaacaaaacaactgggccaacagaaataatttgctactcaactcgctcctagatgttcagaaaaaaatgagtcaattaaaaacagaattgtatttggaaaggatagtgatggacctgaattgtgattctggtctgctctgatggacaaaagtcatggggcaggaacagcggtagagagggaaggtgaagcacccattgttcaaaaactggggctgctagctttgtaatacaatattgtaatgtcccctttaggcccaaccccaccttctctgatctccccaggacagaaaaagataagaactttgcatctattgttagatttattcatcctgagagatagaatgcctaggccataacataacctatattaggatcatgggtgacagatgggtttctggtagttgttggcactgccttgtttactctgtgtgtgtgtttgtgtgtgtgtgtgtacacctttctccctttatatatcatgtatcaagattattggatttgatcaaatacatggttagaccaggaaagatttgaatacacttataaacttgacttaaacaaattccaaatccatttaacagcaatggaagatgaaattcttccactttttactttgttcatgtcaattcagagacaccactggttattaagacttcctcctatgactcacatcatcaaagctacatattcacacacatttttcaaagggaaaataacccacactttatttctgtaaagttcaatggataacagtaatctgtgcaagaataaatgcctcacaagcttggattatgtgaaaacctcttaaatctacatcccttgagaaaaaaaaaagtacagcactctcagatgcattacatggaccttgcttcttcatttttgactttcattaggaaatcgtctcttccatttgcccccaaatgcaaatgcttcttcaaaaacattttaaaatgttcaatcacataaaacagaaagcagccttcatgattagaaacttacaaggtttcagatgttatttctttaatccaattcatcaaatcttaaataggtccaaaattcatatacagtcctaataagctttgaaaagaatagtcctcgcttcaaacagaacagtactattaatatacaactggttaagtttaaaccagtaagtcataatgaagcaaaagtaggttttgaggaaactgccttaagcctccatgactttacaattccatattgagcactaataataaatcccaattcatatgtgtgactacataaatattcatgcagagttaaatgtgcacctataaatgtacacgatacatatgcagatgtaaatgcattttatgatttcagcttatgaaaatgtcttatctgttggttttggagaaactatcactttgatatccattagatgtaatatatgagtttatcattgtatcaccatcatgttataatgccattgtctgagatttatctattaaacaactcagaagtatgtaaatgctcttaaaatgaaaagaaaattgtgaagctattaaatcatggtcaataaaatatttctatgccagtcattatctaatcatctgactccatcaagtcttaactgcaatgatttccaaacccacttaagtacttttgcctcttcctctgcatccttgttataagaatggtaaattgcttagattagttgactgctgctgtaaggccaagcaacagccaagtttgaaaccaaaccaatgattatgtctataaagttaccctaattaacaaggaagcaatcctaagcattaaatggttaagctttagtattacctgagttctgctatttactcaacttaggaagtcagaaccacggaattaaacatttgtattttgatacagtttcttccataaaaatcatcacaaaattttaggagaaacactcctaaaaagctttttcttattgcataagattaaggaaaccatttgattcaaaggctcaatgctgataagctttagcagataataataaactctctaaagaaattatttgattcatactaatttgcattggtcttataaatggcaggatatggatggttgtgggatggaagtagcctagactagccaacagggaaactgttaagtgtataagggaatgcatatgttaaatagcttgatttagtcaccccacaatgtatacaggcatagctcagagatgtcacaggttctatttcagaccactgcaattaagtgaatattgcaataaagtgagtcatgtgaacttttttatttcctagtgcatataaaagtaatgtttaggctatattgtattccactgagtatgcaacagcactgtatcaaaaaatgtacacacattaactttaaaatattttattgctaaaaatgcaaagaatcatctgaaccttcagaaaagcataatatttttgctggtggagggtcttgccccaatgttgatggctgctgactgatcagggtggtggttgctgataaatggagtggctgtggcaattttgtaaaataaaacaacaataaaacttacttcattgactgactcttcctttcacaagaaatttcttggtagcatgtgatgctgttacagcattttacccacagtaaaagttctttcaaaattggaatcactcctttcagaccctgccactgcttcatcaactaagtttatgtaatattctaaatcctttgttatttcaacaatgttcacagcatcttcaccaggagtagattccacctcaagaaattactttctttgctcatccataagaaataactcttcatccattcaagttttatgagattgaagcaattcagtcacatcatcaaattccacttctaattctagttctcttcttatttccaccacatctgcagttatttcctctactacagtcttgaacccctcaaagccatccctaagggttggcatcaacttcttccaaacttcctgttaatgttgctatttttacctcctcccatgaatcacaaatgttcttactggcatttagaatgatgaattttttccaggagtcttcatttactttgcccggatacatacaggtatcgctatctaggaaacctataaccttaaaaaaatgtatttcctaaataatgagacttgagaggttaagttactccttgatccatgggctgcagaatggatgttgtgttagttgtcataaaaacattaatttccttgtgtatgtccatctgagcccttggaagactaggtgtgttctcaatgagcagtactatcttgaaaggaatcttttttttttctgagcagcaggtcttaagagtgagcacaaaatattcattaaaccatgctataaagacatgtactgtaatccaagttttattctaattatagggcataagcagagtagatttaacatacttcttaagggccctagggttttcaagatggtaaatgagcattggcttccacttaaagtcatcagctgcactagcacctaacaggagggtcagcctgtcctgtgaagccagcattgacttctcctccctagctatcaaagtcctagacaacatcttccaatagaaggctgctttgtctacattgaaaacctcttgtttaacatagccaccttcatcaatgctcttcactaaatctcctagataagttgcttcagcttctacattagcaccttctgctttacctggcatttctggttatggaaacagcttctttcctgaaacctcagattctttttctgcagcttcttcacctctctcccttcctttataaaattgaggagagtcagggccttgctctggattaggttttggcttatgggaatgttgtggctggtttgatcttctatccaaaccacaaaaactttctctatatcagcagtaaggctgttttgctttcttatcattcatgtgttcactggagtagcattttcaattcccttcaagaactttccagttgcattcacaatttggctgtttggcataagaggcttagctttcagtctgtctcagctttcgacctgctttcctcaccaagcttcatcatttctagcttttaattgaaagacagaggtatgaatcttccttccacttgataacatagggaccactgtagggttattaattgacctaattccaatattgttgtgtctcagggcatagggaggtccaaagagagggacagagatgagggaatgcctggtcagtgtagcagtaagaaaatatataacatttttcaatcaagttcactgtctaaacaatcacaatagtaacatcaaagatcaccataacagatataataatagtaaaaataatttgaaatatcgggaaaattaccaaaatgtgacacagagatactaagtgaacacacgctgttggaaaaatgtcaccaatagacttgctcaatgtagggttgccacaaaatttcaatttgtaaaaaaaaaaaaaaaaaaaaaaaaaaacactatctgtaaagtacaataaagtgaggtgagcctgtacatataaacatcatgttgtacatcataaacacacaatttttagagatccaggccagtttatatatacagggactgggtggtaacaatgttaaaaacaaataaccaaagaataggagggaaataataataacaatggtaaaaacatgttgaactctatccttgcattaggctttgctaactgccttaaacatatcctattttatgttcgtcagtgtttcactcattcaaatatattcatatacatctcactgaatataaagtagataaggaaactgaagcccagaaagttactccagatttcacaatcactgaattgttgataggggcttcaattaaaggtcagtcttatgaatgcacttaactattacactacaatggtagccaccttcatcaaggaacttagctgaatcttctaggagggctatgagtccatgaggagaactaatatccatttataagagattagttaaaatggaggttgtcggcaggttttgagtttggacaggtggtttggactcccagtatagagaccaaatagcaacaggagcacaggcagcaataagatccgggtgtataaggcaaaagtccaaagatttattcaaggcagaaagacccaggaggaaatagcttttgggtataaatcaggtaacattttgaaattcaagccacacatcagaaacaggtatcacaaagaaagcatttcaagatctgcaacaaggccttcaatccctttgccgtatttataagacaccaatctgcactaataagtgtgcacaattccgtggaggtagagacagggtctgcaggtcactgtagccgaataacaggtccctaggctgagtagtgctcatgcttctaaaatttccacttccaagttccaaatgctatgctttccccttttccaattaccactatcttcatccccatacatgtctattaggaaaaaacaacaataagacatctacttagttcagtcatctgggaaatgctgtggataatacagtactgtgggtcaaataacacattcaagaaccagtcaatttggtgaaaaaagaaaaatcaaattgcttattttgcatcatgcagagcaaaaaaattactatttgaatgttgtgcttttcaaatagttgtactgatgttgagtagacacaatcatattcaccaggcatctctacactgtcactttggtatattattttttacactgccttttctcttctcggaatcaaatttagttatcctttggggatgcttaattccttaatgtcaatcaccttttttttttaactaagcaagcaggttctttattttttcaactaaattctttaatcagcttttgttcagaaactgtttatttctatctgcattacaaatgctagatttaaccaatctatcaaaccaggataatacaaggaaggatattgtcagttcatcctttcctcttaggaacaaagatgccgtattttgtgctttaaaagaaaagaaataataggattagactaagattgaggacaagaggatgtcaaaccaaagaaaagcatgtggtccttctaaagctctcccaactagtatggggaattgtaatccattcatgctaagtgctttgactatgctcattatgcaaaaaccattagagcctagtatatttagttaccatagttctgcctactgggaactataattaaagcacatttgagcaaatgcaattttatttgttattaagcaactaaaagcttagtcaaccttgcaaatatggcattatcttaagattacaatatgagccagacagctatccaataaactttattaggtcctatctttattagctatgtcttgtattcctattgcaggagcattgtatgctgtacaacagtggtcttaataggtctaatagtttaggatgcaccagaaacacctggaaaagcttgtaaaaacacattactgggccccactctcagagtttctcataccttaggtctgcagtagggccccaaaatttgcatttctaacacatccccagaggatgctgatgctgctggtctgcagaccacactttacaaaccattgctttgctgtataaaatagtggttagagctttggagtgaaacccacctgggctcatgtacttgctcttctactaatacatacatgtccttggacaggttacttcatgtctccaagcctgtatcttaatccatatagtagggataataacatctatccaataggttggttgggataattaaataagattaaaagtatagaaagtgcttagcccaggtcctggcaagagagaaaccaatgaatgtcagtgataagtttattattgttgttaattttaaaaatatgccaagatctaggtcaacatatttataaccaatggtgtgcatcagactcaactgtagggcttttgtaaaattcacacagtgagacaccatccccctcagagatgttgatgcaatcaatatttcattgattctaagatgccattgatcataagatacaccattattttatgtatcactaagaaagataaggcagaaattaacccatgattattctcagtgaaataaatgaaacatagaaaaatactgcataatctctcttatatgtggagtctaaataaaaaacgtcaactatacagagagagtagcagttaactaggatgcacaggtccagaaatataatgaacaacatgaggattatgtaggttgagtatccctaatccaaagatctaaaatccaaaatgctccaaaatctggaactttctgagcacagacatgatgctacacaggtacctgagatagtggcaacactgccttctgatcattcaacatacacaaactttgtttcatgaacaaaattatttaagatattgaataaaaattacttttaggctatatgtatacggtgtaataaaacataaattttgtgtttaggcttggatcccatcccccagatatctcactatgtatgtgtaaatattccaaaatacagaaaaaggcccaaatctgaaacacttctggcctcaagtattttggataaaagatacacaacctgtagttaataaaattgtattgtattgggcatttgcgttaaataagtagatttagttgcctgcttttgtcatcaaaaaagtaactccatgagatgatagatatgttagtttgcttcactatagtaaacaccttactgtctacatgtatcccataacatcacgttgtaagcctcacatatgcacaataaaatttatcttaaaaaagtttgatcaaactaatgtaaagcacatccagatttcaaaaatgagaaaatatggggaaaaaagtacatactggaactgatgaaataaggtagctggagatataagtgtgggcttgcttcccaggttattgtgatgtgcaattctgattaaaaaccactaacttggctggccacagtggctcacacctataattaatcccagcactttgggaggctagatgggcagatcacgaggtcaggagattgagaccatcctggctaacacggtgaaatcctgtctctactaaaaatattttaaaaaattggccagtcatggtggcaggcacctgtagtcccagcttctcaggaggctgaggcaggagaatgtcgtgaactcgggaggcggagcttgcagtgagccaaaatcgcgccactgcgctccagcctgggtgacagagcgagactcttgtctcaaaaaaaaaaaaaaaaaaaaaaaaaaaaaaaaccactaacttagtcaatgtgacagctgcaagtgggactcaaagttcagatgcctcaaagctgagagggctcataggttggaatccccattcttagaacaagaatataacccaatatcataatcaaccacctaattccatagactgtttatgaaacaaaaaatatttcctcttggtgtaagagcacccaccctctaaacttagaagaagacttctcccactgaatagcacttacccacatgaactggtcatgttcatgaccagaacacatcagtcaatcagatcaaaggagagtatagcacagttagaaggaaggtgtcaagctgttagaccaagataggtttttcttcttaaacatgaattccaatcttgagatttgaggattatttagggagacaaaacatgatttacatttcagggagaagggaggatgatgaaggtcacatatgttaccaggacgtggccctagtaggcttctattttccgtcttgagttttaaattgcagtttgtaatttgtttcaaaacaaagaaagtagattttgtataatctgtttgtcttatcaagtttatggccactcccatttgccttcactctgggaatcttggatgaaggtggggaaggcatgcgcctaccctcaactttatgctaacactcctgcccataggaaatgcattaattctgtaagccatcacagaacaggacaagatcttatgacagttttatttgggagctcagaatttctaataacttcaataattatctccggtagtctccatgcacatgagttaattataacaagaaaataaaatacttatttcagcttctaaaaattctaagaatgtaaatctctaatgaagtgttgagataatacatagctgtttttacaaactttcaactaagaaaatttcattttaactcctgcctacctcatgaccacccagtcctctctttattattacttatgttaatattaatttaattattattaattttctaaccagggctcaacccagatggacaaacaaacatgaaatcagggactgccaaggacatttcttcaaggtccaaatagttacaaattgtagtgataatgaagttgaaaaacacatggatatggatgactttctcattttctcactatactggaaacacacacataaactatcaatgaaatctatacttcaaaaaatatattttcaaaccttagatacctcttctggtcctggtccatattgaattcctttctaaaatcagaaattaaagctttatcataatactctttttaaaactacgatgttcttaaatttttatgcttccaattggagaatggaacatacaaagtattggccgggcgcagtggctcacgcctataatcccagcactttgggaggccgaagggggcggatcacaagatcaggatattaagatcatcctggctaatatggtgaaacccgtctctactaaaaatacaaaaaattagctgagcatggtggtgggcatctgtggtcccagctactcgggaggctgaggcaggacaatcgcttgaacctaggaggcggagcttgcagtgaaccgagatggcgccactgcactccagcctgggcaacagagcgagactctgtctcaaaacaacaacaacaacaaaaaaaacgaaaatacaaagtatcatgaaatttaacaaaaaatggtcttatgtttccaaaaggataacactgattttattaaaatgtctacataatttaaatgactgcacatgtggaataaaatttaatataaaactcagtcacctgaataatgacaacttagaaacagtcacactggtcatagagagtatctgtcgacttgaaggagaaggaagcagccatgtctttataggaaactagttcctgttttactatagagatgacagggggttggggttttattttcattatttttttttttttacagattttaccttgatttagttgcataatgaatgcaacacctattttccacataagaagataaagactgatttgaaatttttcaattctgtccatcactgttgtatccaactgacttattagcatacaccttgctgcaagggttttatttttactgagggattcttcgtgtgcctcctcattttcaccaaaatgtatataaatctcctgaattttcatgacactgatgtggctaaaaattttaaatattttcagttctttgaaaatacaagaaaaaccttcagaaataagaattagccatggttcagaggttctgatttgttttaacaaaaacatcaattatttcaagttctctgctgactagaaaatagtggatttcatttgatatggcaaagcaacttgttatgttttgtgctaccataaaatgcatcacaatttatagtaattacctgaatattcagtttgtttctggtaccctcctctcagtcctacgtgtctgttagagaatcaaagggtactgcttgtctaagaaatatgctaaagagaggacaacacaatatctggagaaggaaataagaatcatcaaatgccctttccttctttgatataattcctaagattacagaaattgaagataacctagcacacatcacctccaaagagaacagaagaaggtcttttaacttaatcttgtagataaaatggattacaggagctgagtgcccagactgtgaggcagatcagtaacagtttcaacagctatattcaaacggtgttaactagtgcatcagcatcaacctagttctaaatctcagaatcatagaattcttttctgggttccatttgtttcaccatgttactcaatgtcctggaagaaaatagagcggacatcataaaatttgtagaagggagagtggccatgtggatgactgaatggggttggaagctgacaggttggagacaaggactatatcttaaattaataaaaataaattttaaagtacttatagaaatgaagtatccacaaatgaaaagtaataatagaaataaattgaaaagaaatagaagtaaatgtaaaatgatgtgattaagtccaaaaggacaattgttttgtacagaatggagatgtggcatagtagcaatacaggcaactaagacttagagattttagtctacagaaaggttaatgtgaatcaacagtaaatggaatatttttgagtgaatgaataaatgtaatgtattataggaggggagaggagggaaggagaaaaagagtagggaagcggaggggaggaaaagacaggagaggagaggaaggagaggaaaaggagaagagaatctgtataaaaggaagcaaaagccccacttatctctatatagcctggacaacccatgaagtactgcaatacaagcatggagaaactgagcacattcaagcatgacctgagatgtacaaacaatcaaatcaataatatccaagaattcctcgaagtacttgagcatatttaccctggagatctgatcagcatgctcaaatatcctaataacttcactgggaaaaagaattagaggtgttgtgtttgaccccagtggttacaagtaggacagatgtattagactctctaagggtaccttggtgtcaaagtcctctaaggacagaatggctcagcttgggagctactgatcactctctctcctgaagatgctgaaaccctgattggatgacccttggtaagacttttgcaaaaccaagtcaagtgttagataggtggcaggattagatgatctttgaaagtccctccaaaccttaagattccaatatgtaaacattttcctgtggtgcacattaaatccttacaaaagactttctctcataaagacaatgaaaacaaatggttagcctaagggaggtgaaccaatcttcagaaaaccctaagagactcccctattttcttgcttgtttgctcgttagagaactaatctcctataaaacaggaatttattaatatttctttgtcctctgctatactggccgactttgggaatttgcacacagcacactttatcttgctaaatataatagtctgtctggcattcttcctttgtgagaaatccttattcacttgcataaattatgtgtaaagatctgaagcatactttcctttcttcaatacagactattcccagaagtagcctgacacatgccaaacatctgctcccacatgcagctcaatacatgatattgatatgtattatcactgggtgaattctaaatacaaagccaatttagcacactcctgaacaattccctccttctctcccggccaagctgcagggagctcaaggaaatcagaataattctaatacttgcctaagcaagctataaccaggtaaatctgctaaaacaaaaaccacagtataacatttcaaaatctaataaaaattagatacacatgataaatataaatgttcatctaatttaatacatagctaaatacatagaagtattttttagtatctgctatacttacagtattgaaagacgttgctttcctcaactgtgaattcctgggtgtcttgagtgtttgttaagcatttatatgagcctagtccgtcttttaatgatcgaatgcaattatcgttcatgtggtacaaagaaaggtgaccagaatccctaaatcttgaagtttttctagtcatctatgaaagcctctagttctctaacaggtattttcacaaagaccttcagagtaaactcatttttactgctaactagggctttggacccaaacacctctctgctctctttccctggtgaagtaacctggatctcacataagcttggcagacagctcctatcccttgggctaaggattaataaaaccagccccagcagtgaatccgttatttccttcccaagtcccacactgcttctggcccctggcaaagccactgccctggcacaggttacatctgcccagaagaggcaggtttcctaactggtgaagtcattatacacatctgcattgcccaatacagtagccacaagctgcatgtggcaattagttcctcagatgtacaagccacatttcaactgctccatagccatatgtggctagtatacagaatattttcatcatgcgctactggacagtgtgccctaggattccattttgttctcaatttgggcaaacattgttcttggacttgggcagactttatctcccacttaaggtcagagtatgcaagggtttattcatttattcattcaacaaatatttatcaatcccttgtctaactactgaacatataaccacaaataaaacagacatggcacctactctcatggagcttacattctggtcagaaaaaaattaacgataaacaagtcaacacctaatggaaatgattctttcagctatgaatttcagtattagtttgtatcatttttagcttcatggtaacaagatattttggtttcattcaagtggatccatccccacagcagctggcctgctttctcttgattttcttcagatgacagtaactaatggttttaatatttacttgaatctagagtttcttcacctttgtttctttagaacttttactcaaagcttaattcttgcctctgtccttgattctgtcttgaaaggttctccaaactttaacttttcaatcatcagttttaaatgtaactcttaactatttatattctcaaatagtacaacaaactactaggcattcgcccttggaagataccacctcctcagctccttaaccttggcgatagttcttcagaatttctcttgaactattacctttctttcattcccagtgggccatactaactaagctgtcatttctcatacatgaatctctaaaacaacctccccaaaaggtttattgtctcaattttgtttccttacaattggtcatgcacactaaatcacaactactttaaaaactacttttaaaagtgccagtcattgcctctctcaaccttctctgcactagggaagctcccttgccccagtctttcacccctgaaaatgtacacctgtgccaagtgtgttcccacctttctctgtttgagagcacctgtcaggtgctaagcccaccactctctgcagtagttctcaagcaaccagagacactaacagatgagagcttcagcagtttggcagccccacatcccccgacctcacttaaccctagtcacagcttccaaaccagcaccacttcaagggatattggcatagcagccaagttcattggggctaggacttccaaagtcaggacagctggctctggggctaaaattgcagctgtgtttgggagcctcaccattgattatgccaagaaccctgtctgaagcaacaagtcttctcctatgccattctggggctttgcactctatatatgtcagttttttgctgcttagaacatctgaaaatgggtaatttatttttaaataatttatttcttacagtttaaggagaacttgagtccaaagttaagagaccatatctggtggacactctctacagtcctaaggtagtgcatggtatcacatagcgaggaagttgagcatgctaaagtgctagctcaagtcactcttcctcttcttataatgccaccagttaatccattaactcattaatccatggatagactaatctattcctatggacagatctctcatgagccaatcacctcttaaagtccctacttctcaataccgacacactgggtattaagtttcaactttggagggaaaaaatatttaaaccatagcaccctcttagaggccatggagttctttggcctaagggtggcttttctcatcctcttcaccatgtaaagaagctgtccccaccattaatagttctttcctccatgtctcatctatcttgtatgttcttttccctatacctttctcaggcaatctgagaaaagtggttggctcaaggtttgacagagggaagacaaataaatactgcatcttattagtcggggttctctagagtgacaaaactaataggataaatacatctatatctatatctatatctatatctatctatttatctatctagggagtttattaagtagtattaactcacatgatcacaaggtcccacaataggctgtctgcaagctgaggagcaaggaagccagtctgagtcccaaagctgaagaatttgcagtccgacgttcaagggcagggagcatccagtaaaggagaaagatgtaggctgggaggctaagccagtctaaccttttcatgcttttctgcccactttatattctggccatgctggcagctgattagatggtgcctatccagattagggtgggtctgcctttcccagcccactgactcaaatgttaatctcctttggcaacaccctcacagacacacccaggatcaatactttgagtccttcaatccaatcaagttgacactcagtattaactatcacaagtccaccccttgacaacttgaacctatacacgtctcctgagatcatacataatcttcaaataaagacaataatgaggtcataattacacctaatataatacaactatcctttatacaactagaaacgcaccaatccccaacccaaatgctattccatagagttaacaatacttaaatactgacatggatatgaggtcaataaatcttatgtcacatgataaaggaaaaaggaaatgaagatattttcttagtacaagtgtgtacatgcacaaacatgtttttaacaaagaaggaagaaatatgacaattacagtcctcatttctgcaactggtcacgtggtcatagctggtattgatgactaccttcttctactacccattctgtattccctttgcctttagcaagcacctcagcaggtcatggtttttttcctggagtgacccaaaccttcattcctgaagggtctgagccatctgcagtcctgcctggattgggctgctgtagtttcccattgaccttaatcacagggcatggtaatactaagagatgccctaatgaatctcctatattccctgcatacccttccttacctctgttgtgtagtagtagactgatttcgtcttgatagtctgggtcaatcaccccagacagcactgtaacccccttcttagcctgttgacttaaaggtaggaggagcccaaagtgtccaggtggcaatcttaacttccagttcaaaggaatcattgttgtgtctcctggtgttcctccctctggaactaagacttctaggccagcagaacataatattgtgggaacaggaagcaaaattttgctagtgggtcactaggagtaatggtgagtggtgccatcaaaaggccatcctgaagcatctggattgaaaggataatagaattgcctttggaagtcagaattaaaatgccaactaagtgacaatactttgcagggctggggcaaagttctccagaaggctgtgtatgctctgagccagcttccaatatacggtactgcttttcccatagccaggatatgcagagtccaggaatcaggggtggaagtggaagtggcacctcttattatcacccctagtgacccactagcaaaatttttgctacctggacacttggggttcctcctacctttaagtcaacaggctaagaagggagttacaatgttggctggggtgactgacccagactatcaagatgaaaccagtctactactccacaacggaggtaaggaagggtatgcgtggaatacaggagatccattagggcatctcttagtattaccatgccctctgattaaggttaatgggaaactacaatagcccaatccaggcaggactacaaatgacccagacacttcaggaataaaggtttgggtcactccaccaggaaaaaaacccacggcctgctaaggtgcttgctaaaggcaaagggaatacagaatgggtaggagaagagtgtagtcatcaataccagctatgaccacgtgaccaactgcagaaacaaggactgtaattgtcatgagtatttcctcctccttttgctaaaaacatgtttgttcaggtatacagaaaatatcttcatttgtaccaagaaaatatcttcattttatttcctttttcctttatcatgtgacataagatttattgacttcatatccatatcagtatttaagtattgttaactctatggaatagcatttggcttggggattggtgtgtttccagttgcatgaaggatagttgtattatgttaggcataattatgaccttattattgtctttatttgaagattacatatgatctcaggatgtgtatgggttcaagttggcaagggtggacttgtgatggttaatattgagtgtcaacttgatgggattgaaggactcaaagtatggatcctgggtgtgtctgtgaggatgttgccaaaggagattaacatttgaatcagtgggctgggaaaggcagacccaccctcaatcaggggttcacctaattagctgccagcacagtcagaatataaagtgggcagaaaaatgtgaaaagctagactggcctagcctcccagcctatatctttctcccgtgctagatgcttcctgcccttgaacaccagactccaaattcttcagctttgggactcggactggcttccttgctcctcagcttgcagacagcctattgtgggaccttgtgatcatgtgagttaatactacttaataaactcccctttatatatagatataaatatgtcctattagttctgtcactctagagaaccctgcctaatatagattttgtcattaccctactcagtaatacattatgactccctattatctatggaatcaagtttcttttttatgaagttattgccttgaaaagataaccctaaaattgaataattctgttatttttaccattttacttaggagtaagaattataacctgtttggttctgaaaatgattttagacctttcaggcggatgcaccttttggttcatgtgatatatacctgcatatgcctcattttatgtaattaaaagtttcctgataattatactcccagtttccaataaattcttccaccacacacacacacaacacacacacacatgcatgaagtagaagaaaagcttttagagatcatttactgagcttattgacacaaatgagagttttaagaagcacaagcaaacaattttagcatattttggccaactttatatatattaatatttcccatttccttgtcacgtgcatgaagcccacatcatgtctttttccacagggtataaggccctatgctcaatagcttgaattagtcacagaatgtctttctgttggcaacttttggattaacatccacaaattaaaatcagctcaacctcaaactaaagtatctggttatcattaataacttcgccactggacagaatgataaaaaataaaaagagaaaactcattaatttattatgatctcaaactaaatgtttttctcttatgtattttaaagatctgagaagcaaaattacaatttgagtttattagtaactatctgagtccactttctgttgcttataacagaatacctgaaactggttaatttatatggaaaataatttatttcttacagttatggaggccgagaagtctccaaagtcaagggaccatgtctggtgagagccatcttgctggcagggattctctgtggggtctcaaggcagtgcagggcagggcatcacatggggaggaaactgagcatgcttactcaggtctctcttcctcttctgataaaaccaccagtcacttctgatgacaacccatttatctattaagccatgaatacattaatcagttaataaaggcaggttcctcactatccaatcacatcttaaaggccccacctctcaatagtgacatactggggattaagtttcaacataagttttggaggggacatttaaatcatagcagtaactgaagcagaactactaaaagattgttaaaatattctaatcaccttttcaaaaatatataattcctttttcatgagggttaaatgtataaaaattcaaaaattcaagtcatttttttttttagacagggtcttgttctattgtcccagctggagtccagtggtacaatcatcagtctctgcagcctccacacttcctgggctcaagtgatccttccacctcaacttcctgagtagctgggactaaaagcatgtgccaccacccctgactaatttttttaaaacattttttgtagagacagggtctttcaaccctggtctcaaacttctaagctcaaatgatcctcctgcctctgcctcccaaagtgctgggattacaggcttgagtcaccacacacaggctgtaatcccaagtcacttttattatcataacctgctttagtaatcaagagaaagaaaattctttttatccttatgtcatattttattatggttgaattaattcttatagttagagtacatcctaaatacaactaaagaagttaactgatgcttaaagttactaaagcccaaattatttttacttttcttttcttcataataatgtctgtttctgttatcataaatgtagtggtctctgagaagctatgcacttttatatttgttactcagacctcttgaaaaatgttcaaaattattaatatacacaaatgtatagaaaatatccatatacattaatatacagaaataatttcctctcagtagaggagactagatcatagtgaatcaatgtttaacccatttcccaacaccatttaacatgagcttcaggccactagaattacctccattgacttagaaaagtacagaagacataagtcatatcaaagacaacaggaaaatgtttaattgtgtttaagtgcttctatatttgtatgacaatatttatttaacaaacattgatatagcacttgctacatcaggcaatgtttcaagcttttttaataaatattaattcatctaatcctcataacaaccttatgagttaggtaatatcatccctatttttcaaatgggaaaactgcgcgtaaaagaagtatcttgcctaaatccctagaatcaataaatggcaaagtcagaatttgaacctatgagtctggctccagagtctgagctttcaagcactactccatcaggctacctctcaatattctaaatcatttccatatttggaatctgatttaatataaaggtgttatagcttttagtcgtgtaaaaaacttttctttttgagatctgaaagtgacttcagatctcaaacacctaaggagacgtgctggtagagatctgaaagtgatttcactatgtggctgctcccacacaaacacccaatgtctccttgactctcatcccactagctcatgtacctcctgctcggcatccaccaaactctgttttctcctatagcaacacctaccacaatatttgtatattaagtgttacgttctttaaggacaagaagcatatcttgttcacagtttttttttttgttttttgtttgtttgttttttgagacagagtctcgctctctcgtccaggctggagtgcagtggtgcaatctcggcttactgcaagctccgcctcccaggttcacgccattctcctgcctcagcctcccgagtacctgggagtataggtgcctgccaccacgcccggctaattttttgtattttttttagtagagatggggtttcaccatgttagccaggatggtctcgatctcctgacctcgtgattcgcccgcctcggcctcccaaagtgctgggattacaggcgtgagccacggcgcccggccttcttgtttacagttttatctccaacacatgtacctgagcagacaaagcatgattataaattactcaacagccagagagttaaactaacttcttatcaaattacaacacctaaaataaataggtttcttctctatacctatgggagtaggtactcattccaattttaaaattagcatgtgtgtggaaataatcttgtgatttaaagaaaatgacactgcagaaaactacattaatgaatggtcctctccatcttggcacagagatttaaaatttgggtgtttcaaaattaaagacactaaagctcttcgtttaaaaaaaaaaaatgacaacacagatgcactgagcttttcaaactaaaagtcaggaatatatatcaagctactatcacaaaacacttccatcaaaaccctgcaggaagcaaacaattgccagctagcacatcacccttcatgcgaaatgacgtgcgtcattttgtgcaaaggacatcaaaagaacttgtcagttaaacagaggatttagatataccatgagaaaactttcatgcaccactttacatatttccagcaaaattgctatagaagcacttaaggcacaataatttgaacctaacttgacttaagtaaccaacacaaactacttttctaaaatgtctcctattttcataagtgatagaatttagttataaaagtcctactaactcttgtaaaataatctacagagacatggtgattcatttgctttcattcagcagcatttgcttgtaaaattattaattatgtgcctattatgtgctaggtactctattgggtgttcttgtacaaatcatttttctgccagcaaagccatatttttttgagttagtaattcccagatttttgtcaaattcaacagcattatgcaatgagttcttagtatgtacagtaaggaagagcagaattttagttgatgtaagtaattctacattttattttggataacaggaacatacaaactatatacatgcaacctgaatattcttattaactgttcattttgcatttctgtccaatttgaccagtgaattcactcaaatagtcaagttggctttggcatttaggtaggaccagtaggtccataaagtgagagagtcaaatgggtaatggaagacaaactccctcctagatcacaagctcctgagaataagaactgtgacttctatagtactggggccaaatgtatttcctggcacagactatgcattaatatatgattgtttgaatgaaagaatgacctcactaaacttctcccaaacatataaaactatatcccatctgtaaaaatttccagagggaccagacatgatgatggtcatttggtcattatccttattaatattaaccttcctaagtacagagatcccatagaggctcttagggtacaataaatcaaacctaagtacattaattaaccaatacaagttataactttactaacagttattattttccgttaaatttcctaaattctcttaatcttttatcactgaatctgtttttttaaacttttttcttatcttttaaattattctgattattaagttaaaggttaacaagataataaatcataactctgcttcaaagcttgccagcttaaattctattaacaatgcctgattattcaagcttatctcctttttataactttgaaaataagctgaaatctgcacctctaatcacagtgtcctgtaccctttcaactatacgtttgccttgccttccactaaatcctaaactagagcaggggtcaggttcttgttcctctttcttgccatcctctcaccctgacacgcactactgtatccacttcaagggcatgttcaggaaagataatatagcactgcaaaaatgggctactgggggctgggcacggtggctcatgcctatgatcccagcactttgggaggccaaggcaggcagattgcttgaacccagatgtttgagaccagcctgggcaacatggcaaaaccccatctttacaaaatgtacagaaaataaataaaaataaaaataaatagccaggcatggtggtgcgtgcctgtggtcccagctactccagagactgaggtgggaggatcacctgagcccaggaggtagaggttgcagtgagccactgcactccagcctgggtgacagagcaagaccctgactcaaaaaaaaaatgggggataggaaggcagagaaaagcaccccgaagccctcgggcggaaaattggattaaaaccttaaagagaagtaaaatattctcctttactgtctccatttcagtcattgcctttaaaattcatacatatattccactagtgctaacctaagagaatcagcattatttaatatccattgcctcagacactgttgtttggccaaccatactcattcccaggccccagccaccttcttctgtggctaggaacactaaatacttatttttcctgcttctcttgcagctaagcattgccctggacacagttctggctgatgagatacaagcaaaacccaccagagggttccctgaaaagattttgctttcatgattaaaaaaaaaaaaaggagaaatatggctggcattgtcacttctcccttcatcatgtcctgaacatacaatacctaggcttgcattatgtattttgcaaccgtgaaataaaaagcatgaaaatgaaaaacaaactcaatgggaatggtggaacagaggattaaacaggattattaagcaactaaacctatgcaaacaatcccctgttttcagatagcttgatgtgggaataaaagattgttgacgttaccgttacttacagacaaatgctttccaatggagatgctacttaagacagccatggtttaaatcctggttctgccttttactgtgtgaccttgggcaacttaataaacttttccaagcctccatttctcatctgtaaatgggcataagtgaaattgctacaatagcattgttgtgaaaaatataaaataatgcatttcaagtacttggcattgaatttggcacaaagcatttctctcaaacattaaaagcacattttaatactaaacacaatagaaatgttttaaaaataaatgttgcttttttctccaaataattacatataaaaattaaacatttagggtgttagagaagtcaattctttatttttaaaatcatcattatatatagtttaacttaagacaatttacaataagaattaaaatgtataatgtaaatgtaaaatgtacatttgtgtaattaggtagtacaaatattaactaataattgctatgtggattaaattttttatattattctaattattgtgatacaaaataagccatttcctccagcacaagatagactgaaatgactggcagtaacctcacaacttcttgttgccataccacccagaaacctgagacatgtgaatctttactgttccacttactaggttattttcaggacattcaatcatttctctttaatcattgaaggaaacagcaaatctctgtttgttgtttcgctttgttttagtcagaagcatttttgcttcacttcaacaagatcatcactccaattgtttctctttagcagcttatcttacaaggccagtaaaagactgtgttccgaagcctagagactttccatttatagctttccattaagcctcttaaaagtaggtatttacacaaattaattacttaaaaggtagggccttttatgaaatagcttttttattaattcaaagagattataatttttaatctaaacctttttaaaaaggatttgagtcgacttacaacaaaagacataaatagattaagattgttaaaataaaccaaaacatatgcaaatactgggaaaaaaggatgcaaataaaaaaatcatgatggccacaattatgcaaaacatttaactgtgaacttctactaaagcaaaaatggaaacagagttgatttttaaaatctcattatgttagagggaaagtgtatggtctatatttttatatgctgatactcagtgtagccttagtactaaaatttcagtaggaatttctctcatggcccttccccaagaaaaattaagttccataatacacagtgttttcatcagtgaggttcagtggctgctttgaactttaataaaagtcaatagcatgacattataccagtaattttaaaatgattttaagctatggaatctgaaaaaaatatgcagcagctaaatatataaaattatagataaataagaacttctctaattgaaacagagttaaagtgcctaaagctactataaccagtgattacagaatctgagtaaggaaaaaaactgtagccaataaactgatcacagtgccttgcttagttacaaatatacaaatgcaaatacaatgtcctaagctcttatgctctcctgacaaggttggggatgaggcaagaatgtctactctcattgctcttattgaacattatactgcaagtcccagttcaataaagcaaaaagaaaaaatgacacataaggaagacaggaagaaataaaactgtctttattcagaaagagtgtattgtgcatgtagaaaatcttaaaaatctacaaaaagccactaaatctaataagttaattgagcaagattgcaggatacaagttcaatagaaaacaaccatttgtatttctatatattaacaataggcaattggaaataaaacaaaatatattcacaacagcatcaaaaatcatgtaaaactaaggattaaatctaacaacaggtgggcacaggcagttcattaaaaattacaaattattaccaagaaaaattaaagaaaaattaaataaggatatttctatggagtgaattttgtccccttctctacttcagtttatatgttgaaaccctcaatgtgacagtattataaatgggtactttgataggtaattaggtttacatgaggccatgaggatgggccctcataattaattagtgtctttataagaagaaacaccagagagcgtgccatctctctctccgtgtgtgtgtgtgtgtgtgtgtatgtgtgtgtgtgtgtgtgtgtgtgtacacaaagaggtcatgtgagcacacagtgagatggtggccacctgcaagctaagagaagggacttcaaaataaaacttaccttcccagcacctttatcttggacttcccaacatccgtaactatgagaaaataaatttctattatttcagctacccagtctatgatattttgttatggcatcccaagctgactaagacagagatatacagtgctcatggatcagacgacttgaggttaaaatttaagatacgaattcactgcagatttttctataaactcagtataatcagaaataaaatcccactaggcctatatgacccaagaattccatttgtaggcatatacataataaaaaacagggactcatacagatatttttatcattgctggataattcacaataggcaaaagttaaaaacaacccaagagtcaatcaacaggtaaatggataaacaaaatgtggtatatacatacaatagaatgtcattcagccatgaaaaggaatggagttctgacatatgctacgacatagatgaatcttgaaaatattatgctgagggtggagcaagatggccaaataaaagtctccacaaattgtctcacctaaaaggaacaccacattttaacaactgactacacacaataaaagcaccttcataaaaaacaaaaatcaggtaagcaatcacagtacctggtttatattgctgacagaggaactaaatgggtaggaaagacaggcttaaatcactgagaccacccctctcacattccccagaaataattacatggcatagaaagagaatctgtacacttgggggagggagagcacagtgactgggggactttgcattgaactgagttttgccctgtcacagtggaaagcaaaagcgtgatgaactcagccagtgcccacacatgaagggagcatttggaccagacctaaccagagaggaagtgcccatctcaatggtctgaacctgagtttctctgcaagtcttgctactgcaggctaaactgctctgggatcctaggtgaacttgaaaggcagtcgaggacacaaggactgcaattcttagggaagtcctgatgctgtgctggacttagagccagtggattggggtggcacatggcctagaaagacaccagatgggccagctaggggagtgcttgtgcaactcctcccacaaccacaggcaggaaagcttgcagcaataaaaggactccttccttctacttgaggagaggagacagaagagcaaagagactttgtcttgcaccttggatgccagctaaaccaacatagggtagatcagtgggcagagtagtgaggcctgcatcctaggccctacctcccagatgacatttctagacacactctcggccagaagagaaacatcttccttgaagggaatgaacaagtactggcagaattcatcaccttctgactaaagagcccccgaaccctgaatcaccaacagcaatactcaggtggtataccactggccttgggtaagactctgagacatgctggcttcagctaccagctcagccatagtagcgcagagcaccaagtgggctcttagggatccctgaatccaggaataggctattggatggcacttatagacctgccctaggccaaaggggagcccacttccctgaagagtgagccccaggcctggcagcattgaccacaatctgactgaagagcccctgggccttaagtgaatcttagtggtggcctggaaaaactccctatgggctagtggtggtggtggcaacagggaaaggcttctctgcctgtggaaaggggaaagaagaatggaaagagctttgtcttatggtctgagtaccagcttagccacaatgcaacagaacaccaggtagatttctaagttttttttttaattctaatccctggctcccagacagcatctctagacctgcatgggttctggggaaactgactgccctgaaggaaatgacaaaatctgtggcttccccacctactgattgtagatccctagaatcttgagagaatataggtcgtagtcaggtagcaaatatagtggaccttgtgtgagactcagtactgtgctggcttcaggtctgacctgggatagtcccagtggtggtggccacaggggtgcttgaatcatgccatccccagctccaggtggttcagcacagcaagaaagacttcatttgtttaaaagaaagtagcagaagataacgagaatttcttcctggtaatccagggaattcttccagaccttatctaagaccacctaggtggtatctttatgagtctgtattactcggcttggaacccaagtctcttttgaatatctagaaagccttcccaagaagaatgagcatagagcatagacaagctcagactgagaagactacaataaatacccaactctttaatgcccagacacagacaaacatccagaagtatcaagaccatctaggaaaacatgacctcaccatacaaactaaataagggaccagggaccaatcctggagaaacagagatatgtggcctttcaggcagagaattcaaaatagctctttcgaggaaactcaaagaaattcaacataacacaaagaagaattcagaattctatcagatacatttaacaaagagattgaaataattaaaaagaatcaagcagaaattctatagttgaaaatgcaactgatgtattgaagaatgtcttagagtctcttaataacataactgctcaacaaaaagaaagaattaatgagcttgaagacaggctccttggtaatatactgtcaaaggagacaaaataaaaaggaataaaaaataataaagtaagcctacagaatctagaaaatagcttcaaaagggcaaatctaagagttcttggccttaaagaggaagtagagaaagagatgagggtagcaagtttattcaatgggataatataaaagaacttccaaacttagagaaatatataaatattcaagtacaagaaggttatagaacaccaagcagattttacccaaagaagactacctaaaggcatttaataatcaaattcaaagataaagaatcctaaaagcagcaagagaaaaaaaacacacacacaatagaactttaatgcatctgtaagcagacttttcagtagaaaccttactggccagaagagagtggcatgacatacttaaagtacagaaggataaaaacgttttaccctggaatagtatattctgtgaaaatatccttcaagcatgaaggagaaataaagactttcctagacaaacaaaagctgaaggatttcatcaataccagacctgccctaaaagaaaggttaatgggagttcttcaatctgaaagagaaggacaataagcaataagaaatcatctgaaggtacaaaaatcagatagtagaaagcagaccgaaaaacacagaatactataacactgtaattgtggtgtgtaaactatgtttatcttaagtcaaaagactaaatgatgaaccagtcaaaaataacaacaactttttaagacacaaacagtacaacaagacaaagaaaaacaacagaaagtccttacttgtcaataacaacataaaatgtaaatgaactaaactctgtaatcaaaaagcatagaatggctgaatgaatttttaaaaaaagacccaatgatctgctgcttataaaaaacatacttcaactataaagatacacatagactaaaaacaaataaatggaatatttcatggcaatgtaaaccaaaaaagaacaggagtagctacagttatatctcataaaataaatttaaagacaaaaactataagaagagacaacattgttatacaatggcaaatgggtcaattcagcaagaggatataacaattgtaaatagatatgtacccaacacttgaacacccagatatataaagtaaatattattagagctaaggagagagacagacctcagtacaatagtagctggagatttcaacatcccactttcaacattgttgattttctgcctgggaaatctgtccaaagaaacatcagacttaatccagactatagaacaaacgcatctaatagatatttacagaatgtttcatccaatggctacagaataaaaattcttcaactcagcatcattctcacagacagaccatatgtcaggctacaaaacaagtcttaaaacattcaaaaacaattgaaattgaaataatataaaacatattctctgaccacaatgaaattaaactacccatcagtaacaacaggaattttgtacactaaaaaaaaaaacatgaaaattgaatcatatgctcctgaatgaccagtgggtcaatgaagaaataaagaaggaaactgaaaaatttcttgaaataaatgataatggaaacacaacataccacaactcataagatacagcaaaagcagtactaagaggaaaatatatagctttaagtgcctatatcaaaaaaagaaaaacttaaacagcctgatgatgcatcttaaaaaattagaaaagctagaacaaaccaaaccccaaattattagaagaaaaaaataaacatcagagcagaaataaatgaaattgaaatgaagaaaacataaaagataaacaaaaccagaagtttgttttttttaaagataagcaaaattggcaaacctttagccagactaagaaaaaaaaaaaaagagacgatccaaacaaataaaatcagagagaaaaaagaagacattacaactgatacaacaggaatttaaaggatcattagtgactactatgagcaattatatgctaataaattggaatatgtggaggaaacggataaattcctaggctcaaacaacctacccagattgaaccatgaagaaacccaaaaatggaacagaccaataacaaagtaacaagattgaagctgtaatgaaaagcctgccagtaaagaaaagcctgggaaccaatggcttcagtgctgaattccaccagacatgtaaagaactaataccaatcttactcaaactatttcaaaaatggaggaataaatacttccgaattcattctataaatccagtattatcctgataccaaaatcagacaaagacacatcaaaaaagaaaactataggccaatatccccgacgaatgttgatagaaaaatcctcacaaaatactagcaagctgaattcaacaatacattaaaaagatcattcatcatgaccaagtggggtttatcccagtttcaacatatgctaatcaatcaatgtgatatatcatatcaacagaatgaaggataaaaactatatgatcatttcgattgatgctgaaaaaccttttgctaaaattcaacatcttcttatgattaaaaccctcaagaactgtatatagaaagaacatacctcaacagagtaaaatccatgtataacagacccacagttagtgttatacagaatgggaaaaaactgaaagcctttcctctaagctctagaacacaacaaagaactccaatgtcaccactggtattcaacatagtactgaagtccttcctagctagagctgttttctgtttgaaaagagaaagaaatacatggtgtccaaattggaaaggaaaaaatcaaattgtccttacttgcagatggtattatattatatttggtaaagcctaaacacttcaccataaaactgttagaactgataaacaaattcagtaaagatgcagaataaaaaatcaatataaatagtagcatttgtgtatgccaacatgaaacaatctgaaaaagaaaaaaagttcttccatttaatatagctacaaataaaacgaaatacaaaggaattaacttaaagaactgaaaaaaactctacaatgaaaattataaaacactgataaaagacattgaagatacaaaaaaaatgaagacattccatgttcaaggattgaaggaatcaatattgctaaaatgtccatactacccaaagcaatctacagattcaatgtaatccttgtcaaaataccaatgacattatttacaaaagtagaaaaagtaatcctatgatttatatggaactacaaaagaccccaactagccaaagatatcctgagcaaaaagaacaaaactggagaaaccacattacctgactttaaattatactacagggcaataacaaataaaacagcagggtgctggcataaaaacagatacctagaccaatggaacagaatagataacccagaaacaaatccttattttcaacaaagctgccaagaacatatattggagaaaaatcatctctttaataaatgatgctgggaaaagtggatatccatatgcaaaagaatgaaactagacccctatctcttgctatatgcaaaaatcaaatcaaaagggattaaaaacttaaatctaagacctcaaaccatgaaattactataagaaaacattggggaaaatcttcaggacattggactaggcaaagattttttgaataatactgcacaagcacaggcaaccaaagcaaaaatgggcaaatgggatcacatcagttaaaaagcttctgcatactaaaggaaacaatcaacaaagtgaaaagataacccacagaataggagaagatatttataaactacccatatgatgagaaactaataaccaaaatatagcagtagctataaaaactctataggaaaaaatacaataatctgatgttaaaaaggggaaaatatctgaacagacatttctcaaaagaagacaaatggcagacgggcatacgaaaaggtgctcaatgtcactgatcatcagagaaatgtaaatcaaaactgcaatgatatatcatctcacaccagttaaagtggcttatatccaaaagacaagcagtaacaaatgctggagagaatgtcaagaaaagggagccctggtacactgtcggtgagaatgtgaattattacaactgctatggagaacagtgtgaaaattcctcaaaaactgaaaatagagtgactatgcgatctagaaatcccacccctgggtatatacccaaaagaaaagaaatcagtatatcaaagggatagcttcactcccatgtttgttgcagcactgttcacaatagccaatagccaatatctggaagcaacctaagtgtccatcaacagatgaatgaataaagaaaatgtggtacatatacacaatggagtactggagccataagaaagaataagatcctgtcatttgcagcaacatggatgagactggaggtaattatgttaagtgaaataagccaggcacagaaatataaactttgcatgttctcacttatttgtgggaactaaaaattaaaacaattgaactcatggagagagcagaaggatggttaccagaaactgggaatggtagtggggatgtggtggggcagggagtgggaattgttaatgggtgaaaaaaataattagaaacaatgaataagacctagtatttgatagcacaaaagggtgactatagtcaataataacttaattgtacattgttaaataactaaaataatataattggattgtttctaacacaaaggataaatcttaaggggatggatatcccatttactatgacgatatacattgcatgcctgtatcaaagtatttcacatgccccataaatatatacacttactatgtacctacaaaaattaaaaataaaaaacattttaagaaccattacactaggtggcatacgccagatgcaaaaagaaaatattgtatgattccacttatatggtgtataaatacctagaattggaaaatttccctagaataggctcattcacagaaataaagtagattacagattaccaggggctggagggaatgaggagttattgcttaatatgtacagagtttctgtatggggtgatggaaaattctggaaatattggtgacacgacgatgcaaatgtaattaatgccactgaattgaatacttaaagatggttaaaatagcaaattttatattttttttactatactaaaacacccttatttacaaaacaaaaccctaggagacttttttatgaaatctacaaattgattgtgaaatacatattaaaatgtaaaggatccacaatagccaaaatcatttgaaaagaactaagttgcatgatttgatctgaagactcacagaaacactacaataatcaagacagcatagtattggtgttaaccgtagatgtattgatcaatagatgacagaatgtcagaaatagacacatatatgatcaattagcttctgacaaagtgccaagataatttaataggaagaaaaatgttttcaacatattgtatggaacatcaagatatgcatatgaatacataaactctgacctttcctcagatcatatacaaaattaacttatcaattacagacctaaatgtaaaaaatctcctaaaaggagaaaactttgcaaaaaaacccaaaagtgataaattatatcaattcgttaatatagaaatatagactataattacatgtgtttgtatacatacatgtgtccagaacttaataacctgaatcttagcaacaagaggacaaaaactcatttaaaaaactgtcaaaagatttgaacagacacttcataaaaatacaaaggccactaagtacatcaaaaaatgcacatttaaaccacatttagttaccattacaaagtcattagaatggctaaaaattaaaaggctagaacgagtggaattctcatacaatgctagttgcaaagtaaaatattgccactactttgtaaatctgtttggcagattcttataacgttgaacacatgtctgccatatgacccaacaattccaagagtaataatcatatgccaaccctgccacaataaccatatcagatttattcatagtagccacaaaactggaaaaaaacccaactatccatcagtatgtcaatggatagcccagttgtgatacatcctttcaatggaatactactaggcaatgataagagaatagagtattgttattatcattacatgcaattacatgaatgaatttcaaaaacatttttctgagcaaaaaaagataggcacactgtatcattccatttatatgaaactctaaaataagcaaaactaatctgtaatgacagagcacacatcattgattgcctggggttgtggctggtaggagagaggtgtgactacaaagtggcagaaagaacatttttggataataaaaagggtctatatctttatagtggtggtggttacataagtgtatacatttgtcaaaactcatcaaactagaatggatgcatgttgttaaatgtaaatcatgcctcagtaaagaagattttaagagtagaaataaggatctatacccattactgaatctacattatatacttgctgaggctgtgacagagtgcatcatcaacgcaatatggctaagcttacccacaagtaagctggaatgtgggtataaatcaagtttaaggataagcagaataccaggtaactggcaacaccagaaaaaatttcttcctcctacccagctgggaaatatccacagtcttttctactgcaatgtacatatcccagattaaacaagtttgagagtcaggagaacactatatgacatcttcctcctaaaagatgacaactgctcttggcagtgggtacttgagacagaatttaggaaacctctgccatggctagctctcgaagtataataattagtaaaccactttatctgggagtgataataagattttgtgcatttttgttactgccattgcctccttgaccaggacagtccactaatactcagtcttccacctccaaggtagtcctttaagaatttgttcagaaaccctaggtttcagccaggaatgattttaaaacattgaaagcataaccaagtgatggtgtatatattcctctttgcacagatataaatttattgtgcagtttttctatgttgtttaataaagttcactttctctagtgatcttacaggcaacttctaatactactactaccattaatactaatactatggttctcaaacactgcatgttcttaagtcaaattcccagaggtctggggaattggggtctaagatctggtctaacctctctctggtgatcctagtacagatagccttcaaacaatttgagaaacactgcactgttccattgctctgccagggacacttaactttttagtcctccagttaggtgggagtgagttgactgacaggctagataacaaccaaatacataatcaaaatcaaatgtatcataatgtactttcaacaagttgtccctcatgaagacatagcatgattatttttgcatgggacactttacaactgatggttgatgtttacttcgttaaatgaattttaaatacaagtggcattgattctataaacagcaacatcttaggaaaacatcctgtaaagaatctccacacttagctcctagagaatggtgacaaggactgcttaaaagaacatgaaatagtttggtgctatagattaaatttcttctgagaaaaagtgtgaattttacaggtggcatccagatggagaattagtcccttcccacccacatgaagaaagtctataaaacctcttccacaacaggagaagaaagggaggacattttgtgccaagaaatttttgcaatttgtgtactagaagagtactgcaactctctggagcactccatattatgtgtagctgtgtcgtgtcaaatagaacagatactaaactacagaaattgagttaatgaagaggtaacacgtcaaagtctaaacttgaacaatggtagacagactaattgttttctacaattatatctgcttttagttttgaaaatgaccaatccagcatgagccagcatgggtcagcataggatacagaagattactaaatagatgggaactaagaccataacagagagataatccaactacaaccagctagagatattcttagaatcttgtggttaagggttttaccaacaccttgacaattaactccaaaacaatatgtaggtgtatctgtacactatttatgaatttttctgtatatatacttacattaattaattgtttagttcaattttaacagttcattttgctgagtggagcccttcattctcagtaaattttttaaggactttataaacacatacattattaataaaaagtactcaaactaggcgaatccaatcaatagttgcaattatgatcagataagagcacttatttaaatagtggctcttaccttttaaaaatatttttatgaaaattcaccacaaatactttaataaaatgagttatatggatatgaattcaattactatagctctagaaccaggtgatgaaataacaaaatgaaacagaaagattgcagaagtaataaaacagagtgagtggcaaaagaatatcattaataaaataataagatcaaagaaatgaatagacaaggttgaaaactaaattactcactagaggaaacatttgagaaacatcacagtaatgcagataaaagacacagaaacaaaaacaattatttaaaagtaatatatacagaagatagaaaagataggtaagacaataaatgtgacagaaaatgtattaaaagatatggtacaacaaagcttcaccgatattgaggtaaaaaataaacctgtatattgaaaggacacgagaaattcctggaaaaatttataaatgatcatctgtaagaaagtgctttagtgaaattgtttttccccaactttaaggatgaagaaaaataacttggctatcagttcttgctatccatccttttacctatacatataaacacagagagatttccagaatcgtaaccttcaaaattataatgattatgtctagtaggtgaaatttgagttattacatgtttctctggactttcctctattgcttgtatatttataatgaacatatgttacttttataaaagcaatacagtcattaacttaaaaaattaaagaaggaaagaaagggatgaagaagaaaagaaggaaagagacaattattgatttgcctagatactattttatcactttcttagttacctaatcattacgaaagaggaagaaaaggaggagaaagaagaagaagataaagaggaaaaaaaccatcattttgtgctgatcacagattacgtatgtgaagtcttgggaatttctgcttatgtctgatatattacaactttactgctaggaacttttttttttttttttttggcctagtattttgaagtatctgaaagagaactccatatttgtagaagcccaactgggctactgttaaaaggggtttatattccataaatatttacattctgctctacaagagctgagaaacaacttgatgtgcctgttgttcccatttaaacaacaacaaaaaaaataaattgtgaatctttctctacatctagtatcttttctaccaggtctctggtagaatgtcaattccctgaaaacacagattgtgcttttgctttgttccagacaatatgtgtctttttagggtagaagtactaaaaaatgaaaaataaaatgctaagctaattgatggttatgatatattgtttcaatccccctaaggccaggctgtgaactatttcaaccagacatagtctccacaaagttgtagatctgagtgactctgccaagcatgattctatttgcaataagtcttttacagttatctactattttctcaatcactcccttgcatttaaggtttagcaactagttcactgtatacctctccacgactactccatgcactagctttagtaactccaatattccttatcctctttttctcctgtgttcacctaacaaactgaaactctgttaaaacccaactttctatctgctccctacttgcacctcagcagctggaagtagtcaaagaaaaacattcatttgaattaactgattttatgtaaacttttaggaaagaattttaagaaatgccttcattttcttaaatttatgaccacaaatcttagaaagacctccccaccacccagcatccttctatgtttccataacaaattcattttcccactctctcaaaaatttgttttacgtattttcctctggcctcaaagcctccctcaatactccctccttccaccgtccttcactctcatatgatgaccttgacttctgtttaactgaaaaactaaaagtaatcagaagaacatctcctgattttcccatcaccaaatcttctaacttacttgtaactgacccattcacttcatttttcctcctaatatgagggatgaaatctccttggtccatataaaccaactcttcacagcgcactgaattccagcaccaacatttaagaactttgcaactggaattttcccctcctttgctgcttcctcttcagttttcctctctcaattggatcatttccatttgcatgtaaacatgttgtaaaaagactctcaccttgcaaagcaaacaaacaaaacaaacttccttaattctatttgccccttcagcttccgtccatttatctgcttctttggcaaagggtatctactctacccgctttttctttaatccactccaatcagacgtctgtctccactactcccatgaactgttcgaatcaaggtcattaacaacctctatcttgccatatttgtgtctcaattattcagtctctcaagagtattaacttaatggagaatagcattgttgtcaaacactagctttgcttgacttcctgtgaagagtgctttactggttttcctcttcattctctggcattttcttttttcctcagtttccattgctggatcctcctctcaatattctccagagttcagtccttgaacgtcttctcttctttatacttagttctcaccagatagtctcaagttccattgtattatatgatatatacgcatcccctatttgatctgtttccctgaggagccctgactaatacaataacctttcctctttgcctcctatggagctctggaatcaactcaatgtggaagatgtctcaccagtgtcaatcctttccttctttcttagtaacagtcttttattttacgtagccagcctcagtctgtcaactgaagtcgagtagacactgggatccttgatggaaggtggaacccatctttccctaaaattctacgttggagagaaacaattccaattcctccccctagcaaaggcaaagagctgcaaactctttacccctttctttcagggccattattttccccagataatctcagaaatatttatatataaaattaatacaaattgctggttggcatggtagatacagtacttgttttcatttatgctaatgagttgccatttttgtttaattacccctcacctttttaaaactagagaatacattcatcactcatgactgtaggagagatttttatcttaatatggggggtaaaaatataagggtttctagtctgttttatgctctacttctttaaaaattttaattcttccataagaaaacatgttaccccttagggaaaaatccttgattcttcccatcactctgctttactttatattaataacttgtttcattaatttttactattaacttttgacttctagcaatgttttatcactagtggattgtttcagaccaccatagggtaatgtggtaaggattaacaccttaataaaagataataaatttttcgcattttttgaaagttcaggccaagacaattttcatgtaatcatagttagagaaagctttttcacctggcttttataaagatgccaagtgaaactctatattaaaatatgttatcaagtatctccttaacttaaactgatacacatagctgttacttaagaactccaacagaattataggactcagaagtcagagatgccccaatctagaagtcattgtaacagagctcctgttaaaactcctaacttccagtagttattgcagattaacaatgttcagagcattgccaagcttctacattgccataaaacactgtatttatacctaaaagagtcaatttaccagatcctcttaaaattataataggcacccagatcctgaaaatcacccacactacttgtcaggattaattgtttctttggctttcatacgaaagtgtaaaaacaatgaaacaaagaaagacaagcaagcagaggaaagtcagacttaagaggtacagtctctaccagttgctccatttttatctttctggcagaggctttaaataggtatttgattatatgatacaaagagtatagggttctttctagaatttctcatgtagacccaaatatccagccagggttgaacactatcttttcaacattaacatgataggtagaattttaaccataaccctcatgttgcaccacttagcaactgactgattcaaataatgagcttccttttagaaaatcttagaaacacttggatataagaatatgaaagaagaagaaaacatgccaaatgtcaaccatctatattttaaagtaaattcatgcttataaatactattaaaattctccctcatgcctcaggacctgggcactaaattgtttgcaatgcatttgtgaaaagtatgtgctgttctctaaattatttcaaactgtttgtgttttatgttgaaatttaatctcagtgtttgttcagacaaactattaaaagtaaaacatttacctaagccttgtttttgtcttgtaatggcatttctgcttgatttaatttaaatctgttatttttaagtcaattagtagtacaaaaacaatattcaaaagttccatggccattttaaaaacagcctctgttcccaggattataaagcatcaatcattggtcatgacagtatattctatatagttgaaggctgctttctatatagtgaaagtaaaatatatatccgttgctcatcaaagatgtcaactgctttgacttttccgcttttcaaatatgtttttatctacatcagtgtaataaatcatttataaaattctcattaagaagcattacataacacatgccaccatcttatctaacatttctaaatcatacacttcatttgcattctttcttcttttagtttgccaggctatgttgagccacataacttttcctgtagtgacaggggaaaccaatgatccagttttttttttttccatccctgcacaaaatcagtttgactttgattaatgtgacaccagtgggggcttgactaaattaactactactttacttgttaagaaatcaattctttcagctgagaatcaaactgattgtgtttcaagtatgacctagagtgatctttatcaacattaagagaaccagtccaaagcaatagctaaagaataaagtattttaaaaatggcctaaaaactcattagctgtatttacattaatttggaattttgatcatttatacctatgctcttctgagtttgttccataagacgctaaagtgttaatgaaacactttactcacatgtgtattgtaactatgtgggcacttcctagaatgacattctttacaaagcattaatgatacagaaagtataaacctgactcagtaagtggtacctcatagaaaacctcaacattgctcatgtaacccactgagcaggaaataaatgcaccgcaggaaaatggaagcttcactctaacctatgttcttaattctgagtatgttttaaagaaaagtaaaaatgaacagaaaatttttactttatcacaaaaattacagagtgctaaaatgtcacaaattactgccctactgatttggaattgtgaaaaatccagattttttttttctttgttgaagtttgtatttgatccagtatagaaagaagtcattctcctttaaattcttttcaacccgtatagcatggtcagaaataaggcttagtttagtatctatatgtctttttttttctttttgccatggagttgcactctgtcacccaggctggactgcagtggtgtgatcttggctcactgcaacctctgcttcctgggttcaaggatccccctgcctcagcctcccaagtaggtgggactacaggcatgcaccaccacacccaactaatttttgtatttttagtagtgtcagggtttcaccatgttggccaggctggtctcgaactcctgacctgaagtgatccgactgcctcagcctcccaaagtgctgggattataggcatgagccaccacacctggcttatatgtcttttatgttaatacttctctaatatttgccaaactctctttaagaaaatttatctcagcctcaatctccctcaaggcaacagaactggccaatatttaataatgtcattttcatcacattatattgatttttatagttgccttctgtttgcaacagagaatactggttttctgttcacggtactaatataagttttctctttaaatgaatttagattgcaaagtgaatcaatttaaagagaatattgggaaataaccgtacaggtggtaagcaagtatgtcaaaaaatcatgaaagtagtaaaaatggctggatgtcaggaagtaactatatataaaaccaaacaagaaaaaatatatacaaaactgtaaagagaaaaccatctatttgaacaaattaatttcaatccttttcccagtatttgcataatatcatgtttaattctaaatgatgtatttattaaagtgggaccattaaaacctttacccaacaacattgtgatagtttctcactcagtacaatataaactcaaaaactgtaaaattcagctccttagtgaaaaaattctgtaattcagaaacttcattgaacaaatgcttatcaatcactcagtatacccaacacagtgagccagatttgaggagggacaaaaacatttaggtatccactcattaattcaaaagctgttttttgagtagatatgatattcaaagccacttgttgtgtaggatttaatgaaagaaagagaaagaggagcagaaggaggaagaggaaaaggagggagaagaggaagagaaggaggaggaaagtaattattaaataagggtcctgaactcaaagagattaccatctagttcattattacttattattgtccttgagttttacttattatactatatcattttctcacatattatctcttttttaaaatccatgtattactcagtctgtggtaatatttaggagacatttcttttgaccatcagattctatgaaactcaataacaaattcatggaatacaaaatagcacaaccttaaaactcacagcaatacttacgaaattggacacccttggcctttcacatattctttgtgaaaggggagatgctgccccagaaaaagtagtcaacattcagtaaaataaactcactgtggtaacttgaacatatgcatttaatgagaatccacatgcaaagcataacttgaaggtttaactacataaattaaaattgttctaagctgttatccttcacaaatatagtgcttccaatttttactaaatttatacatctcacttaggatgtgcagttgtgatcatgatatataatgtttattaaactacttgcatatatagccgcctcttcttcctctttactctgtgcctgaagcctaatgaagacttctacaaaaaaagacaaaacctattgtgttctaaggaatagttgtagttttttaaaatatgaaaatagattgtgatgttcaacacttaaagcaaatttttcatttctgattcactgaagacagatttccaacaaaagctttataccatatgtactcacatatcactatttttaaaaattaaaatcttacagaaagattacaagacttccttcatatcctaaactttgtgtgatagtactttcttaccttctcagcctagaatgccttccttctgtattttaagtggatgatgcaactggcatgaatgctacagctgccctctaatccagcctctcatttgaattactttgtaccttccacaccaaaaaacttgagctggcaaatactaatatcagccacctgtgaatcgacattaatcatttcataacttaattgtcaccaacagtattgaaggaaaaacaacatttggtgtcaaagagactgaaccagaaaactggccctaaggaaatgtgagtgtagtgatcctagctgggaagctctctgcgcttaactgtcaactcacctggattctgggctaactctgtttcctctgcagaaaatgaaaaaatatgagatccaagcacctgcaactcctcaaatccacctgaagccaatccatctgtgttccaataacccaggcctaggtttccttctgacaagatcgatttctacttggttctatagttctactatatgcatcctttgctgtcttttcttctcattctgtatacccggtgtgcccaatactgtgctagcaataagaaacaaagaagagcaagtctctcagagcagggatgcacactaattcctaggatttcagtatcttatgtgacagctttatctaattttcctttccataaaagtataaatattttaattttttgcaatgtgaaaaaaatttaaatactccataattgcaggcatttgggccttccgctctacttaaatagcatttttactgccttggatgtcataatgaaagcatttgcttatttttcttgcaatgtttttccttcagttcacatcacagcttctatgatggtcttgggttgctggcttccttaatggtgccatcatatagaatcactggagtttcctggtaattggaaataaatacttcaaaattattttaccatgaagctatttttaatattctgtaagatttgtcacttcccttttattccttttacaccttatttaaggagaaaataatatccttgcttcaggaaaaagaaaaaagagaagatttccattgtttctatcacaaatccaaaatattctcaagggtttagaaggtgtattagcatcttattgtttagtcctactgcagccttcttgcagccagaaggggaaacactattcacacacagagggtggcagagaggggacgagaaacagcttggggtcattgaggtcattgctaagacagtgaaccagctctgggcctcttatttctagactttctgttaagtaaatgataatgatccttgtggttgaaaccacttttaatcaggaatgcttttacctgatacccaaagttaccctgatatccctataaacacagcttgatcagttaactagttcaatcaaggatgggtgggaggactcacaggctggagcagagaggcggccagtttcaagtgatgcccattctgggcttcccaatccagttttctctgagctgttttctgtagttgggttttctacagtgaacataaactgtcaacctctgctcagagagtcatgacagcagaggcatggagaccagcagaatgacctcacctccaccttctcccctagtgtaaacacttgacccatggctactacctaatccacaaaggggaaaggaaggcaggtgcctgtggaccacatttcctatggaaatgctataaacaggagtgtcctggctaactggctctctggtggggatgggggatgggggatgggggatgggggcagtgggcagggatgaagagttaccctgatgtgtagcctttcccaagttttgtggtataagtaatcttaccatagatgtcaaactgctaacagatcagtaacctgctgacaatattcctgaacatttaactattgactctggaaagccagataataatttaatgagttctttttcaggagctgtttttgtttttgagagaatcctgtgaactaagagggaactctactgaaggaatgtcaagcataaaacctataatcaaatcctctcttcatggagcttatagtccagctgcaagttcagcaacatgcaatacagaagcaagaatcacttgcttataaggtaagatgattataaatgcaaattaatgtaaagcaaattgacatataagcacctaagacaaagtgcatcagcccatctcataaggtggctgaaaggtccaaatgagattgtagatgagaagactcttggtgagttatgggccacagcagaaatgtaaaggatcattcctcttggtgtgcagtgaggataatcagacaaggcaccatctggattcccagaacatggtaattgataatgacaaggtcaaagatggaaaggcagaatgcctggggatactgagaagacagagaagcaaataggggccgctggcctcaaagacagtggagcaaattgtgttcaccgatccaaattattttctagcacaccatcgctgcctttttcatcccatttattatataaccatgaccaagactttaacttatctagtactcaaaagctccacctgcgaaagtgtcttcaaggggctgcttttaggatattcaggatgaagacctaaatgatcttcagaatagccttctacaaattcaatgtctcatcatgacttagtaggttagcagcacggcctttgggactgaattctgactctgccacttgctagctgtgtgccttgtgtaagtaacttaaactctcagtgcctcagtttcctcatctgtaaatggagatggtaatatttaactcataatacggttgtgcagattaaacagacataaatataaattacctaggacaatgcctagcacatagtaagaactctatagctgatagatattattggtattgattttaagagtataacattcaaaatttggcttaaaattcttaaatggtaaagaaattataggcaattaaattagttttgccacctgcctttaaataagatggttctaaattggctaggatgctttctttctgccacttagagtgtcaacttcaacttaagtgtggccttcctgtgaaggaaagtcagttgacgagtagcaagaaccgcttcatacttcaggcacatccaacatgggaggggagaaaggaaagagaaggagagagagagagagagaaagagagagagaagaagaagaagaggaagaagaaggagaagaggaagaagaagaagaaagaagaagaagaagaagaagaagaagaagaagaagaagaagaagaagaagaagaagaagaagaagaaagaaagaaggagaagaaggagaagaaggagaaggagaaggaagaaggagaagaaggagaaggagaaggaagaaggaagaaggaagaaggagaaggagaaggagaaggagaagaagaagaagaagaagaagaagaagaagaagaagaagaagaagaagaagaagaagaagaagaagaagaagaagaagaagaaaagagagagagagagagagagagaatgaacatgaaccaaagaagaaagaggaagagtcattctgagcatccaatatatgtgtcctcctattacatcacatagaccaaaccactgtgtccagagatttgtgatatgctgataggatggagctggaatgtttctttgggaaaacggaggttcaagtaggaagagaaaaaggtaaggggatggatactaggctgttaacctacaaatggcaagtatagttttaaagccattttctgtattcatctgttgaccttaaaccataaggtacaggctattcaacaataggcatgatttgtactttcactgttcgcaattccgaccactaccctattacatctaaaacatgaatctggctgcttatccttggattttctacctccataaaatgataaagagaatgttccttatatacagaatacctgagctttaccagcaccaggactggttgttactctatgtttttgatagagctgattttcctatttcattagggagacatatatcaacatacagaaggttgatgtataaaaaagaaataagcccaaccagctgaaagaggaagaacttaatttattgctgaatagtgacaatcaattcaaatgattttagttgaactgacattaaattataacctcttggtttaagacatttgagagaatgagatccaaagaaaaagattgggcatatttttaaaaattccttgaatatctcttattcactgtttttgccatacaaacaagcttagatatttgacttaacactgccctagttctcaagcctctagtttctcttcatgacagtagctttctattatgatagatgaaaacccaaataacatttattctatcctattggaaaacacatgaaaatgtccaggggagaagcatctctaaaaataataaatgaaatacatccaccaataaagaggaatagaatcgtggtctctgatctcctttttgaggcactattcctcccacgggagttagactgtagcagaaatctaagcatggccctaattcctacattccaatcctagatacactaaaaggagcagaaccaggtgaagtaaacttaaaaggaaacaaagtctttatgcattccaaaaacaacacttttctctgtgtgtaatccccataatcaaattgatgcttgaatgacaaagcaagaaaaatgatataaaattggggaaattaagaatgatataatcgtgttactgcctctgtgccctatatatctaaatatgtatctatcaaaaaacctctccaacagaacatggtgacagagataaatttcagtttgacaaatgcaccaaacaaaaaatgaaatgtatcataaaccattgctctttctcaatccaaacagaaaaaaattcctaaagaaacctgcattctttataataactagggtaatgtatgatgtgttctctcaatttctgaaatactatgtaagtcacgaatctaaagccatgcaaaagttatacattcacaatatgcttgtagaagattcatgttaaatgtggctttgctcatagttttttaaaactggtagttttgactacaaatactaaaataaagtttattaaaattttttcacttttcaaacaatcatcttagtatagagacactgccttattcatttattcattcaatatattcagataattcactattttctataaaagaaaaatgcccatcttgattaatgagatcatctatgaagcaattgtgctaactttcctaagtttcatacctattaatttcaaaaaatttccactaatttctgcattataagatcgattgaatgggaacatctaatctgtctttacaaaaccctttattactgcaactataatctgtagattttaatactgttttctgatattttcatcaatactgcagaagttgtccatatctatcacaaaattcacgacctattttaagtagctaagttctcttaaattttactacaaagtaatcccaaattatctaaattgattattccatgagtcatgagcaccaaaacatggtatataaatgagtgtactgcttgatggagaacattgatcagctgactcctgttcacccttgatcttgccatcccacatgtaccagcacccacaaccctacacgttgtactcctaggtgatggcaataagaatacagaacagctagagctatttgccaagctgcagaaatagcccttggtgatataaataaatgatgtcacaaatgacaccaagttttcaagcttaagtagctagaagaaggtgtcatcattttcaaagaagaaggtgtcatctttttcagaggctagaaaattgagatggggagctgatgcatgtcatttggaacttcttgagtgtggggtgatggagaggcattccagttaaaaagcagtaggcagtcagatgtgtgataactgaaacctgagtaagaaaactgggatggaaatgtaaagataatactcatctgagagaggggaagattaatccagagagagagaagcagggacagaaaaatagaaatataaatgaatggatgaatattaacgaaaatacttaaataatgcttaaagtgagaacagagtaagaggatgaaaagaaatgcatttttttaaaaaagaaaaaacaggaaagaaaatccaacaaaatatattcattattaatttattcaaatatttattgagaatccactttatcctaggcaccgtgttagacactggggcaaggaggaatatacagattcaaagtaaatatggccgctggcctcaaggaatttatagcctagtgaagaacagagcaaagcactggacaaataacacacacatacacacatacagaccaataagagtaattgtaataaatacgcaaaaaagaaaaaaatcaaaaacaaaaacaaggtccaggtgctgggcatatataaagggcagctgcctcactttgcctggagtgttagagaaagttacactaagaaaatgacatacctggcaaatgagtaataaaaaataataataaggaaaagtgatcaccaaagtcagagggagcagagtcagcaaaacaccaaggaagagaagaggaaaacacacaatggagagcaataaagagccccctgaaaatcttaaagtggctttttttttttttttttaccatttcctcctccatttaccatcctagtccaaaagccaagtgtaagcaggcagttcagggctagggtttgggtcagggtggacactgctaacttgttacccaatacacattcaccagttctacctactaacagaaccccacattttttaaggtagcaatgagcctagacaaattactaattttgccggcctgccttgtagctaggggtgactatgacaactcagaccaaaaagtcatatgcaggaggctgctaaggattaccaggaagttttgctttcccaatggtaacacagcccctttctgcttgacacctgattttctttttcttaccttgaacaacaggttggaagtggatcagtcatcttgtaacatgaggcaaccataagaatgaaagccacgtactaaggaagacaaaagggaaaaacagacgacactagagctttgagggcatcctggagccactgcatcagttccagactgtctagctgtacactttgttacgtgagaaaagcagactcctatatggttaagtcagtgtagaccagtttcttttacttgaaatcaaatacaatccctagctgatacagggttgtagtgggatgggaggaggagttattattgttaaggaagtgatcaaagtagggatgacatatacagaaacaaaaatagaaaccatttcaagtccctttttacaatatagacacagttactacacaaacacatgggataatcaaactatacaatgaatgtgttaccttatttaggataaggctttagaattataaacgttatctcttggaagctttgtagctttaaactattgaaaactggtatatttaaagacacagttgtcacatcataacattgtccttaaaaacaaactttctccattgctgtatatgactcaagaccatctgagaaggtaatgggagtgttgttctgagagctcagccaggtgctatagcaaatggttagacatttaaatagcattatttatcataagtaacatgaaagaattatcttacagtctgattccaaaatgtatgtcaatttggcagtaaaccagtgcctttttaattataaagcataaatagatttctaacatttttcttttcctaattatacacactgatttgtcatgacactgccattttgcaggatatgtaaaaatcagctctggccagcttgaacaagtattacaaacaccaagaatcattacacgggcacactctataacattgtccattgccgcacaaatttcactgtaaggtgtgtccaatctgatacagctttgaagtcaaaaaccttaagatttgaatcttatctctattgaatgctaattatgttacccaaagcaagtcacccaatctgtctgagctttggtttcctgaatacctatattttgtgagtattaaatgagatcctttataaacaaacacaatgagcacaaaggcctatctacaccactgcaagctctctgcaaacattatctcctttctcttttgccctttctctacactgaactacatttgaggaattttcattaaaagaaacagaagtaaaagctagtaaaattcattcctacagaacagatcccaacctaattaagtgtaacacaaaaagtgagtttctacttaaattctgaggcaaagattataaatacacagaagcccaaatgtggcaattgtgcctattatcagaatagcatgcagaccataaaaagaatattttaaggactgtttccattttcaaaaggctagtaagttagtattatgtaatcacaaagctatgctagaaaagaactttcagcagtcactctcattttcccaaaaatacagtgtgggtcatatgcctgggcacagccctgagcagagagaggttgcacttgggggtagtgctccctgatgaattcaccctgctctcatctttctgtgatctctcacattcacagctgtccatctccctcaccttgaaccagcacagaaataaagaaaacaaacatctcccctaggagagcagccagaagccccttaccaagcatcacctccctgatgagttgtctttctgactatttcacttcttttagggcagtctggcaggcaagggacagtaagaacaaaatgtttataactctagtgataaaacagtagccacaatcatggatacttagaattcatattttcctgcaggaactaggtgtgaatggtatcatcatcttggccaagctcaaaaatgcccattcatttaatacaaatgtgttacctcactggttccctcctaagaaggtgaggggaagaaccatcatcacctagccttgtaattattcagattacatttcgttttatgtgacagtggtcaaatttgtattattcttctgttgccctaattatcatcataaatcaggaaacaagaatctcaatgtccaattaccattcagaatagatagagataggaaattaaagctccttttaagtgggagaaagggcaattccacagagcttcccttagctaagggaatggatactgtgctgaatagtacattattgaagaagagataagcgattgtgtgatgtgcaattgccaacactttctattctttcaactttagttttaaatgcttacaaggaataacatcttcacatttttcaaaaggctgctacaggagaaagccacttatgctcacttatattcacaagtattgcaaatacagcaaattattacttaaagaagaaagaggaagagacacagagaccaaaagaaacagaaagactctgaagtcttggcttccacactgtataggactttggccaggaatgttttccactgaaaccctgccctcactactatcctacacctccccagctgcttcctttaaggaactgaagccagaaaggtactgcagagggaaattttttttaaagaaatcaacttctcagaaatataataagcccaagcctaaactgttgttttctctccttggtaatttttatttttctaatgataaaagtggctactaagtgatgatactaatttccagcaatttaactatatgttacttctcaatgtactcattacagctatgtcactgtaggtggtataaaaaggtgagtcaatccagttgtttggacagttcaatcaatgactcaaagtggtagatcttgtaactctgtttaattacacctaaattaaatatccctagtagactttattcagaaaaagacaatacacatctgtgatgtcactagaaaaatctacttgccatgctcttaaaacagggacctcagctattgacataaaaacatttttagaaaaaagatttagccacacaactagtaatagttattaagtttgttagactgaatccaaccatttttaaggtggtaaatacaagattagattcagattagaaaggatactagaaaatacaatgaaaagatatgtgcaatttttatgtctctgactttagaggattttttaacaattttgtgtccttccatttcagtttcataattgagttgaatgccgatgaaacaatatgtcatccaaacctaagtcctatgttgtaggtgattaataattgatgacaatattaaaactgctcttatcagttctaacttttctggctaggaactagctggctcacagcccaaacatcatagtaagccatagttaaaactgcctttggatcttattagaataacaccacttattttcttcctttgaactgataatgtttctttttttttttttccaatacaaattttattatggcagcacaggtcactgtgtggtaactgtctgaactctaagcaatcttggaagcagtggttcttaagtatagttccaatgtggtctgtaaggatcttctagatgtttgaaggatttgtccaaaatttaattcatttaaaaatggagatgtatttaaatatataaatcagtttccattgcaaatgtcaacttataaaagacaaaatattatttttttaaatttaatgactataataattctttaccctacccaaagcaccacagaccactcatgcacccaaccctgacaggggaagagagatggagaggcatgggggtggagggaggaatggggtggggaatgaagggagaataagggatttcgcttcaggccaaaaggtatgtaagaataggttgggtccacagtttccaagatcatgacttctaggaagaagcatatgaatcaggaaagaaagacatcagagacagaaagagaatactttttactaatcaaaaaaatctcattaattgtaatgcaagagtattatacttgtaatgcaagagtattatacttttctgtacattttgtttcaccaatcacctaaattttacagctttttacaataactagaaggcagtgtagcatagtgacttcagtccaaaacccagttctcccacttaatttctctaagcttcagtttccccatctataaaatgagagcaagatctatattatgagaacatgtttttaaatacctagcaagatgctcaattgacggtagtaacataataaattagagtaggtgactttctagaaacccagctatgccccctcgccttagtcttgtgtggtctagcattggtgtgaagtaactgcacacttccacttacagggtgatttttctaataccctgaaaggatacttttatgttttcggtagtactttggttttcccaactgttttcttcataacgggttttctcggcttttatcacaggtgttttttctttatttagaagaaaatttaaacaattataaaacgttgtttattcatccattatttatagtttattattatggcaaatctatttttaaggctttgttatgaattagtgccaacaaccctcagaacaaaatttaaacaattataaaatgttctttattcatccattatttatagtttcttattatggcaaaacctatttttaagtctttgttatcaattagtgccaacaaccctcatgttattcatagaaccacacagtatgcaaaagggacagacactgaaaatactttccaactgtacataaaagaggttaattttcaaacccggacagtggtatttaaggagaaaatttgtctccaaatactcacaacagctagtcatattctaaaacctaaaaccatgattatttctcctttaagttttaaactattaattttacatttcaaagggatgttagcttagagccaaaaggttttgatcatttcatcaactaaaaactgtaaaactgaattcatggaaacaaaccccccaaaaatctccttggctgacaaaaatttccaatttcaaatccacagtcatccttcattcagtgtttgcacagctccatggaatcttgtttgctcattaaagtgaggccctccataaatagaaaaactacattggaacccactatgtaacacaaaatttctaaatattaaaagccataccatctgaagggcattttagaaaatgatcagtaatttttctaagatgtattcctgacactgcctgtaacttcaaaatatctctgcatgtagggaggactatttcacgtgttccttttgatattaaagtcttttctccaaggctaggcctgtaaataaagtaataaagtagcttttttaaaagagggaatttagtcaaatatggaactggttttacatcactgcactgctactcatttgcttgacgaaattgatagcttgtcaagtcttgtatttggctattaacagctgccacctcttctacagcattgctggtgcatattcttataaggattaaataaggtaagattaattaatatgcctggcccagggcatggcacttagtgagcactgaggacatgacagctgttaatattttaatagcaattatttcacaattgctatgaagctaagggagacagaaagatttgtccagcattcaccatcaggggtttccactgttttctggggcctattctgtattcatcattaacaatgacaacaacaattgagatgttaatacgatagtcagaaaatagagctagttactgtggaactgggtctccctgtttccacactcgtcctgtcctctccattcttcatatgtcactcaaaagcatccttctaacacacaagagacgacatctctttgctgactgaaaccctccagagacttcacactgagaataaaataaaatccaaactttcctgtggcccacaaggtctcccagaaattgatccctgacctcatcacatatcaggtcttccctccttcgagtcacactggacttatattcctggttttagcacctgctgttgcctttgcctgcagagctcactcatgttttcacatggctgggtccttcttttcatgcagacatcagctccaaaaggccacctcctcagggcaaccccaccacaccctacctagaaaagcctcatccctcccactccactgccctgcccttcatacgatctcaccaattccattttatttccttcacttcctcctatgtttttgttgttgtttttatttatgtaataattttatggaaaaatctctgcttacgaggacataaacataaggccatttcccctaacagtgctatgtcaactcccccttcctgagaggaatcagctcctttgtagaaacttggccaaatcctatagcttctcagccacttgagcctaagagcagtcccactttgacatttaagacttggccctattcattttaaaatatccatctcaaaatttattcaaatctaggctcttcctgttcccagaacaaggtagactacagggtcttttgatagagagtggagtgaaatcccctctttttacacacttcttttcataatctccttaaacttcttactcttctttcctcagacactagacccttggggaccatcaataccagccaccatacccaggagaaaagctgcatgaaggaagagactctttattttctattttgcttgactgctatgaaacaacaatattgtcccccatccttttccttgccaaagtgcagtgttttagctccgctatgtgctagtttagagactgggagctgcctctcttttagtcccacagtccatttgttcatttattcacatgaacaaacatgtactggatgctttgtatgtgccaggccctgtgctaggtgcaggaacaaacatttcttggagtttcctgtatcttcaatatttacatttattttttttcaagttgtgtaccactcactggaagtcaatatcctgtccagagacagtccacaagggagctggcgaaaagcagactctattttctctattagctgtatcattgtcattctgaaaaatagaggagctaggcttgctcccagtagaagcaactagagctactttaatttaacaattagaatcatatcatttctaggtgatttatatatatatactttaagttctagggtacatgggcacaaggtgaaggtttgttacataggtatacatgtaccatgttggtttgctgcacccatcaactcatcatttacattaggtatttctcctaatgttatccctcccccagccccctgccccctgacaggccctgatgtgtgatgttcccctccctgtgtccttgtgttctcattgttcaactcccagttatgagtgagaacatgtggtgcttggttttctgtccttgtgatattttgctgagaatggtttccagctacatccatgtccgtgcaaaggacacaaactcatccttttatatggctgcatagtattccatggtgtatatgtgccacattttctttatccagtctatcattgttggacatttgggttggttccaagtctttgctattgggaatagtgccacaataaacatacgtgtgcatgtgtctttatagtagaatgatttataatcctttgggtatatacccagtaatgagattgctgggtcaaatggtatttctagttctagatccctgaggaatcgccacactgtcttccacaatggttgaactaatttacactcccaccaacagtgtaaaagcattcccatttctccacattctctccagcatctgttgtttcctgacgttttaatgattgccattctaactggcatgagatggtatctcattgtggttttgatttgcctttctctgatgaccagtgatgatgagcattttttcatgtgttttttggctgcataaatgtcttcttttgagaagtgtctgttcatatcctttgcccactttttgatggttttttcttgtaaatttgtttaagttctttgtagattctggatattagtgccttgccagatgggtggattgcaaaacttttctcccattctgtaggttgcctgttcactctgatgatagttgcttctgctgtgcagaagctctttaattagatcccatttgtcaattttggcttttgtcatcattgcttttggtgttttagtcatgaagtctttgcccatgcctatgtcctgaatggtattgtctaggttttcttctacggtttttatggttttaggtcttacatttaagtctttaatccatcttgaattaatttttgtataaggtataaggaaggaatccagtttcagctttctacatatggctagccagttttcctagcaccacttattaaatagggaatcctttccccattgcttgttttcaacaggtttgtcaaagatcagatggttgtagatgtgtggtgttatttctgaggactttgttctgtcccattggtctatatatctgttttggtaccagtaccatgctgttttggttaccgcagccttgtagtatagtttgaagtcaggtagcgtgatgcctccagctttgttctttttgcttaggattgtcttggctatgcaggctcttttttggttccatatgaaatttaaagtagttttttccaattctttgaagaaagtcagtggtagcttgacagggatagcattgaatctataaatcaccttgggcagtatggcctttttcacaatattaattcttcctatccatgagcatggaatgttcttccatttgtttgtgttctcttttacttcatcgatcagtggtttgtaattctccttgaagaagtccttcacattccttctaagtttgattcctaggtattttattctctttgaagcaattgtgaatgggagttcactcacgatttggctgtttgtctgttattggtttataggagtgcttgtgatttttgcacattgattttgtatgctgagactttgctgaagttgcttatcagcttaaggagattttgggctgagactatgggattttctaaatatacaatcatgtcatctgcaaacagagacaaattgacttcctcttttcctaattgaatagtctttatttctttctcttgcctgattgccctggccagaacttccaatattatgttgaatatgagtggtgagagaggtcctccttgtcttgtgttggttttcaaagggaatgactccagtttttgcccattcactacaatattggctgtgggtctgtcataaatagctcttattttgagatacattacctccatacctagtttattgagaatttttagcatgaaaggctgttgaattttgtcaaaggacttttctgcatctactgagataatcatgtggtttttgtcattggttctgtttatgtgacagattatgtttattgatttttgaatgttgaaccagccttgcttgcatcccagggatgaagccaacttgatcatggcagataagctctttgatgtgctgctggattcagtttgccagtattttattaaggattttcgcattgatgttcatcagggatattggcctaaaatcctctttttttgttgtgtctctgccaggctttgttgtcaggatgatgctggcctcataaaatgagttagggaggattccctctttttctattgattggaatagtttcagaaggagtggtaccagctcttctttgtacctgtggtagaatttggctgtgaatctgtctggtcctggactttttttggttggtaggctattaatgattgcctcaatttcagaacctgttattggtctattcagagatccaacttcttcctggtttagtcttgggaaggtatatgtgtccaggaatttatcgatttcttctagattttctagtttatttgcatagaggtgtttatagtattctctgatgatagtttgtatttctgtgggattggtggtgatatccccttttatcattttttattgcatctatttgatccttctttcttttcttattagtcttgctagcagtctatcaattttgttgatcttttcaaaaacccacctcctggattcattgattttttgaagggttttttttgtgtgtctctatctcctttcagttctgctctgatcttagttatttcttgtcttctgctagcttttgaatttgtttgctcttgcttctctagttcttttaattgtgatgttagggtgtcaattttagatctttcctgctttcttttgtgggcatttagtgctataaatttccctctacacactgctttaaatgtgtcccagagattctggtacgttgtgtctttgttctcattggtttcaaagaacatctttatttctgtcttcatttcattatttacccagtagttattcaggagcagattgttcagtttccatgtatctgtgtggttttgagtgagtttcttaatcctgagttctaatttgattgaactgcggtcggacagacagtttgttatgatttctcttcttttgcatttgctgaggagtgttttacttccaattatgtggtcaattttagaataagtgcaatgtggtgctgagaatgtatattctgttgatttgaggtggagagatctgtagatgtctattaggtctgcttggcgcagagctgagttcaagtcctggatatccttgttaattttctgtctcattgatctgtctaatattgacagtggtgtgttaaagtctcccattattattgtgtgggagtctaagtctctttgtaggtctctaagaacttgctttatgaatctgggtgctcctgtattgggtgcatatatatttaggatagttagctcttcttgttgaatggatccctttaccattatttaatgcccttctttgcctcttttgatctttgttggtttaaagtctgttttatcagagaccaggattgcaacctctgcttttttttttctttccatttgcttggtagatcttcctccatccctttattttgagcctatgtttgtctttgcatttgagatgggtctcctgaatacagcacaccagtgggtcttgactctttacccaatttgccaggctgagagatggggagcctccttgttagataaagttccatttttaatagactttattttttagagttttagttttacagcacaattgatcaaaaagtacagagttcttatatgtcctctgtcccccaacctcaccatacaacaaacacacaacctaccccattatcaacactcaaaagattctttttatgtgcctggcgaataaaaggtgttcaaggttttatgctgagtcagtatagtcttgaccaagaaatctgcccaggtgaggagtggggttttctgaaggcagcaccctctctgctacccttccagggggtggcgatgattcttttgcctttcctcaagttgagtgcttcaaactcctactcctacacattggtccagctcctgcaccttggccactccccagatgcctacaagtggagctgctctaacacctgaggtcttctccctcatgggaggaaaggggatagctcagctctgaaaaagcactccccagaaggttcacccctcccagtcttcttatactgactggtgcaggtgggcttagtggtaaggttggttcttacccagtgcctctcaataaatacttcaagagagctattccaggggccagtagcaccttcaacttagaaaaaggggcacttaattttctggtcctcaactttgagccaaagccccaattctaggactaacgggggaataccgttgatatgtatcagtttactctctgtttatctcaactcattcttttattaatcttcaccatctcagtctatcctcagcacctagaacagtgtctgacacataatagtactcattaaagatctgttaaatgaattctatttggaacacttctaaaccagggaattaactacatcctaatgaaacccataacatgctgaatagtactggtagttcaaaataaaaagaatctcgtgtccatttagctaaaatgtgcatctatttaacctatttcggccaacttaacaacaggaaaactactttttttcctacatgacatcccttttaaatgttcttggatagaaaggatgtccccgactcctctttttcaccaggcttctaatgttacatggtttccagacccactgaccatcttggctgaccctctctgaagaattaatattacttttaagatgtggtctaccagtgaagagcagctggactataacttcctaagagctggacaatcctcttctgttaatgcaggttgcacttgcattaggtttggggcatttgttatataggattaatttcttcagcagaggaaccacacagttggttcacatcaagccaactgtgtggtcaacacaaaccccaggttttctttatgtagattactgtcaaatcagacctccacatcctgtattggttcaagtcacttcctgaaatataaatgctgaatcttaaatttagctccactacatttcttccttttgtttttttccccttgtttcagtatctagaggctttaaaaatgttggtatcatattatttgtcattatctgcaaatttgacaaacatatttctctatgtccctatttatactatttttttaaattatttattttcaattacctgaagagaatggagccaaccaagagccctgaaatgttctagagacctccatctggattggccctttttgaacatggctgctcctcccactgcaaatccacctaaatccatctaatggtgccctcatgcagttcacatttttattgtatctctctgttacaaactctaaagcttttaagaaatactctgttgaaataaaaatacagtacatcaacaaattaataagatcaccttattctcaaaggtatgtttatgttagtgcaatatatgtatagagttcacttattttcttcataaaaaaatcatcgagttatctgctaaagcactaaaaactatcctaacatcaatactgttgttctgaacttccaaaaatctttgtacctttgttgaaaatctcaatacctctccatcttcagattcttcttaagctccataagtgcctgcagaactccaccatttccagggccaaatcttcacattctttaatacctaagaagttctacatctgtgtctggggcagtgacagtgcctagaccttctattttctcctcatctaccttaggaattaattagttgttcatattcatatgtcttgtcctccctgtcccaatttgaagattattagctcttctagaaagaaaaaaatagaagtaaatgaagatgtgaattggtctttcttttctccatatctatcctatcacaccatcatgtccaagtggtgaacctattcttttactattcctgttattccaaatttaaatctaaaatatatttcatggttcagcacttttcaaagctacagtttgttctctttgtgaggcccagtgacaccactgtgctcatcccaggaacttaatcctcacagacatgctccaacagctctcacactttctactttagcgtttcctgtaactgtgcattgctatttccctcaggactcctgctccaggacactgtcacattcaactcactttcactggttgggtgactggcctctagcagcatttcagaggagtgagctctttttgcccatccgtccacacccccatcaggtcacactcctgggacactcaaattgtgcagtctaccaccaaagaagactattccaaccatctttctagcaatgctctgctccttatagaaaattgaagccctgtactttgtaaaggttcatttactgtctcaatttggggtacttaaaaaatcaatagcaatcttaattcccaccagagataaatagcccaaatctttaactatgcatgaacaggggaaatttaagaaaatataaaaagaccacatagccctcaaatcatccattccctttgcagaactccaactctccccagtatggatctcttccagatttgggtacaagaggggatgactaacagcttgtggtttttttctataagataagaaggataaaagttttctatttttaaattttatttttgcttttttgttgttgttatttctactaaatgctgaattgaaaagcatcttttgctgtacaatctagagagaaaggcttctatctaaaacttctcccaaaggccattctagatatccttaatcagtggatctccagaaactaccctgaggcctttcgtttccttttttttttttttctaacatggtatcttgttttaataatattttcttgagcatagtgacaagaattttttcagatgttatttttgtctcctggtctgttgctttatttttttaactcaatttacaatgtttcctccacttaaaaattataaaaatcttcttctgtgttaacttctaattcttttgatctatagacctacgtaacatatgctttaatcagattgaatagcaatattctctttctttggcttcatttctccagcctaaaaatcttcagcttttaatttttttttaagtttttcccaatgttccatattacaagccttacattattcttgagacttactccaaataatctctatggcccctatgtcagattaggacacctatatctctagtaataatattaattataattgtaagtagtagaaatatctaaacatttattgagcacctatgtaccatgaactgatcagctcattttacctgtaccacttcatttaaaccttacaaaaattttattttacagatgagaaaactgaagatttaaaaggttaagtagtttgctcaaagttatagaaatcatgtatgttagaaccagaattcaaacctggaaagctgggttctttctccaaatctcatgtacctcatcatggctttctattgattatgcagaacactatatacacttctcccacaaacctttagatagaagggactttcctaagtattaaaccacaactcctatgttttaagagatatagagaacaatcaccctcatataaattctggacacataaaaagaatagactccattaataatgaaagctaaaatcacatgtgtaaacacattgcttttaatctattcaattatttccccataagcactaactgtgcatcacaaattatggtgtctaaaagacataccacaagagttaaagctgggaagattcattgtcattctctaatggaatagttttctgaaagaatgaaaattctgaatctctaagatggaatgcctccatccactgtttctttatcctgtttatcaaattggggaaggaaatgcaagacaaactacacagtgatatcactgcataattaattggtacatctctaccagttacatataaatacattttcttttcatgtactttaatttaggagttgcaaaccaaccatgctaagcagccaaattcagcctgcagaaaagccttaattgtcttacacaaatgcatggacagtctccagtttgccattggcaatactattccctattgtgtcacagctggcctgttatgatatgtttatatagcttgtaacaaccactataggcatttgagtttatgacccttgagcagatcaaatgactacagacagtaagataaaagcccatattacagacctcattatctgtactacaggtacactgccccaaaataaacttaagaggtaaagcagctaatccactgcacaaaaaaccaacagttgctctgctatactaaccttattccccctgttccttcccttttccctcttcatatccagacctaaatggcaaagtttatctttgtgcttgttgttgactcaagttcagactaggaggctgcagagtcagattacaaaattggttatacaatctatgtcacagaggtacatccctgaccttacacaaattcagtgttttcactagtacaagctccaggggataaaagcaaaattgtactcactttatccctcaaataactctgaacattgctgtagagtagatcatggagacaaaattggttttttggaaaagaaaagaactaaatatcattctttcctccctaaaaatagcactactgtaggaaatctcataaaactctgaactttcactcaagccatttcaaaagtgattggttggggtgggcatgaaaaaaaatatctgcagagctttaaaagcaaatatttttaaaagctaggaaagtgagcatggtcataaacgaaagcagctcagtttagattggttgccagtaaatagccagaaaaagaacttcagccttcaaaaagagatttcaaatacatctttgtatcactgaaataatgccaatgttggaaatatttgaaaatatttgcagagctgtattttagacaacgaatgatactccataaaaaacaattcttttcccactgtggggcagaatgtcaaaacatgacaagatcactagcccagatcccctggaaaacaccatagaatcatttcaaaggcaagagattacaatgatatttgccttgttaaggctgtgtctatacggtgccagcaaacccttgattaggttgattcactcaagcaaccagtcgatttcgtgaaacatttactcaggcctgtgtagtttgcataaattaaccaagtgattgattgactggctggttggattggttggatacttggctggacttcaactgactgctctcccacatccgcttcagccacttggagcgcccagccacagtagtctcttcccaattccactctccacaaggctattacttgtttctcagcttatctctctaactaaatactgagctcctcaaaaggcaggggcagcttcctctctatcttccaccttcagcacagtgatgagcatcagactccacatagtgtgagaaatcagtcaatggtgtggcaacttacaagctgccctttgacataattggaatctgtgatgtttcttaatccccacagatttcatcatgcctagagggacctattaaaaaatgttagttaattcttcccgtagaggagccacacaggctcccatccccatactgcttccctctcagatggcttttttcactctgttctcctcttgagcctctccctcttctaattccacatgtcacgacttccaccaagcattccctgacaatatgacaggtatttctctcttctgacttccgctgttacttgcccccaacatttgggcttttaattaccaactactggcttgctctatatttatcagtattattgcgtttcactcgcctcaaagattatgaagccctttgagatttggaccagtatatttgttaagctaattccagttggctttcttgtgaataattaacaagtcataactatcagttgtccagtgttctacactttatttcactcaattggtataagtgcagttctaattcttatacctacaccatattaaaaaaaaactgaggtatagaggagctaaggaatctgcttatgatacaactagtaaatctcccttgtacccttcttaatggaagtggggtatctttctgttcagtcgcatatcctaacaaaaactcttcagttttcctgcaagaaaactgcaaccctttctccagcattattgttaaggaagatgactgttaacacagaatccacaattttaatgcaaactcatggctacccaatctgtatcctcaactaggtggaaggaatcctttgtatttgatggcctgcctggagcacctatatattgcccaaatactcaaaactttaatgcccattttgcaaggaagagcagcagatccccaccctgggatccccatagtattggccctaataggattgcttgtattgagttgctactttgaaagttgccatttggtttggtcaatcatagagccaaatgtggggtttgaccatgggtccatggctaggagattgtaaggacactgcttgttacgccgcacagagtgcccttcattatgattctggggagagagccctgtctggttttagtactaaggacagacttttcccagagcaattgttctgtcttttcttctggatcctacggcattttcaactaaccaggtttttctttttggttagagctaaatttatgacctatcctaagcaagtaaacaggttttatagtcatcttaatcttgctcctggttctatttaatgacccacatttacctttccttttaattttctcctgcttttaatttaaaatagacaaacagaaggataagagccagagagacagaatattgcttacccctcagcttctctcagtgcctttgctcaaccccacacttcctcccacataatcagctcaaaaaactgatttaagaaaatcattttacatgatggtgaaatggtttttaaccaatgtttgaatcatagatccctttgctaagggtatagatcttctcactaggaaaaaaatatacaaccctatcaaaaatatttcaggaactcatggatctctgaggctgaagccatgtctatggattccagagaacaaacccttgcttgggtgcatacacaaggcttctggtatccccaatttgcctcccaggacttgctccaagcccagaagacttgggggaattttccaagctactgtcaccaaggaagagcccaggtctctcacctgtctgagcctctccctcccccaacctcacttctttcctccctgaccaaagactgtgacatgctggtccctcttgctctgttcttgcccccactttatgccacaacttacctggcattctggacactcatctgcttcctttctctcaaagtattaccatcctgctgcatccatcagcccaggctgcaaaccccaaagttttgctgtctcacaatttcaaaggaggatagagggagcaaggagtgggggctactaggaccttttaaattagaggacaaagaggttaaaggagaagcctgcagaaccacaaacaatagcggagatatctcagccctgcagaacacaggatcacaaggagtcatagctagtcagatgctgaattccagacatgtgcatgcacgtgcatgcgcatccgtgtgtgtgtgtgtgtgtgtgtgtgtgtgtgtttagttacactatatatagtgtcaggaaaaaactgccaacttggatgcttttaatatgtacctcagaattaatgaagaaaaagtgaaaacatggtttgactatgtaaaagaaatgccaattacagttacatatgaaatacatgtatcatttttgactattaattcgtatggcagtatacatatctaccactaatttttattataaattgcacttgatttgcatactgaatgttgttttctgtcagttgagcctcaaaatttgctgctcacaatttccaacattaaaggagacgttgacaggaatcatagcttatactccttttgtttttcccttagcatctaaataacatagcaagatatgcctggaaattgataatctagctgtggagaccagagtttgtacacatacctgaagccactgaagaaaaatataagacaatacgtaagaaagttacagtacacatgatttatagaaaaatacgagaggagaggatgggccaaagtaagaaaacaacatgaagaaaatgagctttgaacttacccttaaagaaaatatagcatataaatttggtgaaaggacattccagtccaggcagaaaaattgttttctctgacacacaagatatttaagatctaaagaactgtttatttcatattagtgtgctcattacattataataagcttcgagtgaactcacataaagaacttaaaaagattattttttaaatttatttacctacaagtatattcttgtcagttaaaagaaagagaaaataaaaaattcagaagacagaaagctacctataaaactttaataaaaataatccattgtaaaaatggaaaaataaaatctccaccagtgaatgacatacaaaactttatattatctgctaaaatggagtggtaggtatttctttatcttcttggtttgaacctaatagaacaatggctgtatttgaccaactaacaactagaaataatgacagtggatagtgaattcatttaatcatggtaaccatagccaaacttattataacatataaagtgaaatgcctgaaagacaaagttaaagctaaagactttgggaaacctccaaaataggtaggaggtcaaagagagccctcaccccacagttgtctctgaggcttagcaaacttagtgcactgcaatctgaaatcagagggacccattatggaggctgggtatattggcccacttcctctaaaaagtaaaggttaatacaggattaaacatgaaagtagtttagtaggtgttatgggatgcactaaacattcatatgttgaagttccaacctccagtagctcagaatgtggctgtatttagtgacaaggtctttagaaaggttaaaggactaataagttaaaatgcagtcattatgacgggcccagtccaataggactggtgttcttataagaacaggaaattgggacacagacacagagagaagaccaaccgaagacacagggagaaaagaaccatctaaaagccagagagggaggcctcagaaaaaagcaaccctgccaacgccttgatctcaggcttttaacatccagaattttgggaaaacgaatttctgttccttaagccactgagtctgtggtatttgttgtggtagtcccagcagactaatttatttgggggaaactccttggggaggaaatgaggagggagcctgtggagggtgggaaaactgtgagtccacaatgctggtctggtctgctcttgagtgagaaggggaaggggaaggagaaggggaaggggaagggcaagagaggggaaggggaagggcaagagaggggaaggggaagggcaagagaggggaaggggaagagcaagagaggggaaggggaaggacaagagaggggaaggagaagggtaagagaggggaaggggaagggcaagagatgggagtgggaaggggaagtggaagggagaagaaggggaagggagaggaaggggacggggaagggagggggaaggcgagggggaagggagggggaaggcgagggggaaggtgagggggaaggtgaaggggaagggagggggaaggggaagggaggggaggggatggggaaggggtatggaggggaaaggggaaggggaagggaggggagggtgaggagggaggggagggtgaggagggaggggagggtgaggagggtggggaggagggaagaaggggagatgggtgggggaggagggaggggaggagggaagaaggggagatgggtgggggaggagggatactatagtccaggtctaaggcaagttttgcaagactatagaggagtcctgtatctccaggaatgggctgctttagtctccctgccatgctgagtcagcaaccaagaacagttcacgggcagcattggtgatgggtttcagagcagagctgttgggtttgtcagtttattacattccaatacctgagaggcacattctcatggccaccacactggaagacctccatcactgtggacagtgcccagcaaggactttacactcagatgccacaaatgcccatccaaatttccactgaatgaaccacgtttcctattcagttaccgatgtgaaactacagaatcatctcattttctctcaaggacaaatatttcatgctctacaagagtaaaaccagtgtagccaaaccccactgactgaagaattatagctacataaaagataactgtcctgcaagttacttctgtattccttgtgaaaaaaaaaaaaaagagactggctacccaaattaataatgtaaataaggacagtgatggccccactgaggcttgtccaaagcaaggcccagtttactaaccccggaatgggaagatcaaacctggtgttgggagtttggtcccaagttaccacacaaactcattctgcttctcacctttcaagcctaccttctttcctttggatggggaatcaaaatgcctctttcttaaagctacgagctgtctaatatgctacatgaggaagagaatgggaaaaacaaacagtacatgaatagaaaaatgtgctggatttaaagcaaaaagatataactaatctgacatgtaagtccaatccttgcatctccaatatgtagcatagtggttgatagcaggtgttcaattcatgtttgagaaataaataatggcaaacgcattgaattagagttttatagtgattaataataaatgaaagtagttcctttaaatgatagtaattagcatgtctgtggtcaggcaaggagggggtaaattacccagagcataaagttgcagtgaggctcttcttaagttctctgaatcaagggccagtcccaaaagcaggggaacaaaatggggcatagacagtggactgggatcagcaggtttcagggcaggtttgcatctgtaggagagaggaggctgaggtgttccattttacttcctttacaatgccggtgcagggtaacgtttaggcagggaaggctgaaatatatgacatatgggctcccacaaatcatcatcacctcaactcaaaatttatcagtgtcttccttgtacttataaaatagaagtttccattcactcattaattaattcattcatttagagccaatgatcagacgctatgctatttggggaaacacaaattaacaaaatgtattctctaccatttaagaggaagacaaatgtaccaacaggcaattatagtacaatgtatgagatatgctgacagagattatgttctatgaacaaaagttctctacaggaatatggaggaaacagactttattccagtgaacagtttggaaatcagagagacacagcctgctgtgtaaaatgaagctatgttccggagaacaatgagagtgttctgttttatagcaaaacctcctacccaggtttccagtcaggttggtttatgcaaatgaacgatggaaactagcttagtgctggttggctggcacagctgagttttgattgatcaatacagcttagccctgcttggttgatacagctgagccctgtttcatccagtcgagtcgagggagctctgattggttgagctctgattgagctctgtttggtttccaaacccaaaaccaggagtcttggctgatgtttctttctggtgagaggaggggggattgggcctccgttcatcttggcactaacaataggaactggtttagcttgattgtagaaagagaggtcctgtgatacttttacatctttctgagaacacaattaccattccttcccccagctaggaccacctggttctgttttaactttgagagcctcagcctcaaagattccattttcagtctgccaggggaatactttagagttcaaagggcctccagagcagagacaggggaaaatacctgtctgcagggtaagtaacaggattgcaacaggttggcatttgaactgggccaagtagagcaccagagagaaaggaaatgggttatatatctagacagaagagcaaagaaatggcaggtgccaaggcacagaggggtcatggttttgattaagatgaagtggggaggtgcaatcggtgataaggttttaggaagaaacggaaaaagaattttaaagataaaaccctttgcagattgacaaacctgacaaaaacaagaaatggggaaacaattccctatttaacaaatggtgctgggaaaactggctagccatatgtagaaagctgaaactggatcccttccttacaccttatacaaaaattaattcaagatggataaaagacttaaatgttacacctaaaaccataaaaaccctagaagaaaacctaggcaattccattcaggacataggcatgggcaaggacttcatgtctaaaacaccaaaagcaatggcaacaaaagccaaaattgacaaatgagatctaattaaactaaagcacttctgcacagcaaaagaaaccaccatcagagtgaacaggcaacctacagaatgggagaaactttttgcaatctactcatctgacaaagggctaatatccagaatctacaaagaactcaaacaaatttacaagaaaaaaacaaacaaccccatcaaaaaatgggtgaaggatatgaacagacacttctcaaaagaagacatttatgtagccaaaagacacatgaaaaaaggctcaatcatcactggccatcagataaatgcaaatcaaaaccacaatgagataccatctcacaccagttggaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttaacccagcaatcccattactgggtatatacccaaaggattataaatcatgctgctctaaagacacatgcacatgtatgtttattgtggcactattcacaatagcaaagacttggaacctagccaaatgtccaacaatgatagactggattaagaaaatgtggcacatatacactatggaatactatgcagccataaaaaaggatgagttcatgtcctttgtagggacatggatgaagctggaaaccatcattctcagcaaactatcacaagaacaaaaaaccaaacaccacatgttctcactcataggtgggaactgaacaatgagaacacatggattcaggaaggggaacatcacacacggggcctgttgtagggtgtggggagcggggagggatagcattaggagatatacctaatgttaaatgatgagttaatgggtgcagcacaccaacatggcacatgtatacatatgtaacaaacctgcacgttgtgcacatgtaccctaaaacttaaagtataataaaaaaaataaaataaaaaataaaaaaccctttgcggataggtggctctggagtcacctgcaggagatgctgggtagccaagggcatggtaaggcaatggacttctgaaagaacaatgaccaagaggtttctagagattagggggacaggagtcctaaagggggagctggagaataccaaagacaaacttgatttgttttacccttttcacacaagttacatatttttaaaacctcttcttaggacctaattttctcaagtcttgcttaatcccttgctcagaagggagaggtgaacagaggaaggggttcccccagcagcactgagctggctctctgatgaagtgggggcacctgtggaggggaagctcagagctcaccagatactgccaacagcagctgcacaggagggtatctgagaggaagctactgttcccagaataattaactctcttcagaaatcatgggcacagacacacaccctctctctgaagcagaaccaagctcaagggctggagatttcctgttccccaccatcaggtggacagcccactctccctactccacctgcctacagacaaggaagatcaatctgggtggctaacacaccttgccctagagtaaccaagattagaaagatgcatctacttttccacatgggacatgaaattgagtctatttaaaagttctggcacaatttagatattaaaattaattaaaataaatctgttactagcaatctacctaaattatgcatacaatgtttctcagtaggtactcttttgaactaccgtttagctaaaaaaaaaatcaatcaccaaggaatttaagtaccaaagtttggcttgaaacttcaaatccctccatgtcaagcaggaaagcagagctaatttagagggactgtccagccagggatggtgtcaggcaggctgagggcaatataatgattttgcagggaggtaattaaatgggacataacagcaattatagcagcaacggctaacatacactgaccacttccagtgggtcaggcaacaacatgctaagtgctttaagtgtattattttcttcaatctttttctttagtacacaaaaaaagtacaaaggaaaatatagcaaaacctacatatccaccacccaaaatttaaaaatgacattttgtcatatttgcttcagatttttttattttaaaaaagttgcaaatgaatttatactcccaaatcccatttccctctctgtttctcctcagaaacagccactatgtcatgaatgtggttcatattcagtgacattttcatattttaccatatttatatgtgcctataaatattatagagtattattttaggtttttatttcctgaaatcttttatcaactcaaatgcatgacttcaaagtctatcactgtggattaatttgttccattgcacttatcaactttgaacatactgtcagggaagaattttattttctgttttattaaataatgtataaatagtgtggcatattcatattctttgcccctgttttctatttcattatctggagttttttttttttcagtaatttgtaggagtctttgatctatcatatatcccaatatcttccaccaggatgtggtctagctttacctttgttttcggtcttcagtcattcaagagatgcctaactccaggcagtctaatccgttattttttccttacctgatatcataaaaatatccttttgtatctatatctacctatctatcctgtaactgtattctacatacagtcataaagtctcctttttttgcatttggtctctaatccatcttcaatttatttttttaaatggtgtagagacttaattatattttcatcaaccacaacaaaaaaatagattccattctttcttcactaattggcaatcccacctccaccatatacccagatcccacacgtgcataacttctcaagctacctcttctgttctctctatttgtctatccctgtgctaactccaaagccccatgtcatgtactgaagcttttttacaaatcaatatataggcaagtctttgttttttgcctgtttgcttgggtttcacaattgtctggctactctttcaattttatatttccatatgaattatagaatctgtcaaatctctcacacatacacaccacaaccagttgatatttaattggaatttcacaaaatgttttaattgattgtgactagacagcttttcaatacagaaacatcccacatatctaaataagcatagtattatctctctaatcatttcagacttttctctcaataacgtttatattttctattttttcctaagtaacatatagttttagttgatgttatgaaaagcattttttcaggtgggcggatcatgaggtcaggagatcgagaccatcctggctaacacggtgaaaccccgtctctactaaaaatacaaaaaaattagccaggcgtggtggtgggcgcctgtagtcccagctactcagaaggctgaggcaggagaatggcgtgaacccgggaggcggagcttgcagtgagccgaggtcgcaccactgcactccagcctgggcaacagagcgagactctgtctcaaaaaaaataaaaaataaaaaaaaaagaaaatcattttttctgttacatttttaatgagctagttctggtacagaagacagagttacttactagcaaatgtcactgtgggcaagctctttatctcgctgtgcctcagttttctcaaatttcaaatgggaataatagtgctacctaataaagttactgctggtgagagataaataagttaacacatgcctagtgcctggcacatagtaattaaatgcaaatgttagcttttattattaaaagaatattaatttgcatattgattttatatctaacggccttgaaaatttatgaattatcttgaattttcttttaaataatgatatactctgagtatgaacaaatttactttcttctttcttcttccttataaacatttctctttcttgccctattgtattacccaggactaacaatatcatgataaatggaaaaagaaatagcaacgttcctgtcttactctctttaaaagacatattctaaaattttcacctttactatttatgtttgctgtcatttttcgctaactataatactatttatcaggttaaggaaggccccttgcattcctagtttggtgtgcgatttcatcatgaataggtcttgacgaaggcatttgattttctctaatttaatccctacattgtagtctacactgaacatttagcaacaatatacattgggccaggggtcagcaaactacagcctacgcaacctgtttttgctgttaaaaattttttttaaaaagtttattggaaaacagccacacccatctgataacatattacccatggctgcttttaagccacagtgacatagttgagtagttgatacagaaaccatatggcccacaaagcctaaaatattgaccatttgaccccttacagaaaaaaactgctcaccctgatatacagcatattaaactgctcttgttacaactttcactctaaattgaggggttagtgaataagcaggaaaggaggccaaagagttttaagttttttttttctaacttctcctaatctctgttccttctaccttctttcatgtttacatttctctctttcctcttctctcttcttccccctttctttttccccttctcctttttttccccttgccattctacacttttaaaaagcaatgcagtccagatgcagtggctcatgcctataatccagcactttaggaggctgaggcaggagtatcagattgagcccaggagtctgagaccagcctgaacaacatagtgaaatctcatctctacaaaaaacagaaacacttagccaggcatggtgattcatacctatagtgccagctactggagcagctgaggtaggagaatcacatgagaaccagaggttgaggttaaggctgtagtgagcagtgatcacaccactacacatagcctgggtgacaaaatgagaccctgtttcaaaaaataaaaaataaaaaagcaatgcaaaatatcttcctttgattaaataaacaataaaactgtccaacatttttttcaatatgtagtgataaccaatatatagctaggtgctttactaagttactttaaaattcatttgctcaacaaacatctattgaatgctatttgcaaggcactgttctaggtgtctgaaatataacagtgaacaaacaatgattcctgcccttgggaagcttacattctaattgagggaaatgaacaataaaaatagagcaaatagtaagtgatgaaaaaaggaacacacagaaaatggtaagcgggaaggggaggggaaagaactacagttgtgtaaaggatattcagcaggcctctttgcaaaggtgccatctaaacaaagatttcaatgagagcatgaacccccaagcccatggcaggagcattcctggtgtgtccaggcaatggcagggagattgggatagctgggacagatgaagcagagagaataggaggtgagatcagagaggttatggagaccagattgcagaggccctggtgggctttactctgaccaaaatgagaagccactgaaagattttaaacagaggaataaggtggtctggcagatttttaaaggcttacctttggccattgtggtgagtacagtttatagaaactgcaaagccattcaagaggccatggcagtattgagaagaattcacgtcatttaatctctcagcagttggataagatatatactatgcccttcttccagatgcagaaagtaagatgtggaagtttaaataacttgccaagtcacacagctaatataaagcagagctggttttaaacctagagtccatccaaggtcaaaggttggtatctgaagttagactagtttggatttcaccttgtgaaaatgcttcataaactatttaatgtatgatattataattaagagtttcatgattttagactaatcatgtatattttatattttatgaatttttagataaatcatacttctaaaataaaaaactagttggatgctatagttccagactcctggattttgttcttgaatggcttatggataaaagcccctaagttttcacgtattagatttgcttcaaataaacctatagacttgggaatttatttactctagccctaggaactagaggctcgccattatattcttattctcccatagagtttcaaattatattctttaaaagacacttcatgactggagtgttgaatcttcttttttaagcctgctgactgataggtagattccatgttcaaatctcatcttgcacactgtaaatatcttccatcataattttagtaggtctagaaaaatcatctctctctctgttaaacatacacatacacacacacacagaggagcaacattactggcaagaatgataatatatatggaaggatttactaatgaaatatttctgtatattcttcagtgacaaactgggtggctttatgttaaacaacataaaagaaagtcatacaaatttgatctccagtttattcgtgttgagtttgtaaaccatgcacactgacgcaggtttacaagtaaatgatgttgagaaattcaaacacatacatatgtgtgtgcaatccatatgtggaaatgcagtcaataatttatatcaaccagccacaaatatttattgcaattattaaatggctcctaggcacaatcttaggtcttggggattcagtgctaagaataaatgggcaaggattcccatcctcattaagcttatagcctagtagggaaaccaaacaataaatacttagaagtattaggagagccatgagaaggagggaagatgtagagctgttcttaacatgggagcaaagccaggccagcatggtggagggacgatggtcacagaagacagccccatggaagtgatgcttaagctccacttgaaggacgggtacaggttatcaaggagaagagcaaagcagtgagggaggaaagaacttctcaaggaaagagaagggcttgtgcttgatagaggagaatccaatgccttaggagaaagaagaagtgggggagtctggtgtgcgtggtggaaagcagcacaaggtgggtgccacataaagtgatgctggagacaggcaagggccaggtcaggtagggctgaaagatatggatttaactttgaggacaatgagatgccacttaggaaggatttttagcagtagaatggcatatttagctcttattttttaaaggtcagtctggccactatgtgaagaatggactggaagggaacaagaatggagcacatttagaaggccattgcaatcacccagatgagaagtgcagtgatctggacagaagcagagacagggtagatgaaggtgaacagtttcaagtcaacagggactgactgtgcgtgggggatgtgtgaacagcaggagctgataaggagccctcattttcggacagggagggtaccaagaccattcagaagactggaaccatggaggaaatgctacttcacaccaggtacgaatccatttcaagtgtgttttagaggtagaggtaggagtgaaggtccattccagcaccaattctccctaccaacctgaattgtttattgcaaaagattttatttcattggtctctttttactgaaggtataaatggagtgtcatcttttcaaggagagagaaacagatgccctttgagaaggggagacggaaggggaaggaaagttctgaaggcagaggtgtccagagaagccgaagcatgcaatgggaggcacaggagtgagagtgaacttcaatagacacacactgacccaaaagagttgtgcatcaaagacacattctgataactctgcaacttttgcagagagccgatgacgttctaattgtaacatttccctttttactttttcttccttggtgaatggtggtagacctattgattacaccataaagataagagggaaaagaaggaatgactgcttttctcatataattatctttttaaagtccttgtcctggtttgcacactcaaaaaggaacacagaatttgcaattatagggaagttatttctgagcataattaaatgctctccatctttctctcacacaaaagcttgcaaattccaagctagtagatttttgaatcctatcaatcatttctatttttaaattatattccagatttattatatgatatactaattataatacaatatttgcaataatgaaaatgtatttgaatagtcaattggaacccacaagtcaactcctagatagatgccttagtggctctgaaaggtggtccccacttgggatttgttaaaatgcaaacacctgggccccactctgggtgtacagaatcagaaattcagggagtgaaactcaacagtctttttaataagccctccagttgattctgatacatgttaagattgagaaccacttcttcagcagtgtttcccaaccttttcccttcgtggcaaaaaaaaaacctgcacacgtaccctgaacctaaaataaaagtttaaacaaaagagaaaatgatggcatttgtacaataccccatgttaagtggataaggctgccagaggcttgccccagaccctatttgtgttggcctgagcagctcaccgtaaccttttcatgatccaccagcagaaaaactcagatctgaagaaactcacaccagtgcaaaaacaactatatatacattctttttgttaattatggcaccatttccaacaatgaaaaattatccaaatacaaattaacaaattgtgacatatttgtgcatagaaatactactcacagttacaatgaataaactggagttccatgtatcaacacagagaaatctcaaaaacataatgttgagcaaaaaaaaaaaaaaaaaaaaaaaaaagcaggttataaaacaatgcatacattttgataacatttatatagtatttataacatgctgaacaatactgaatattgtttgtggcatgcccacatgtagtaaaatcataaaggcatgcataagaatgatacatagcccttaggaaagaggaagaaggggaatcagggatgtgtattcatggggctttacccattttatttcttcaaatatctaaagaaaatatagcaattggttaagatgtgacctggggagaaagggaatagttacacatgggtttcttatatgacttgatgtatttttctgtatagttaaaatgtttcatgaaaatttttgataagaaaaaaaaatcagttggagtctgctatcaatttatccgagttgtaaacccaattttgtgttagctctttggtgttgggcagattactttctctctctgggccttcatttcccatttgcaaaatagaaggggctgagttcagtgacctctgaagctctctgcctcttgcaccctcttcaatatatattggtgctcaaatagaaatactcttagccccttctctttatcccctctatgcataggcaacaaccttctcagtagttgttccctgtccagctgtctaccttaatagccccttgtttacaatggccccagcaaatgggctggggactaataacacatcacaaagcaggaattgtagaacctgtgtttgaagatatattttaagacaaagagaataaaaataaaaccagaaaagtttggtacatagacaagcagtgtaggatttagaaaatgaccttgaatttgcaagcaacctttccttgaaggagaatcttttccctgagcaatgaatttcactaagtgaaagagaatttcaaatcaacattacagcaatgttcactactttattcctactctttaggcatcacctctatctccttatcgctcaccccaacattagatatgattcaatacaactaactagctttttcaatgaaagaaagcttagtttctcatgtttaggaactgattcctttgatcttccctcaagttacgacttacataggcaattccctttccaaataggctagtttgtagattctgtctttgaatgtgctcagtcatttcaacaatattaacatcataatattgatgaactatgcctacaaagggcgactgattttgactaatttattatttactacaaaatatttccaatgtacaaaaaatatactcaccatcaatatgtatttttaagttttactaatttgcacactcaaatcagcagaccaagttaaaatggcatcttctaccttgtgatttgtgacaccatatcacaagcttgagggttccatgctcctttttaggcacttggtgagtgtgatatggtaggaaacatatttaatgtatggttttagctctaaaattcactgactaagtggttttaggaaatcattcaacatctcttggcttcagtttcctaatctatgatatagacaaaatggactttgttatttacaaggtctccccatctttgaaaccccttggttctatggaatgacctaacaaatccattgatctggcattgtggccagtctcagtctaagttttgaactcttttggttgagaaatgataaactcattaatgagatgcaagctagattcaatgcagtgtgtatatgtgtgtgtttatacttacttatattgattatatacatatatgtgtatttcatttaacagaaggggctggatgcagtggctcatgcctgtaatcccggcactttgggaggccgtggcaggcggatcacaaggtcaggagttcaagaccagcctgaccaacatggagaaaccccgtctctcctaaaaatacaaaaattagctaggcgtagtggcgggtgcctgtagttccagctactcaggaggctgaggcaggagaatcacttgaacctgggaggcagaggttgcagtgagctaagaccacaccattacactctaacctgagtgacagagcgagactctgtctcaaaaaaaaaaaggggggggggaatatacatttcatcttggttattatacaaaaaattcccaatatctggcacataacagcatacagttaatacttactgaattaacaggattcattttaagttcatactatttgatatactatgctagtgacattaaatgacaatttctcttttaatccttacagtaactctgagaggtagatacttcttaactggtataggtttacagtactactaaatacgagtcaggattctaagtctgacttggcccatctcagtgataatattaatacccaaaagatagacatatgctttgtaaattaattttataagagcttcacccttgtatatctaattacttctaacaggcattcaacattgacctacaactttatatttcttccttagtactcccctgaaatttcttactattcactgttatgatgtgcctcgctgctgattaaaaaactaactcaaaactaaaataatgagggcccaaaatgagaattacttagtgggatccatccagaccttattcttatttaaataaatacagttgactttactacctgtgaatgactgactttggaaattatttgtggtacctattttatcccactaaactgcttaatatatcatattatgtacatcaacctcataactttctttgagggggttattagtctgtttggttataaaatgcagtcaataatatgcattgcattacagcaaaacatctgacagaaaacagaaaacaacatacccaaacagaaaagatggaaaaatgtagactggatgttagcgcaactagtaactcgttgaacatttgtacccaaaaggctagtgaataagagaagaacctcaacctggaaaaagaattgagccacaggattctgttctggacctctttctgttctcaaatattatcaatggcttagatagaaaacaaggtcctaaaaatgttaagacaaaaacactgagtgggataataaataggttgtataaaccaaaatagatatggtagtgtacagatatgggtcaagttgaacaaatcaaaatttaacagagataatcataagatcaaaaataataattctcaagtgcagaatgctaaaaaaaaaaaatagttggcagctacctagacagaaacatagaaactttggttggcaataaattcaatatgaaccaaccatatggtatgactacccataagctataccacctttaggtacaataatagaaacaagaaatttctgtaataatagaaataaaattttctcagagaggtgagattataggcctgctctccttgccaaagataacttaattccatgctgcagatggattttggtgttgaaccttaaagaaacagacaaactggatattcaatttcttataccagaagaagggaacatttttttaaatgatgtttttcgtctacagaaaagaaaactaaagaaggacatggcatctatctttaaatattttttaggtagtctatggaatgaaaatagtcttcatctgaaggatccaaagaggtcaaatgagaattaatacgctcaaataaaggagattgtgacttggcacaataaagaaatatatggtatggacttatcagaatgtgagttctcccatgttgggtagagggacaaaaggctgaacaaccaattagtagaatattgtatagggaattaagtcactagtgggagctttgtctgaatgaattttgaggtctcttgcaaacctgaaagaaaataaatccataatctacaaatggcctaaaagaaaggtgattgcaaaagacttattcacattactaacggtctcagcaagatatggtgtgaagtccaatctgctacccatccccaaatatttatatatacacacacacacactcacataacacacatatgcttcttatcaaggtggaaaaaacaccaaagccctcattagctcagattctactgtttcaaatgtgtaacaatgcagaagaaaataggatcaaggtttgctatctctaaggggaaaaaaaaaagtttgcgaagtgaattgctagggtaaacaagattctgggaggaagcttgaccttacaaccaaagtcaaaaaaacacaccattaaaaataaatagcttatgatttctgtacaaataaatcttcccaatttctcaatgacccattctttaactcagctcaggtatgactgaacagttataagtccttgctagcagtccttactgaatactacacacacttgaaaataataaagttattaaaattttgtttaattcagctttcctttgaactaggcattccccaagtttaaattaggtttcattaatttaagttatttcaggaaatttttgatgatatgttgctctacattattcttgagtacagataagcaagaaatggccatagatcattcccagccaacacaaagtaattattatctagaaagagataaaagtaatattataagtaaactattacctagaaagagataaaagtaagtaagtagtccaaaactaaccttaaagaagcaggagatcacacaaacaggccataaactgtagaagcacattaaatccaaagctgccaaattcatgacatgcctggcaggtctgcatgggtgcacaacctgagcagctgcccagggcctgtacacagaagggaggtacacttagctaatgatctactgtcaatgtcttaaaagtgtcaataatttttgaacactgggccccacagattatgcaggtggtcctggagactggcacataatggtgactgagatatgaaaagcaagcaagtaaaatgtatacacaccggcaaaatctaaaaatagctccatttattaatgaaaaacaatatcctgtaatcaagacacagcctgttggttaacgttataaagaattactttgcttgtttaatgtgtaaaccaatgataattcacaaatttgctaattgtttttctgtagatgtgagctgtcaaccggtggagcttaagtattcaaaagtaatcaaccaccatttcaaattccatcaaaaagtcatgtatcactttcaggagacatgaaattttggtacatttttactggagttgcagaaggagtgataaagcaaaagtgaattttaaaacaacaaagcaatctcctcacttcaccacagaaaattaaatgtagtgaagcagctttgtgacacttcagacttttccagtattctctggattgtgaactgacaaagctacatatgagtgaaaaaaaaaatttgaacttttgctcaaattatattcaccctaatgtggattgtaaagttcctttcaccagtgagaaacatacagctttatatccacgtttacagaagagaaagagttaccaaaactttaaatatcaaaaatatttttatgccactgtcttatatacttcagcataactcatttctaaacatgtaaatctagaaatgaagcaatcagagggaaaagttaagatgaagaatcaaacatcaaatccatcttggttctagtctaacaaatgtttccccactggatttcaagttcatgagtagagtctatgtagctctggagaaggtatttaatagtaacctagatttatataacaacatttgttccaaacaacatttgcatacatcatatagtttgtccatacaatatccctataaaaacaagaaaaaaaaagcatcctcatcattttaaagatggtagaactgaggcacaaaacatataaaggtttttccaagatttcacacatatacaaagtaaaacatatttgaaaatcatttctcctttttaacatatctctattattaaaatctgagtgcaagattattgttataaaatgtatgcccagaaaagatattagttacaatgtaatttcaattataaatcattttacctggcactctatgaggcactaaataatttttaacaaatatgcaaattaaaagattatattttctaaatctcattgtgaaattatgtttaaatttagcaccagctcatatcccacaaaaaaaaaaacctaatatagggaaaacttgtgatagaaacagtctattaaatgaaattatattttgatttctaaagctgccttgcaagaacagaggttacaatttctagaaggagccatatacaaatttaaaaagagccataattcatgcaaagaaacattttctaacctgtaatttatagttcagctgcctttctaaaatctcaagcttttagttaaataattgtagatttgttgctcagtttaaaaacccttctggaatcacgtctttaactggcgttgtgacgtcttacgtcatgatgttgcgtcaccacgtgatgacgctgtgccatcacaacacatcatcgcatattgacacaatgtcatggcataatatcatcaaattaaattcatcagcactccccacagcctggccccaggaagggcaagagagctttaaagtttctctttgttcttgtcaacacactcctggttggtaggcgagaacagcaactggacaaatcatttcctggtctattaaaacttcctagatctcaaattaggagaatttgaaagttacagcttagagttggaggaaatagttttcacggggatagatttcatggcttgttactcaccttgccccataactagttacacttgaatcccattttaaagataaacatttataaatgttagttcctcctttttttcccaggccctaaaataggatcatatttaggctggtgaaaaaaaaaattaatttgtttctaatttcttgccctcaatgtccaccttcctcaaattgttttccttcaccacaacattcctcttctataacattctgaaatagcaagtaatggaggataggaggcagatccagtcaatagttttgactacagacatttatataaggctggagggtgtgttgaaagctgtgagagagggccttttgccatcacaggcttggtgacaagcagagtctccgtgttagcaactatgataaacctgggcatttggatgaaacatttatctgaatgttatctgaattaacttatgaactcttccaaaaatatgtagttaccagttcattaaacataatgggcggtttgtgcagactgtcagtgtgtgacctctctttcattagttcatttgctgtgtgccagacactgttctaggtacaagggctcagatgaaacagaagaaacagtgtcaccttgaggtgctcacagagcaataagggagacaagtgagcaacagatttcaagacaacctgctaagggctctaatgatgatatgacagagtgttctgaggactcagaaaaggaaaggataatctagggttgccaagaagatcctataggggagagaacatatttttgtatcttgaaaaatgaataggcagagaagaaaaaaattccacattcaaatgcaagaattggacaagttggacatgtgggagacaccaaagtattagactaaatccgtcattttgtagatgttttctcaaaatgattggttcatataaattttttttttttgcttttttttttttttgttttttttgagatggagtcttgctctgtcacccaggctggagtgcagtggcgcaatctcagctcactgcaacctccacctcctgggttcaagcgattctcctgcctcagcctcctgagtagctggaattacaggtgcacgccaccacacccagctaatttttgtatttttagtagagaccaggtttcaccctattggtcaggctggtctctaactcctgaccttgtgattgcacccgccttggcctcccaaagtgctgggatgacaggcatgagccaccgcgcccggcccatataaatgatttttaagaggtactgactcacactcatattaccataatccttcatcataattacaaatagcctctagataactcatgaatacgctgcatcaatgcagtggagttttcttgtaggagcattttccatccatgagaccaaatatgttccttctctctttgtaaccaaataaaaactgaaaatcaaagccacttgtactttcttgaaagcatctgactagccataaaaaccttggcaacttctcttctggtgtgtacataaagatggattaggaatatccctgctgctgattcaccttttaaaacaagcactggaaaaacacttcagcccagccaatgataagtggttatatattctgacattaagccccacatgaaagtcactggtagacattttctacagctaccataatcctcaagaggtgtttagaaactagacataacaaaagaataaaaacttgaggggatttcagtcctaaaagacttcatctttctgagaattacatgacatcgaaaggcaagttttcaaacaagtttctaaaatgtcacttttaagctagacaaacacatatctttttagaggttatgagagcaattatttaaacttgataaaatatttaatgtatggctttgaatctttaatgtatggccaaataaatactcatatatgatatatacacatatatattcattaacatatatattttataaaatgatacaaagaagagtactagtacctacactccaaaagacatgcaataagtaataatttggttacagaaagagagaaaaagttttcaaataacaatcctttttcactgatagtttatacaaaattttatcatgaataggatagtaagaaacaagatacaatatgaaatttgcttgaataagtgatatatttagtaaatggaatacagaaaatataggcagaatatctgctgaaaataggaacccaatgatatataacagtccaatatggagttagtgaacttcttaagatttgtttctttaagaattataagtatggcatgccttttttaaattccaaatccagaagataaacaagaatagcaacatgagaaattcctagtttttgcagatttagtcagctgtatattaatgtacttttcatctagatagaatttaagcaacagatgcatgtagcaaaaaaaaaaaatttaactcattttgtgtctttcagagcaaagaatcttttgtagtagaataatcacccatcatttgcctacttagcaagttcagggttccacatatttgctttttcaaatagggacacatttgtgcaaatgtgtccagttatatagtgatagggtggccctgaaagtggggctgaacatgttcatatgaaacttgcctgcctccatgttgcacacctaccttgtatacctgagacaggtataacaaacaactgcacttattctttctgtccccatagcttttcttctacttctttaggactcctaagattcacatgaactgaagcaaaatatccacagagagacattaaactttatttacttacatgaataattttctttaaatcattgaattcacagaaaggaaggggtaaaagtactcctgcttattaaggactatgctagctactagaaattgtgctaggtgatttacatatgttatctcatttcgtgcagttacttatttaatgatcttgaaaaggaatacaattattaactaatacaaactacaacattcagctgtttgaattaatctgatagctcatcatttttaaccaaaaaaatacattaacattttcaagtgtctctatgaactgggcattattattttaaaattaacccaacttattttcccatggttactaggtgaatgggcacagatcaagctaccaatttaatcaataatttctggctttggggcccctgcagcagaatattcatctccacctttatcttcctttcccccacacccttcctccccctgctgatgcttgtggaagctcaagttctactgtgtttccagatcttcctctaccatctggggtgttgactgatatctctctgctatcgttactgatgacaggactttattaatgtcatctcagtgtctatcttgtcactgctcaattcaggcctgcagatgctaaagttgggaaggatacttttcccaccagaatgtaaatagtctactgtacttccatactggatgttctttatttttcacactataggagagccccagactgattaattaaagaatcctaaatttaagttaaagttggtgaatctcaattttcaaagcagcttcttgacctccttgatgctggatcatccaaaatttcctacagaagaaaggctgccaggcgtggtgatgtgtgcctgtaatcccggctactcaggaggctgaggcaggagaattgcttgaacccaggaggcagaggttgcagtgagccgatatcgtgccactgcactccagcctgggcaacagagcaagactccatcaaaaaaaaaaaaaaaggagagagaaagaaagaaaagaagacgaaaggctaattccaggtaattcagacaaagagatcatgtggggaaaaggcagatagctaagctggtgaagccaggtgtgcaggaggatcccagcaaatctggggaaacaaacatgactaaaaaggatacaccaagagaggagctggcttgacacagcatgcaatagggagtcattgccatttataaaagaaggaatggtgtaataaaagcagcactgtagaaggattcaggaggaattggaggaattccaggagtcagggccaccatgacactgcaagcatgaaagctggggttcagctggtgtcaggggacatgggggtgtaagagtccaaccagagatgttttcagcaaaataaatgtcaggacttgtgaacacattgtatataagaaatactgtaggaatggttggtacttttctttatatatctggtagaatttgacagtgaatccatcaggtcctgggctttttttggttggtaggctatttattagattcaattttagagctggcttttggtctgttcagggaatcattttattcctagatcagtcttgggagggtgtaattgtccagaaatttatccactgcttctaggttttgcagtttgtgtgtgtagaggtgttcacagtagtttctgatggttgcttttatatctgtgggggtcagcagtaatattcccttcatcatttccaattatgcttatttggatctcctttcttatcttctttattactctagctagtggcctatctattttattaatttttttcccacaaaaccgactcctgctgggtgtggtggctcacacctgtaatcccagcactttgggaggctgaggcagatggatcacaaagtcaggagatcaagaccatgctggctaacacggtgaaaccccgtttctacaaaaacatacaaaaaattagccagacatggtggcaggcacctgtagtcctggctactcaggaggctgaggcaggagaatggcgtgaacccaggaggcagagcttgcagtgagccgagatcacgccactgcactccagcccggatgacagagtgagactccatcaaaaacaaacaaacaaacaaacaaaaaagcaactcctaagccaggccaggtgccatggctcatgcctgtaatcccagcacttagggaggccaaggtgggcaaatcacttgaggtcaggagtttgagagcagcccagccaacatggtaaaaccctgtctctactaaaaatacaaaaattagccacttgtggtggcaggcacctgtaattccagctacatgggaggctgaggcaataggatcacttcaaccagggaggcggaggttgtagtgagcagagattgcaccactgcactccaacctgggtgacacagtaagactctgtctcaaaaacaaacaaaaagaaaaaataaataaataaactcatggtttctcatgtctccattttcttcagttcagctctgatttttgttatttctcatcttctgctagctttggggtggatttattctttctctaattcttgcagttgtgaaattaagtttttaatttgagatctttttgacatgggcatttagtgctatgaatttccctcttaaaactaccttagctgtgtcccagagattccagtatgttgtttgttctcattattttcaaagaacttcttaatttctgccttaatttcactatttacccaaaagtcattcaggagcatgttgtttaatttccatttaattggatggctttgagtgattttcaaagtcttgactttctatttttattgtgctattgtctgagagtgtgtttggtattatttcagttcctttacatttgttgaggattattttatgtccaattatgtggttgattttagagtatgtgccatttggcaatgagaagaatgtatattctattgttttaggtggaaagttctgtgaaggtctataatatccatttggtccaatgttgagtttaggtcttgaatatctttgttaattttctgccttgatgaactctctaatactgtcagtaaaatgttgaagtttttcactattattgcacagaagtctatgtctctgtgggtctctaagaacttgcttcatgaatctgggtgttcctgtgttgagtgtatatatacttaggttaggtctttttgttgaattgaaccctttaccattttgtaatgcccttctttgcctttttttattcttcgttggtttgaaatctgttttgtttgaaattgggattacaactcctgcttttttctgttttctatttgcttggtagattttcctccatctctttattttgagcctatgagtgtcattacacatgagatgagtttcttgaagacagcataccattggatcttgcttttctatccagcttgccactctgtcccttttaagtggggtatttagctattcaaggttagtgtctgacaaaggtctaatatcccacatctataaggaacttaaacaaatttataagagaaaaccccattgaaaagtgggcaaaggacatgaacagacacttctcaaaagaagacataaatgtggccaacaaggatatgaaaaaaagctcaatatcaccgatcattagagaattactaatcaaaaccacagtgagataccatctcataccggtcagaatggctattaataaaaagtcaaaaaacaacaggctggcaagcttgcagaggaaagggaacacctatacactgttggtgggagtgcaaattagttcaaccattgtgggaagcagtatggcaattcctcaaagagctaaaagcagaactaccattctaaccagcaatcccattactgggtatacacccagaggaatataaatcattctactataaagacacatgcatataataaatttcattgcagcactattcataataccaaagatgtggaatcaatctaaatgtccatcaatgacagattgaataaaggaaatgtagtaccatatataccatggaatattatgcagccataaaaaagaaccagatcatgttttttgcgggaacatgcaatagctggaggccattatccttaggcaaactgatgaaggaatggaaaaccaaataccacatgttctcacttataagtggaagctaaataagaatttatgaacacaaagaagggaacaacacacactagaggctacttgaggtgagagagtgggaggagggacagatgcagaaaatataactactgggtactgggcttaaaacctgggtgatgaaatagtatgtacaacaaaccccatgacacttgtttacctctgtaacaaacattcacatgtacccccaaacctaaaataaattaaatgttttaaaaaaagaaatgcttggaagctaaaaagacaagcacaactccaaataatttgaggatgaaagataagaagagtgttgggctactgacaaaaatgaggatgtcagagggctgtggtggtggagatggaaagtggtttaatttagatgtgagcaagtcaagatcacagcagactgcccaagtggaattctcattcttttgttactgccacagttgcagagcccaccagcgaagtctgggacagagatggtgggggcacctatttcccagcacaaaccttttcaacaactactaaaattcctggtcaaaatgaaccaaacctattcattctttcatttaaaaaaaattaacatgtctttccctgtaaaaaaaagaaatgaatttttctctttcttactcaaaaactgatcttcagaaaatcattgaaatcattcacgattctgaaacttttgctgaaaagctttgatgtattaaaaagaataattacttaaaaaacagatcctttgacactccagattggaatttgatgacttttttcccacagtgattcaattaattggtttttcttaatgtttaatggtagcaaagtcatcacattgaagaaaccttatgtcatttatcagcttcttctccagagccctgagaacacctgatgattatttcaatccaaccaatcactcactgaacacataatcatgaataatttagtagagcaatagatccattacttaatatagtgctaaccttttataatgcttatacctggggagaggactaatatctgtgtcacagaataactgatatcaggccttgggttttgaaggtaacattgtgacttatggaatatctaaacgcatgcaattataaaccacattatgggaaaatagttaacctttgtgtagcatttaagagtttacaaggtactttctcagacattatctcatttgatactcaaatcaaacctgtgagaaaggtattctttatttttttttaatttaactgacacataattgtacatatttatgagttatatagtgatgttgtgatacatagaatgtatagtgatgagatctgggtaattagcatattcatcaactcaaatacttatcatttctttgtattggaaacattcaatatcctgcttctatttgaaactgtatattattaacagtagtcatcctacagtgctagagaacacaaacttattcctcctagctagctgtaattttgtaagctttaacaaatctctccccatgtctcctttccccctacccttcccagcctttgctagcctctgctctacttttttcttcgattagatgaatcatttagcttccacatatgagtgacaacatgtggtgcttaatgttttgttcttggcttatttcacttaacgtaatgaggtattataagtgaggacagcagggctcagagaggccaagtggtttgcctaaaactgcctagctattaagtggcagagctgagattctcccccgacagtctgtgctgtctcttgtaccagtattcactctgatgtgataaaggcccaaatgccaacgggctttctaaagtaggctctctccattccacacagcaccaacagcctacccatgtgagggccctgttgcccttcatctttgttgaccacctccctctggtggccaagagttctcacatgagaaccttcaagaggagcatcataaactaccatttctagagcaaaaaaatgcttgtttctcaggaaccaaatcacacatgagcatttctgcaacatatacccatcatcctgtagcaaaggaagccacacatctggtagtaacaggtgccgtattctttttttaaatgattcctgccatgtgacagttcatgtaaacagcacacagaattctacccaatcaagaattactctttatttaaaattcttaaaggagacttgccttgctgtaagctaattttgtgaaagtttgttttgcctattcaatatttagcttgatttccgaaactatctggaacagtctttactaggtttgtctgtttctctctctgagactgcctataatagataaaagcaatgctttatttccataatctgctcttgagagttcctcattatgcttaaatgtctcccctttgttttaaagggtattatcctgcattcaatgcaagaaattaaaagtgtcattagataaaactgacatttcttttatagcaaaagtaaactcaatccaatttagaatagtatgtcaggttccatctttacttgttagataaatcactgttacaataatcttcattttcatcttattattattatttaaattttttacttacaaataacagcactccaaggatcatgtaaaacttgaatttaaacaaagttctgggaaaggtggctagtgattcagggagaacagcaaagggagatatggtttataattacacctatttaggtaactgtgccaaatccctttagaccagtgaaagcacacaacagagcagatcctttcccactaaataaacaataaataaataatttaccatgatatggtgagccttgagttttcccccattccttccatccctcgtattagtcaaggataatttcctgaaatatctagtattaatgaaactcttttatgaatcaaaattgtaatcatttagaatctgtgctcaaaagatgtgggtggtttgatagtcaaaatcacattatttaggggaacttgtagccagcattccaaattcaatttattaactccctcatcaatagccagagtatttgacaatttattcaaagctttcaaacatagcaagagacaataagaatgccgtgcctagtgctaaggggattccaggcacattatcagaatgggggcttgcagtgtaactaaccatttgtggatgcatgggacagcaacatttcctgagacatgggacttttggtgctaaactcaagacagtcctagacaaaccaggttagtcactctagggtcaggttgagggaaaaccttcaactagaactggggcacacatggagaaggatttcttcctagaaacaggagaaaagctgcctcgctgaagccagagcacaaggtcagagctggactcaagaccttgatgcaagagcaacaggagtattcagttaaagctttttaccaactaccgactgaagacaagattggtcccagagcaggagacaggctgaatcttggagtagagatgattacaccacacagtgaggaggaatatgggaataaaatatccatatttactgaggggataagaagaccttatcctcctggcctgtcttctctttgtgctctcctgttagctgaatccagtcagctgtttttctttcatttatgccaggatgcatcactttatacttaagcatgtgtggacagagaaaagctcccactaaaacactgacataaagagaggaggatcgcaccagaattatagggcttccctgcttttgtgaaggaaaagtctttaacgttattataaacataatatatggtactcagattggggtttctgttatattgaaccattttcattggaagacaaagtttctctcccctctttccacaggcagccagtacacattgttgtctccattgtaaccattattttatttttatttattatttaaagacagcgtctcactctgctgcccaggctggagtgccacggcacgatctcagctcactacaacctccaccctgtgagttcaagcaattttcgtgcctcagcctcccaagtagctgggattacaggcatgcaccaacatgcccagctaattttttgtatttttagtagagatggagttttgccatgttggccaggctggtctctgactcctggcctcaagtaatccacctaccttggcctcccaaagtgctgggattacaggcataagccactgtgcctggccaataacaaatattttaatttaaaaaaaaaagaaatcacccctttgtgggtaggaaattcttttgtaaagacagggattcacgagtatgacttgctgccagggtgaggactgtacacttaggacaaagcagatgagagaaccccaagaggaaagtagagaactgttgacattcacctcttcccaccagaaggtttctctctcagaactaaaagttagtgatattctatatgctgatttattttactaaaggagataaatattcctttacaaatgaagcagaaatatggtgtcatgattaagagcatttgtttattccactggttaaatgtatgatcctagttttgtaacctctctgagacaaactttcctcatttgataaatgggtactataacccacaactggcagggattttctgagaagtcataaaatagcaaacgtagaatgctatgtccaacattagtaggtgttcaacaaatgttaattattttccttcctttttccctgccaatatcctatctgaaaacaaacaaataggtcactatcaaatttgaaaaattattcgtcatcacgatttattaccaatctcagtaacaggatgatgggcacattcagttcattttcttttaaatttaccttagctttcaacatctaacttgtctttaaaaataccattcactaaaataagtggatatctggtagagacaacctgatatttgtacttgaaatattctaaaatgcacttggacaatcaattcatccactcacttatgtgtgtatctgtcgacaagtgtgcttgtttctacataaggatcattatatacaagccccattctgagcgcctctgtgtttgattgttttctaagaaaaatcatgatttccaggtggaacagtgagtactaccctttaaaacctctgaagttgatttttacttatatcacaaacacaggcatcaaatggaagatgagataaagttcaccaccagctttgaacagtaaaaatgacagaaattgggagttctttctgaaataatgcatagaagtcaatacagccaataactcttcctaaaccttgtccaagcaaagacgcttcaagtcaccataaaccatgatgtgtcccagaagctcattgaaaacaatgagctagcacagggattattttcctcaattttgacttttattactagtgaaaattaagagctatcaccatgtgtattctcacaagcacattatatgtataaataaattggtttaactctctcaataattctgaactgaagggactatgattatccccatgttaaagacgatgaaacttggaaaataacccagggttttagaactggtgacagcaaagttaagactggaacgtgtctcttgctgaattcaaagcccataatctctagccattaaactaggtaagagaagaaaggtaattttttctttttggaaatattataatcctgcctaagaaaaattctgaaacaggccatttcatcttcagtttctaacagcattaaataatgtaacagaataggtaccttcgttttaccttccaaatcgtctagctagtccaaatatctgggtctgcaaacggcattttctgagtcccaggttccagatcatccttactatttcacagaaaataacatcactgccaaagaagttatttctccaaagtaacttcttagacttgacgtatgtagtttaagcaaatgtcctttaatgttctcttcatcgtggctggggaaaaaaaatacctaaaaagctctgagttttattcacttcaaaaaacggaatcacaaaagatttgaaaaaatgtcctagtttttcaactcaactttaaaaggttttttcaaatggttaatttgatatcctagagtattcagcaggatcccttaatgaacttaaaactggactttttttctacagacttggtgttcagataatgatttaagaccacctcaccctgccttctttgtgcatggatgtcattagactcaaagtcaagcatgaaggtgaacagacattaatgtaagaccacttagagctacgttctctgcatcactcacaacaagcctcctttattagcccctgacgggggattcattagttggtcggactggatcaaaagctaggtggaaataacccttcctggcaactcagacgtttttcctatttctcttcttatttgtagaggtcagttcatagataataggaaacactgtaactcaaaagataatgtggtctctgaatgcaaatcaaattaatagattaaaaatatggtgacatggttgaggttcatagttgatcttttctatatatacatatttttttttgccagaaataaatccaactggcctcttctccactcaagattttcaaactgaatatcagacccccaactgaaattcagtatggtaaaaatagaaataggtatctttgctttcagtattttccctctctactcccacatgcccagctttgctatgtggaatgccactgataccactgaaattaccccctgaactccagtttctctccattccctttgattgctcagttcttactcaagctgtcttcagtgccgctcttcttcccaccgagacatggtgaggtttatgctgttttcaggcatagacaactagcttccaccattctgtgtaatatatcgtgtttccttgcctgtgcacacctggttcacccaaacatcaccctgtacacccaactaccctgtagtctcagctcagcaagcattctcccttcattttcctcatacttgcatttgagggtgtcagaagctctccctatctgcacaaactctccattcacattttactgagccagttctttcatacccacaaagagttcttatgtgcgcccctcttccaataggatctctgagactgctaacatatttcctaaaagtttcccattatctgtagaataaaatatgatcttcagcctggcctttaaggttctccaaggtctcactgtgtttgtggatttttttttcccaaccactccagattatattgatctctgaaactttttagcatttatatctgcatcatttgttctcaaacttatgctttcttccactgtttcatgagaattttatgtctgtttgttgcccatcctgccagcactaaatgctgaaccctcatattatactttttttttttttgcagcatctggctcaacacacaaatcggggcacttaaaaatattaattcagtaagatggaatgagtgaatgagtgaaaatagagtgctacctagaaacagagaaacacaaaggatgttcaatttggggagagaaagctgtaggtgtttttccaacccacatgatacatcttaaacattatttttagggagttcttgaagatgggcaagataaggtcagacactgttctagttcacttttttttattttgacaaggcaccaggagagacaaagctagcccacctctctttctttttttttttctttcttcaaaaaaggccatcctcgcttccttttcccttttccttcaaaaagtagtattctacaggaaaaactctcagaggaggggagagaaagtgaaggggaaatgagaaggagagtcagtcatcaccgccacagctgtaggaagaacgccttcctctgcccagaaggcaggaacaaacaccacccgattccagcccactgagcagacctttgagagggatcaaacttctaagtactggagggacctagaaaattgcttaaaagccaggaaggatcagccacacaaaaggcatgcagggcagaaggccagtgcctctggatcactctgaacccatgaacagaagagcggagtaatggtccatgactgcaaagggggcagatgagtaagtacagagagatgatctgcgccccatcagtgaaaccctgaagatgatccttcaggatgcttataatggttgcaggttttgagaagacagatacttttagaggggtcagggattactagctgagaagcttccacttactctttcaggaaaatgaaagtacaggctctgttctctgcatcacccacaagactcgtttattaccccccaatggtgtggggacctttattagtcaggggaatgattattattttgtctaactccacaggctgattggcttggctttcccaaagtctatgaaactaaaactgaccccgcaaattaatagaaacagcatgagtcatttgaagttcaagttttaggagccactcaggttctcacgaatcatgaggtgggagcaagccaccagatggagggctcgaagagagacccagccccagaggatcctctagattgcaaccagcttttttcagacatttttatatatataataagactgtgctcctccaactagacagaaagtcctgttgaatatgagtcattggctcttaaatagtttgaagtttttgtaaggagtttttgtccttgaaaatccttctacagacaagactgaaacattaatcaaaccttaggtaaccaaaggagtatcctttcatttaacttgtgttttcagcattatagaagttttagtagtgctgtaatgtttcacatacaaattgctgtaatgtgttttgcttaataagacttggaaatggaagtagttgctactgataagcccagatggcaatacaatagtatcctgaattaatctgatattccaaacaattttaaacttttaaataatagaaggtagcaataaaatagtattctgttgattataatctagaacatgggcaacattattggggtaggggtggctactggggacttcagtgtaaaactcagtctttttgtcattcatgaaaatttaattccacatagtcaatgttttacatttccaattttcattcacccatcacatctgagcaggaaattgtgcaatataggcaaaggacaaggacagcagagggtcacaatatgtgtactggaaaagaatgaggcagggggctgctcctcctctggggacagagcttctgagatgtccccacttgccctgttctaggtgatgagtctcagctttgtatatccagcaactcaattttgctagccaccttggaactggctcacaataacccacgctatcatttgaaatgagaagatgattttcagacatgcctctcgagataacccaaagcatccttccccattatacaagttgctttgcctgtaagaccaaaatatttcatccagtctcctggccctgtctcctaacagtgctggatattaatcaactgccttctatatgctcaccactcccccttttaaaagctagactgataatatctcttgctggcacctcctcttggataagttagtgccttcctcctgccacagctggatagttggattcactgacagagtcaagccctgcctagggctcaccctgatctcttgattgaaaactttggattttaagatgctcctcaggtgttcatgagtgtctcatttacaagcagtctcccaagcagagtattccaacagaagactggcttcatcctttgtgtattcttgaaactaatttcattctcagagttataggtgtgtttccttcctatagacagccacattttatgtaggagtcttactcattttgtataaaggcttattttattttcccagagatttctgtggtaagaaatgctgtccatagttaagttcctagtaaagatctcaggggtaaaggtgggagatgggatggtggcagccaggatcttataggttcaccaggtgaggctttaagctcaatctataggttacccagttaatcacaggtaacaaatagtgttttccacaaaatgtagcattactttaagtcctttataattacatatttcccacaattacttagctaatggaccactacagaaaatttggctatattcatagtttagtaaaatggaagtgattacaaaaaataaaattgatagaaatacactaaaatatttacttgataaatgcattcataaattagttttagttggaattttaaacttttagtcagggcgaagtatatgtggggcagggggtcggggggaggtacatctaacaacagagaaatcaggaataaataaggacacttgtcttattatccatgatataaatctaccttctttggttttgaatgggataatgtggagggagtagtagtggcctacgaagccagccaagaagctgttgaatctaatttatgacatagtccagacctgtttttgagccacctgccaaggggattcttcccattattgggggagggagaggaaggcatgtgaatagccagcactaaccacctggttgggctaatgttcactgggatcctgaaagaaagagggcaaaacagcctgctcacccatacctgtctcccaagctcccaccagtttcactgacaagggtagcattagttaggcgaatgactccctatcttattcacctttataccacccaagagcacccagcagaaggcctgacacagagacagtgctacaatgtttaatgaattgaattgtatgctggccaatattaggctttacaattgttaaaagatggtttgatatgcttagtcttgtcaaaaacattgtatgtaagaagaagaaacttgagaaaggtggtcagtagagagcctcttcgactaatagacagtttgagcatctgacagctgcattagaagcagaaattggtaaacaacttgacatagtatagcaaaacattcatgaaggcagccctgaatcccaaacagggatggataacctgaggacaaggaaagaaaaatgaggcaaatagacttttaatgctgtaatatacattaaacagaagccctctatttctgttccatgttcagatccatcttgagagcacagcaaacactcagagtatctgggggagaaggtcagttttcattcatcattatcagcaatgaatagttactaaaaggagtgaggctttgagcccaggaaagcagaaagaacagagagagtccccaaggctgggatgaggcaggaagctgctcaggaggattagcgcctgacgtggaagtggtttcccattcttctcttttattcctaagtttcctccattcttctcttttattccttaagtttcctccaatgacgacacccagatcttaatgccctttaaggagtccctgaagagcaagacctggtagggaccgcccaggaatctggtggctgactagagccccaagctgttacagggccatttgctctgctcttggccatcgtgtccattccaaaactggctttggcattcattgggctggtctggctcaaactctataaacaaatgcccttctaagtaaggactgcccaagtggagaacagaagtcacgtcagttatgccttatcattctcagggattcacagtattttagagctgtctgtggttaaacagtggacaatttaggccaatcaaagccattaatgaggaagaaactaaagtccagagagatggaatgacttccagggtcacacagagcccaagggtgagccagtccaatccttcgaccactacctgcaccccatatgtatgtgctgttctccctttatagccttcgttactgtgtgtcccatattatttccatattattttcctaagtccaggtcttcaatggagtgtgtgtgcagatgtgtctgtgtgagtatgtgtctgtatctgtgctgagcagggcaactgtgctggaataagagcttcaagaggtcttcagagagcccaggtattcactctagccctctctctggtgttcagccaagcaaatgtcaggagttttcataagtaatatttctctaactggcttgttctttcccatgtaacccagatctcaaccagaatctcttccttccttgaaatttaaactgtattcccctaaaccttaatttgttcttcatgtgcatccatgaacttcccccaaattgctgtgatttccagagcaggttccagccttgtgtgcttctaagctccttttctaacacaagttctagttatagcctagctactggggtgaaggtgacattctctgtcctatatcatatgtgaaaatcaaaccccttccaaagactcctaaccaaaacaaaataaaaaccacccacacagggccactgtgaatacgagagtatgagatatagagtcagtttgcattaaaacaaaccacttcgaactgaccagtagacatgcccattttttaattacgttctctgccaggtaacaacccccttggtaactcaagttttaccatcttcttaacttatttttactcttctttctcattatcttgctccccctttctcctcctttcaagattgcttgagattctgtatccttcttgttctactacttagaagtagcaactctcaactggaggggattttgttcacgggggaacatttaacaatatctcaagacatttttggttgtttcagtgaggaggtaccggaacttgacatgtagtaggtcgaggccagggatgctggtaaacatcctgcaatgcacaggacaggtcctacaacagcaaattatctggcctcaaatgtcacagagttgagaaggctgtaggttgggaaaccctgatctatagtgacttggctatagccatgtctattcaaataccaactacagtcctaggcatatccaaattctttccaccctccttagaacgtggcaatagtttaaaatagcattttcttacttcggttgcactaacaagatccagatggaatgtcacctcccctggcagcctttcctggtccctctttccactcctccatctgtgctttcatgacactttttacacaccaccgtcctaccatccgtctaccttgttagaccatagccgcttagcagcatagatcattcccttttagctcctctagcacagttcctggcatagaattggtgtttaataatccttgtagaatgaaactgaatcttcagagcagctcctccaatcttagtatcaagcctgacagaagagtggcgattatcatgatagctgagggcaatcataactcttgttagagaaggtacaaatgtcatggggatgactatatgatgatgcacggtacagccttggttgaaaagaccacacttagtgtgaagatccaaagatgactcaacatggctcttagagacacccattgtcgacagaggatatcaacctgagaagatggtccccatcccagttttcagtgatggcatcacagctttcaatttgcattgcaatcagggctattttaaaggaagaaatgtaacagcctatctaaatattgctaaagcacacataaatgccaatttttcttgactaaggatacgtggtataattattttagaattaggagtaattttccaaagctttgtaagcacttcattaagtaatagaatttcaaatagtaacttctagataaacaatcggttggtgagaaagaaaaattgacattcatctataaggaaaaggatgtatgaaagaaataggaaatttcaacttaacacttctaatcaataattttgatctcatcttccagatactgttacatcaagccatccaaccatgatatataagcataattgaagtattaggcaatgacatttatttatatatacatgtgggctttgtgtttcttttttctttctttctttttctgagacagagtcttgctctgtctctcaggctggagtgcagtggtatgatctccgcttactgcaacctctctgcctcccaggttcaagtgattctcctgcctcagcctcccgagtagatgggattacaggcacccatcaccacgcctggctaattttgtattttcagtagagttggggtttcaccatatgggtcaggatggtctcgaactcctgaccccagatgatccacccacctcagcctcccaaagtgctgggattacaggcgtgagccaccacgcccagccgtgtattttttaaagttaatgacaatcaaactttgatgccttctaaggatagatatttcatcatttcctttatttaaagataaaaacaaatagaaaatagcagtgaggaaaagctaacagctacagaaaccaactggattttgcatgacatcttccctgccaaagttcatgccagccgattaccctttctctaccctgcctcagcttcaaacaactcccctagagcaaatcctacctactgtagacccagtagctgtttccccttttttcttcctcagggactactggttggcagtggccatttgcctcgggatacattggccctgccagagcccaactggtgaatctcagtttagttagttatacccagtatttatcaaacaaaaaggcccccaatggagacttcgtaggtatttttttttccttaagtactcccaaacctccgtccccatcctgtaaaagtttaattccacagatacaatgtcctttggaggaacataaacgattgtaacacctaagattatttttgtccctgtggtacacagaaaaacagccccataaagacatccacattctaatctctggaacctgtgaatatggtaggttacactgcaaaggaaaattaaggttgcaaatggaactaaggtagctatccagctgaatttgagacaggaagatgatcccagatgattctggtgggcccattgtaaccacaagggtccttaaattgggaagggggaggcagaggagtcataaatgagaaaggtcatcataaaaaaaagactcgcttgatcattgctggctttgaagatagaaggggaccatagccaaggaatgctggcagcttctggaagctggaaaacagagcaaaatagattaagaaaggagcacagctctgctgaataattaacacaccttaattacagcccttaattattgggcttctaacatccagaaatgaaagataataaatctatcttgtttaaagccactagatttgtggtcatctgtaatagcagcataggaaactagcacatcccccatccccaagaaccaattttggtcaccacggtggcaattctgccaccactgagaatgtatagtctaactcagtcattgtaatctcactcctttcccaggtattaatttaaaagtaggcatgtgactgaattctggccaaggagatataagcgtcccctggaagtctctggaggctttttggctcttaaaaaaaaaaatggagagattcattttaagacaaacttccctttgtttttctatagatgtcaccatttacttgtgatccctggacctgctaccaggagacaatgagggctgactgataagaaagaccacatgctaagggtagaagcacagaacagtgggaaggagctggatcctcgctgcctttgtttgcagagggacacaaccagccaacacacttccagacttcttgctatataggaagaaaaatgcactcattatttaagctagttttgggatggctctttcctgcttgccatcaaaagcaacctttcttccctttaccaaaaataaacgcattctataaacaaaacattcatcattcagtatccccttgttagctcaaatttaatatggtcagcagcgatatttaagggagaagatttcggtgtcagagaatatagaaatgagattctaattagagatgtttagcagacacttaatccctagaatagcacgaaaggtcctttctgggctagcctttgcccagaacagcctgttctctcataccccatttcccccacctgcctccaccctgaactccatgtatcctgtgccccagtcacactgaacagcttgccattgcaaacacatgcttgccttctccatccctgtgcagtagagcaggatggtccctagagcccttttacctgactaacaccttctcattattcacaatgcaatgcagatattggcttcatggagccacacctggcatcacccctacccagagagagtgaaacattagtaaccttactttacctgtgttcccacagaaccttaggtacatctttgccctgtatttttcaaattgtcagaagtgctgtaattgggtgagttaatgcctgtctctctcccactaacctggaacccgaagttagaaactgtggccttcatgggtaaacccccacacctagtactgtgcctgggccagaaggggagggaggaggcagagggaaaaagggagagcaaatgaatatgaatgagagagtgtgagtctggagctcagatgagacatcagaactgaagatatcatttggggagtcatcagcatagagacgacaattgaaactgaaagcttgtatgagattgccaagaacagtttctttagaaatattcaccatcacgggtgggaggaggtaaaggtgcagagagagaagcatgggagaaggaattctgagtgctgataaaggagacaatttctgaaggtatcagcagtgctggaggatgcaaaggggtcaagaaggaaggaagccaggaaaaggccttggacttggcctcagaaagaacctctaagaaagtaatagtaatttcaccagagtgagtagagaggaagtctagtggcaggggattcaagggagagtgaacacagagtcagtgggtacacactgagcccacactgctcctgcagatgctcaccagaaaaggaagagaacaaactataccgctctttgccttctttcattccatattcacatgggctgataatcctgaaaacatttttatttaattaaaaaatacaatgcctttatatattttggtctgttcaggaataagctctttagggattttgccaaaggggatataaaatgtagtccattctgccagggctggtgtggcagcctggggattggttatgtggtatggattcaggggtgggcttccttgttccaatagaccaggaacaaggaaacctgagtccctggtgctagtctttccttgtaactcactctatgatctttattaagttattcatgtctctgggcctcagtttctcccttcttaacctgctttagttctcaatcccactcaatgataccaggaaataattcgaccagtcaatgaatatttacctattagttcaatgtgcaaagcattaagctaagaggctaatggaagtttccattcttctaatggaaaactctgatccctattatgacataaatctctcctgggaaagtaacaatcttagctgttattagtcattaacactactgcgtaaatgtttcctcgattataataataatggcaaacatttcttaaaagcttattgcatgctggatcctaagcttaaaactttacatgggttttctcttttaatcattacaaaagccataggaagtcaagaacattgttaaccttgtttacagatgtggcaggtggggcttggagaaatcatttgtctaacatagtcacgcagtgatgtcactaggcaagtgccagagcgggatcggaacccaggcagcatggcctcaaagcctgttgctttagtcagggttctccacagaaacacaaccaagaggaattccctcttgctcagggaaggtcaaacttctgttcagtccttcacctgatgggataagaatcacagaaacatccaaaataatatttgtccacataccttgtgcaacttggcccagataagttgacacataaaatcaaccatcacacttgtgcacttaacagaacaaggtactcaataatattttttaaaatattagttcacctcaaagcatttctttttgttttcctcactttcgttgataatataattattcacctaggtgccaaagccaaaactttgagcaccatccctgcctcttccttctccctcactctgtataccccattgcttgcaattgtttgattctacttcttaaaggtcttcctactagtcacctcatctccatccttgcaaccacagctttatttaggaccttgttattcattgcttggactattgcaacaccctactaactcaacctgctgcctacagatggactgaatctctccattcatctttcagcctaccatcagaaggaactccctcaaacacaaatctggtcacgctgctgccctttatataattcttcaaatgccctacctccttagtttggtttaaaaacaaggtccccccatcatccctttcctaagcccccatactccttgcatcctacctaacaacaacaacaacaacaaaatctgcttccttgaaattgccattacccttccttggttctaaacttttgcaaatgctgcccccctctttcacaaaaggaatgctgctcccttttcccccaaaatcggctcaaacaccattattgtctgaaagtgtttcctgatatctctgggcaaaataaagtaccttcatccctgtccttccagagcttcagtacagaatttaccaaccactgtaagtaacaccccctctagactataaatccctaggagacagtgctatgttctgttcatttggggaacctgaacacctgacaacatactacccggaaatatgagaacaagtacttcatacatgtattggagaccttagcagagatacaaacttctagagaatacatttgtggcttatctgctcccttagtgagggaaaaaagtacttagtatctcataatgtaatacggggcttaaaaatcattgaaggtgcctaaaaatagcaagtaggtctacttttccttgggaagagttttgataagatatttttgatcttttaggagttaaaaagatgtttctcaacctctaaacagagttggtgggcaaggcagaatggattggtagaatattaaaaatagagcgaggctaggctgttccttcaagatatttgcaaacactagaatttttaaacacaaaacagaataggagttggaatattttaagaaaataagtaaaaatgtagtcctcttgctatctccaacagctatgcatttgagtacctgaaatgtgggagtagacgaaggggcattagatacactataaaccatgtttgttattataaataacacataaaaccacagagcaccttcattatagattaatgttacagttctctgtggacacaagaccattgacaacatgggggacatgaggttgtaataagccttagattctataagtcaataaaattaagccatggcacaattgtgtcacatctacagaaaggcagagtagatcatcactgagggagacagtgattctaagcctcactcaccttggccaagcctgaagatcttgagaagtgtttctgtcccatcactaacttacccactcatactggtggtgtcagtgcaggagtcactgctactgaaggctggtggaaggaaagaccacaggttgttttttgtttttaaatactttaagttctagggtacatgtgcacaatgtgcaggttcattacttaggtatacatgtgccatgttggtttgctgcactcatcaactggtcatttacattaggtgtttctcctaatgcaaaccctcgcccaaccctccacctactgacagaccctggtatgtgatgttccctgccctgtgtccaagtattctcattgttcaattcccacctatgagtgagaacatgcagtgtttggttttctgtccttgtgatagtttgcttagagtgatggttccagcttcatccacgtccctgcaaaggacatgaactcatccttttttatggctgcatagtattccatggtgtatatgtgccacattttcttaatccagtctgtcactgatggacatttgggttggttccaagtcttcgctattgggaatagtgccgcaataaacatacgtgtgcatgtgtcttcatagtagcatgatttataatcctttgggtatatacccagtaatgggatcgctgggtcaaatagtatttctagttgtagatccttgaggaatcaccacactgtcttccacaatggttgaactaatttacattcccaccaacagtgtaaaggcattcctatttctccacatcctctccagcatttgtttcctgaccttttaatgatcgccattctaactggcgtgagatggtatctcattgtggttttgatttgcatttctctgatgaccagtgatgatgagcattttttcatatgtctgttggctgcataaatgtgttcttttgagaagtgtcagttcgtatcctttacccacgttttgatggggttgttttttcttgtaaacttgtttaagttctttgtagattctggatattagccctttgtcagatgggtagattgcaaaaattttctcctattcgcaggttgcctgttcattctgatgatagtttcttttgctgtgcagaagctctttagtttaattagatcccatttgtctattttcacttttgttgccattgcttttggtgttttagtcatgaagtctttgcccatgcctatgtcctgaatggtattgcctaggttttcttctagggtttttatggtgttaggtcttacatttaagtctttaatctatcttgagtatgcatatcaagaatattggaaacatacctattgtcaatagagcgggccctctggatcataaaatcgaagtgaggaagaaaacaaaggcattcatgccagaggaagcaaagtttttggtttgtttttgattgttttgttttgttttttgagatggagtctcgctctgtcacccaggctggagtgcagtggcatgatctcggctcactgcaacctccaccttctgggttcaagcgattcttctgcctcagcgtcccaagtagctgggactgcaggcacacgccaccacacccatctaattttttgtatttttagtagaggccaggtttcaccatattagccaggatggtctcgatctcctgacctcgtgatctgcctgcctcggcctccaaaagtgctgagattacaggcgtgagccactgcgcctggcccagtatttttttaaacaattcagaaagctatgtatccaaattccgaagcaatcttgagcagtcatcaatgaaagtctttaactcagtgaagcacacattgtcttaaatgcctttatctctttccctggtctctgtctacatgcacctccccttccttcagtacctagcccaagcttcccctccataaagccctcccataatgtccctggttggaaccagtcacctcaacctctgcacctgcatagtttatgtgtgtatatctagcaattattttctcatcttggctctaaactttgaagggcaactgttgtgtccgtctccagtgcctatcacagcattgtgcccatagccagggtgcagtgcatcttatggaatgtgaccaagggacatctcctgttttagcataaataaaagaaaccagagttctgctcttgttccaccttcattaatcaagtcctccctccagcttgttgtttaccagcaagggagagaaaagctgaactcacaagttcatgctgctgagataaagacctgaagcatatgttggcccacagggagggctcgatgccaaaagctggggagaaaactaaagtttctccaaggaaaaaataaataagggtggaaaggagagcacctccagttaaggacaggtactatgacacctgacaccaggaatgcctttgctgctaggtgcttccttaactgtgacaggacattaacacaggacctgcagctggggcaggagaaaaagagaaaaaggagcagcagagaagaaaccagcctcagtcccaggcccttctccactgcagggttccagcttagagcaacaccaagctgtgggaggggagaaactttcagtttggctgaatttcagttttattacacaggactggacattttaataactgaaatgagacttttcatatatttagaagtgaatagagaacgaagagtatgagaccaatataccttccagatgggggtgggagaatcctagacttcacaggtgtaaaatcagtaggaagaggcaaaattaagaagtttccaaaaacaaaactcaaaccttgaggacattacgctaagtgaaatcagcccattacagaaagacaagtactgcaagactccatttatatgaggtatctaaaatagctaagttcatagaatcaaaatctggaatgatggttgccaggaactatgggaagagaaaaatggggagttatttaatcaatgggcaaacagtttcagtcaagcaagatgaataagctctagatatctgctgtacaacgctgcacccacagtaaacactaatgcagcatgctcttaaaaattagttaagaatagagcttatgtttaagactttttaccataataaaatgaaataaaaaaatgaagaatctaaaaatttaaaattttaaaataaagaagtggtactgtggagtctcacctatcacatataccagttacattgacattttaaaagtcagtgctcaataatagggctcccccagagtgccttgcctgcttcacgattcacagtacaaacaaggcttccatgcttcctgacaatcacacatggaattccattttttaaatgaggaaatgaaaaataatttagaaaccataaaaagaaataaaatattttctttaaaaatagaggactcagccatgtttatgacagtcaaacaaaatgtctatttctctcctttttgccagggctcctctgattgccatccaattagctagtggtcagagtgacccattagtgagaagtcctgttagggaagccctttagctggtatgcaatatgtgctattttcactgactggactcaattggtggtggtggtggtgagtgaagtctgcattctgccacagataactaatgtgtaggtagatgtggttcctctcaataaccatgaaggccctgggttaattcctttggttgccaacacactagggttggtgaaggcagcacagaatggagagcctttacaaagctggggagaatgctctaacagaagctttttcttgtccttgaaactgctttgttgtcatttagatgaaagccaaaactatttctgatgaatattatgatgcatggttacatttagatcctatttttcaggggaattttggctactgtaactgaatttaacatatgttgatagagctctttcatgccctgggcactgatgaataagaccaggttgctaattcccctgagaaagttacagtctacgtagaacgcagtggtgtcaatggactgacaccatacagcatgtgcaatggacatctgtgtggttcacctgccaggcagctcttcttcttgttgtaggagagcatcacactttagctttaagaaatgacacctctctgtggctttgaccatatgtttcaagtggagctcaccccagctttctctccccagctccagaaatgggcatatgtcccatgcatggctaaagtgaatagcaccttccccaggccacagtgattgcttgagtgatgaactgtcacttcttgtacagtgggggccaagccttggacttctgcggacacaattggaagcgaagcacatcctttccactaaaggtgctgtattgggttgaactatatcaccccagaagatatgtccacctggagcctcagaatgtgactttatctggaataaggtgtttgcaaacataactgcagtagggaattcgagatgagatcatcttagaatagagtgagccctaaatccaatgacaagtgtccttataagagacagaaaaggagaaaataacaaatacacagagagaaaggtgatgtgacaatgaagccagagactggagttatgcagctacaaggcagggatgccaagaattgttggcagccaccaaaaccgaggagagaagcatggagcagatcctccctcagagcttctgtaaggagccagccctgcctacaccttgattttggacttctggctccacaattgtgggagaacaaatttctgttgttttgagccacccagtgtgtggtgatttgttaaggcagctctgggaaatgaatacagttactaagctggcagtatgcaagcctacagctgctggtggccatcttcccaccacatgggcaaaacctaagcatatagccagcacaccagaaagcagagcccagagctggagcaagacacattcctgtagacttcattttaaaatgtggagctaaccctgcctgagaagtcagatttactcctatactgttttaagtttttgtaccctaaattgcctcataggcttacatttaagtcctgtctgagacagtaaaacaaatgctttctttactaaaggtacacacacagtgttgcaatcacagaatagagctcatctaacactacttaagggaacccaggaagccttcactaaggaagtatcattgatgctgagtcttgagtggaattttgccaggaaataattcatctgatgtcccatctctgcatcattctctgtgggattctttctggggagccacatagtcattctgcacatgcccatcccaatctaagggctccaggacacaaactgcggttggccaagatgtcttaaatgagttttgtttcaatggcatagatccccacagcatcaagtgattcccatcctccatgcctgggaccttgtgaccacttgtgccaataccaacttgcttctggccctcattcccactccagtccaagccaatcccagctcttgcctggagacacacaatagatttctaactaatcttctgcttccatcttgaccctgcaatccagtttctgcacacgtacctcaactgtaccatatctctccaaatcaaatcccttcaaaggcttttaccagatctgtaaattcccagcacctaacaagttcttggaacttcatttgggtaccaattatgtgttaaatgaatggtgaataagcaagttcatcagggcctggagtcatgactcaatagcagaagctttagaccttaggacatcttgcagtcatgactcacatctcatgttacatacctggaacattccaaaccaattgaaagaggaataatatattcatcagatttatctacttctgattttgcatccactctatttgtctgacatagcagatctctggttcttaatctaagaatggtagatctactatctggttctggttttcagattcaagtttagcaacctgggtgtcaatcctgctatcatgtacttaagctactgcttctgtttcccaactgaaacctgtccctaattctgattcccggctctccttccttcccatgtgccctccggttgcggcactggcatgccccagaacccagatcccatgtctctcaactgttgctaaacagaatgagatgctgagccctgaccctagggcagggtcccatcctctgctacagaacaatttttatgtggactgttagccacgccatctgactttctccaagctacctacttcctgatgtcctgtctccagcatgcactcacctgccatgtccatctattccttcattcaacaagcactctcagattatcttctagacagtgcagctacagtgctaatgaaagatgtctgtggtatgctttccacctctgaagaaaaagaagggaataatttaaaaagtggtaagatgtctgcatgggacctcagaaactgaccaagtgttcacagtggttcacctcttaccctcttactttgccttgacagaactttagtcaggattctctccttcctacaggtccctgaattctacttggccccaagcctgagaaagcactaaacactggaatgtggcccccttattagcttgcactgagaatcagctgaccacagcaggacaattcctgtcataccccactgatcatcctccccatcccactggccatcccccagttccactgatcatccccctgtcccactgatcattcccctcaaccatcccactgatcatcctcccatcccactggtcatccccccaccaccatccccgtctcactgatgactggtcatccccccaccaccatcccactggtcatcccccccaccaccatccccgtctcactgatgactagtcatccccccaccaccatcccactggtcatcccccccaccaccatcccactggtcatccccatcccactcatcatccaccccatcccactcgtcatccccccatcccactcgtcatgctcccctgtcccactcatcatcccccgtcccacttatgacccaccccaccatcccactgatcatcctcccatcccactgatcctctgatgacccccctgccatcccactgatcatcccctcctcccactggtcatccctcccgtcccactgatcatccctccgccgtcccactgatgactccccacccccgcggtcccactggtcatcccgccgtctggctggcgaccccccggccgtcccgccaatgacccccccgccggcccactcatcattccccgccggcccactgatgactccccctccaacccactgatcatccccgccatcccactggtcatccccccatcccactgaccatcccccatcccactgatcattccccgtcccactgatgaccccccccaccatcccactagtcatccccccgtcccactggtcatcacctcgccccactggtcatcaccccatcccactggtcattcccccgttccactggtcatccctccattgcttaatcccttttacaattttaattaagcttttgcttatctctccctaccctatataatggaagcctctttctttttgattttgtgacacttgacaatttctgaggttggagcattctctctgtggcaatggtctttcttttgaataaaatccctccttatctaagtctggatttgttttcatttgacagaatacatagaagagaaatctaacttgggtgggaagaggaggggatgaagattagagaaggcttcctggaaataaactgtgaacagaaagaaaataaaacattggctgggcacggtggcccacgcctataatcccagcacttcaggaggccaaggcaggtggatctcttgaggccaggagtttgagatgagcctgggtaacgtggtgaaatcttgtctctactaaaaaatagtaataatacaaaaagctagctgggtgtggtggtgcatgactgtaatcttagctacttgggaggctaaggcatgagaatcacttgaacccaggaagcggatattgcagtgagccaaggttgtgccactgcactacagcctgggtgacagagtgagactctgtctcagggggaaaagaaaaaagaaggaaaagaaaatgttaaccaaactaacacagaggacatgcacggattccaggctgtgaggtggcatgcgtgactctcttgccatgtggcagtatgttcaggtcctcaccaacaccaccatctctgatctgtgctccataagcctgaatggaattcttcatgccacctgcacctggcaatgctcccaaacaactgcacctggcaagctggcctagctccttcctcggtccaggcctagccttctgtgtgtgcccacaaaaacacatgcacacatgttctttcttattcaaatgtgtgacccctaccctcagcatgccacagacacctcaagtgaactctagcatctccagaacacccaaggggtcaagtagttattatgatagatgtaggccatctctaccttttcatggactctctgttcatggcatctcactctgtaggcttaggcaaaattcctgtagcctagagagatctgagactacaaggacatgaaaaatgcaaagagggtaagcttgactggaaactgcacaaggactggaagcaggtctgactcattcagcatcatatccctaccacctagaacaaggccccaacacacagtaggggctcaaatatttgttaaataaaatgtcatatcagctcacgtgaataattccatctatcgcagagtttcctctgacactatcatcaagcaacattttaaaggggaaaacagtggttgtcctccatgatatgaaacacacaaggctagcaatgcattctgaacaaccctatttcccttaatagcccgttatgcacatgccagccatgattcatgatgtaaatgtaactctagagtcgtatgaccataagtaccaatgccttggaagtgtatctgagctgctacaagagagattatttttttcctcactgctacaactgccagaaaatatgtttaaatcattacttgaaattcctttcccaaccaaatctcttcccagagctgttaacaagaaacaaaatatgctgacttgagtttcactttctttccattcctctgccttcctcttgtgggacccccaatgaatcatgaaatggttttggtcaggtaagagtgaaaaaagcacagaacaaagcccagtctgtcaaacatgcagatcctagaggacagagactctgcagcccagttctaccaacggacgtaacccctgaaataatttgcacctatttcaatcaactattcatctgctagccttctgattttattatattatgaagccatttattttcaaggaaactatatttgttgcttagttgatacatgatgaagtaaactgagaaaatacactcctaattctcaggccaactcttttaaggcctataaaaaatgacataaatagattctgatgttgcttcatttctgcagaagggtgtttttatattatgttcttctatcaacacagtaagtacagattgcatcttaaagctctcatctagtgctggagtttccaaacacaatggctttaacaaggaaatgactttggaaaggaaaataaaagaatgtgatttctttggggctgagcatgggagagaagcacacttcctgtcatgacttgggaggcatgcagagaccagctggcaaggctctgatcacagaagctaatccctcaggagaaaatgggtaatcccagggccaaaattcacccaaagaaccagaacaaatatgggcttgggtcagacagaacttcattaatcagggctcaatccggcagccatgactggggagatgccatgtaaagaggaaagcagagattgaagtgatgcttctacttgccaaggaatgccaaatatcaccagcaaaccacaagaagcaaggacagaggctggaagagattcctcctcacagcctcaagaggatccaagcctgctgacaccttgatctcaggtttctggctcccaaactgtggaggccaattctgttattcaagccacccagtttatgggactttgttacagcagccctagcaaactaatacagttggcaataggagttaggtagcaggaaaataataaataactgaaaacagggaccacacagttcatgtgaagctcctggcccttttcaagcatttgtacgggaatctctgggaaagagattcaaactatcacttgaggctaaattcctttatacttgggaattcacatttattcatttgtatgacactaaaagaacatgagaaatataaagacaacaagctagagggggtcagggccccatacaatagccaggattctgctcaatggcttcatgcatagtcaaaccttaccagctgtgtgagaataaaggcagaagaggagacccttcaacccagtcaggtaaagttgacaaggaataggtagtatgtcatggtccaaaaccaggaggccagaatacagggatgggtccatctccaaggatctgaagtgtaagtcaaatgtctggtgggacatcactgtgagtttgcagtgacagagaggggctcagggttcaccccaggacaaccatacacagggtccatcatgacaaaaccattccaaaccctggcaacttgtgggttgatgctgggtggaagctgttggccctggctaagacccaggaactgaacaaaattaaaattgctgccaagggcatgggtgatgctgggtaggggtgatcatggaaagcagggactaatagtgtcaggtaaagccacacactgattgcatgtaagagaatacatgacagtaatcatcaatagaggaagaaataagaaccgtcaaacactagatattttacacatattaaacatttctcatatattacattacaaagttggcataatattctacattcaactttttgcattctttatttccttaggaaactgtgtttctactcaagttgtctgaattaatttaactcatatgccactgtgtacttcctttgagtttggggtccatagctgtcctgctccactgtctcatgccaggtcttttcattacatgaactgcaggatgctctctctcaggcacagtgttttgggggcaatgcctctaaatgatgcctccattgaggcaaagatcacatgaatttgtaattgtttgcatctccacctcctctgaaacacagtgacctgctggaaagcaaagaccatgatttgtctctgtatcctcaaagcccagcacaagtatcacctgacacatgcactataaatgctcactgaattgattcattcttaagaagattcaaaatgaaaaaggaagcaagcagatttggtgagccatttctgactggtatttcatgaattcatgtatttaactatgggccagcactatgtcaggtaatacattagtcatgtgaagaaacaataagattgatcactgctaaggtatagagcaagtttcaggaatgcaagaatgggctgcccttaattgagcacttagcctctctgctgccttttgctcattgagcaaattggatatatattcaggccagtaagaacactcataggctacctgctggtgtagatgggctccttacaagatacaaattgaggctgggtgtggtggttcatgcctgcaatgccagcactttgggaggccaaggcagatgaatcacttgaggtcaggagttcaagaccagtctggccaacatggtgaaaccctatctctactaaaaatacaaaaaccagccaggcatgggagcatgcacctgtaattccagctactcgggagactgaggtaggagaatcgcttgaacccaggaggcagagggtgcaatgagccaagatcatgccactgcacttcagcctgagtgacagagtgagactgggtctaaaaaaaaaaaaaaatacaaattgaccattgttgaacactagccatgagccacacattgttatgtatgatctcacccaattcttatacaattgttatccccactctacacatgaataaattggggcacaacatgattaagtaagttacccagatccctttgctacaatatgacaaatctggaacataaacccagccagtgagaagttcttaaccactccccagtgctgcctaagagattagggttggatgaacctacagattataggttttggtatttgctagcaataaaaacttgaactctaagtgacttaacattacagtaacccccgaaggttcccatgcgttatcaaagataatgcataaggcatggttggaagcagctctgccctttggttcccagaggctgagcaaaccttacccccagactcacattactaacacaactaggaatctggtgacaatggtcattcaacagaaattcatgaagagcctgttacatgccaggtactatactggatattgggggatctttccactaagaaaaaacacatgctgatagaaaagattgacagagaaatcagcactacaatcagagtggcaagtggtaccacagagttaagcgcagggaccctggaagcacattgctaaggatgaggcaagataccccaaacttgtcctcaaatctcaacccttttaaagtggcaactgaatggtcacattcaagtagaagcaactgttaggtgacatggcaaataatattcaataaccaaggatgacaaaaacaggacagggtagaatacttagcccagaagtgggtggatggcattgagaactggaaaagagaggggaggtggtcaggagtcattcgaaagcttcctctctggtcttccatgtagaatcttagccacatatagttaagattgaaggtaattaacaaatcaagcaaaaaccctctgctatttcaaatatcctgcacaccaggcaacatacctaccatctttatgataatatacagctttgttatgccttttgggggaaaatctgtattatccccattcctttcactagtaatacctgatattaagtagcacttttgagtttataaagaacattcacaagaattatatcattgaattattactgagcagacagggcatccattttacagacaaggaaattaattctcagagaagcttgttaacaaaatctcataattgaaaaagagggatttaaagaagtgcttttgactccaaggttggttctactgcatcaaactgccattgtttactaaaaacttaactacagcattagaatcataggttttaaagcacttatttgaatgctgtttgctgtttcatattaacagcagctgttgctacttggcagttactaagccctaaatattaggaatggctggggtgaagaacagctttgaaatgacactatatttgatcagcttctgcaataactgttaaaatcatatgcatgtcctttggatccctataaagcttctacagtatcactgtacctgcagttccaatttgcaatttcctcagccctcctttgaagttattcttgccaattacctggtgttaatattaattaaatatgatttgtaactcaaaatgtggtgttatcaatggaactcagctgtacaaatataaagtaaaattttcaattgaattaaattgtttcctttcattcatagtattttacaacattaatacttttctcaaattgacttttgcctgctggaagtcattttcccaaagcaatgaacatctgaggggaaacactgctgtttatgtattctttcctttctgtcattgaaaatacttcgttttaatcttaaagtgaatccatttcagttaccagaaacttgcttcttgtttataacccaagaggggaaaatgctttattttaaaactgtactaagatacattaaaaatatgatcagtgaacacgtttcaattgtacactagggatgaaactttccttaccttattgcttgaccctcacaaaaaaaaaactatcaaactttttggcaactgtcattttatatacacaaaaaatgaattaattaaattggtttcttacattaacatttcaaacagaatctgccatcccaacaactctctggtcccttccaactctaagatgttaatattcggaacatgtcaaacaatagtcagaagcttccagcatttgcaaatttagggggagaaagacacacatagaatatttgacagaatcaggtctattctgccccctgtaatgtatgcaatgatgacttgaaggcctgtcatcttcaataagccattcataaacatgatgactgattaaagaaggtgtgctgccatactgtgcaaatctacaatgaaaagatatgttctctcatattccttttatcttcaaagataaagctttagcttccttgccccttataatgatagcagtagcattaacatttattatcctgtcttcttttaaaaataatataataatgtaagacaaagaagggaaggaacctgtctaaagactaaaggaagtcatttattgagtcatgagccaccaggcccagagcttatgatggaaaagcatgagtgaatattattaactcctttattataatgtcaatgaaacattatatcaaggaattaaaacaagacagaaatagaggactgtggatctaatagctgagtgttgtgtaacacgtaggtcttaaccagcagcaactaagctattcccttccctcaggccaaaagaccaaaaggggaaataaaaataaattaggccagaaaaaaatctctggatgtctgtcatattccaggtgtcatcaaagagaagcttcttggaattacaaagtggggcaggtgaacagcaggtacacacctatgttggcagtgtctattgtgatcctactgggagctctacctaggaaagccagacagacactgggatcccatcacttaccccagtctggaaccctgaattatccattaggttacctcatttacccaagaatcaggattgggagagtagaattccataacattccaaaaggaatttgtgaactcgctatattacaggcttctccattaaccaaattctgtctgcttaagcccttctcattcttattactaacctgttgtcctcctagcccaaatcccatccctaccactggaagctaaccttctgagtatacccttcttcaccctctgttaagaactgaattatctcccaagaaaaatacattgaaatcctaaacccagtacctcagaatgtgaccttatttggaaagagggtcattgcaaatgtagttagttaagatgaggtcatactggggtagagtgggcctttattccaatatatcttcatttttataagaagagaagacacagagataaacacaagaagatggtcatgtgatggtagaggcagagactggagtgatgcatctacaagccaaggaataccagggattgtcagcaaacaccagaagctaatagaggcaaggagggattctctcctacaaatttcagaagcaaccaccttaattttttatttctagtctccagaactgtgagatgataaatttctattattttaagccactagtatactatattttactataaaatgcctcctttcaaggacctctcttcatgtaggaaccctagccctaaccccaaccctactgtgcacgttcagctatgcattctggcaaaagttcctgttttcttatgaaacactgctcatcatccttaaatttttttctgaggatctccttttatcatctcccataattgaagtcttcttcaaaggagactgagagccctcccatgaccataaacccatgaaaagagaacactctaccatactgttacctcccattgcaatgtctaggccattattcccacactgtattcatctgttctcacaatgctaacaaagatatacccaagactgagtaatttgtaaaggaaacaggtttaactgattcacagttccacatggctgggggtggcctcaaatcatagtggaaggcaaatgagggacaaagtcacgtcttacatggtggcaggcaagaatgcttgtgcaggggaactcccatttattaaaccatcagacctcatgagtcttattcattaccatgagaacagtatgagggaaaccactcccatgattcaatgatctccaccttgccctacacttgacacacggggattattataatttaaggtgaggtttgagtggggacacagaaaaaccatatcacatacctttatatgaaagcttctccccatgagtccatcctcattcccctatacttctcaccttagcaaccacctttccatactcaaccatcaattgtatgagaatgagctttgatctatatctcagttcctgcttggctctagatcaatgttccttgctattcttctccacaaagctatgtactggtacctaaagtttactgtgttcattttactgtctcttttctgtttatggtacctgccttttcctagttgcccaggtatgcaatttcaagttcaactttaatttctttcataccctcaagctctgtgtcccgttactaaattccatagacttcacctcacaaatgacccccaagtctatctcctcttccatttatattatcactgccctatatcaggccaagattgttattgcaatggacgctgaactggtctccttgtcttctacttcttatagtacaaccttaaatatacattctgatagatccccctctcctcagcagtttcctcctgatataatatgagtatttgtccctgccaaaatctcatgtgcaattgtaatccccaatgctgaaggtggggcctggtgagaggtattgggtcatgggggcaaagccctcatggcttggtgctatcttcaggatggtgagttcccacaagatctggttgcttaaatatgtgttgcatctcccccattcccaactctctcttgctcttgctttcactatgtggtgtgcttgctcctgctttaccttctgtgatgattgtaagcctcaaaaggcctccccaggagcagatgttgctatgcttcctgtacagcctgcagaaccataagccaattaaacctcttttctcataaattacccagtcttgggtatttctttatagaaatgcaagaacagcctaacacagaagattggtgctgaggggtggggcattgctataaagatacctgaaaatgtggaagtgactttggaactgggtaacaggcagaggctagaagagtttggagggctcagaagaagacaggaagatgagggaaactttgtaccttcttagagaccagttaaatgcttttcaccaaaatgttaatagtgatatggacagtgaaatcctggctgctgaggtctcagatggaaatgagggacttactggaatctggagcaaaggttacctgtgttatgccttagcaaataacttggatgcactatgtccatgccttaggactctgtggaagtttgaacttgaaagtaatgacctagggtatacagcagaagaaatttctatgcagcaaagcattcaaaatgtggcctggctgcttttaataacctatatcagatgtgggagcaaaggaatgacttaaagctgcaacttatatttaaaagggaagcagggtataaaagtttggaaaatttatatcctagccatggggcagagaaagaaaaagctttttcaggagaagaatttaagcaggctgtggagcaaccacttgctagagatatttgcataactaaaaagagccaagtcctaatatctaagacaatgggggaaagtcctccatggcatttcaaagacctccatagctgtccctcctatcacagccataggagggaagagtcctttcatgggccaggtccagggccccactgccctgtgcagcctcaggacactgttacccacatcccagccactctagctctagccttggctcagagggccccagatattgctcatgccactgctctggagagtatgagctactataagccttgacagcctccatatggcattaagcctgcaagtgcacagagtgaaagagtgatgaggcttggcaccctctccctacatttcagaggatgtatggaaaagcctgggcacccaggaagaagcctgctgatggggcagagccatcacagaaaacctctacaagggcagtgtcagggggaaatgtggggttggagcccccacacagagtccccagtgggggcactgccaaatggagctgttagaaagaggccaccatcctccagactccagaatagtagatccaccagcagcttgaacccaggttgaagtgcattggtggaatctcggctcactgcaacctccacctcccaggttcaagcaattctcctgcctcagcctcccaagtagctgggacagcaggcacatgccaccatgcccagctaatttttgcatttttagtagaaactgggtttcaccatgttggccaggctggtctcaaactccacctcagccccccaaagtgctgggattacaggcatgagccatcacaccaagtctggacttttgagttaatgctacaatgagttaacatttggggagactattgcaatggaaaaggacatgagatttgagaggagccaaggtggaatgatatagtttggatatttatccccacccaaatctcatgtcgaaatgtcatccccagtgatggaggcagggcctggtggaaggtgtttgggtcatgggggcagatctctcattgcttggtgctgtcttcaagatagtgagttctcacaaaatctgttcatttaaaagtgtgttgcacctcctccccttgctcctgcttcaccttctgccatgattgtaggcctcctgaggcctccccagtagtggatgccactttgcttcctgtacagcccatagaaccatgagccaataaataaacctcttttctcataaattactcactttcagggatttctttatagcaaagcaggaatggtctaacacacctccattgtctagaaaactaaggataaaataaacaccctatgatttgaaataatcatgtgtctatgtcaaaccttccaattttgtctcccataattcactaaacaaactatgctccagtcagaaaaactgtgctatttgctgataccaaatatgtttttttccttctccagcaataatcctatagtcaagagatgccttgggatgacactataacagctgggatatcaaggggctatttgtctttaccaagtgtctcctggccctctcccactcagaaagatctcaactagggaagagccatcactgaggtctgatcaatgaccaccatacactcataaacttcattctcccagattcgcaaaggacactttcccaagtctgatttttttaaaatgaaaaacattctaatcaaactgtacaagcaatttatcactaacccaattttcatttcaccatcattccattatgatctgcttgagttaatcagaggtaagacagaggaagcctcaatttacactgaaacttcttagcaatcgatgttgctaaagagaaattcagaacaaagtacagaaaacattatgagttggggaaatatacaattttattaatgggcagacactccaaaaaaattgaatgtatacatctctttctcactcaagctactgaggtttttttttaaaaacacactactaacatggtgacagatgtcatcaatgttgtagtaagagctgcaaatgttacagaactaatgaattttcattagagacatcagataatttcagaatgggttaagttgctaccatttgccattcccattaacatcattgtcatgtaaaaggtttaattttcagctatttttgttctagataaaatctttgtcattaaaatgagggatgattttgatatttaatatattccatggcatactccagtgtggtactaatttggccttttcagtattctgcatattaattaacaatccatccctcctccattccccagataagtgagaactgaaatagaatggacaaccaatcaagtcacagaatactgaaaagatcaacacagaagaaatgtgttgctctaatcaagagcatatacaaggcaccaaaattattttctcccatgctaatgactatgatagaaacaggagtaatgaatggcaccatctaaatccttttatgtgacagtattaccaaagcacagcaatgctccctaaaaaataaaaactaagtatttcttattttagtcaaaagaataaaactgtggtttcacttaacttttagaacaatccattttgttggattctgcaacaaatggcagattatgtcctgttttgaattttttatagtaatctatctcatgcacacaaaatgtgtcctcaagttgcagaatgtccaggatcactgtggaaaacttatttcaatacatactctattagttttctcctcttgctaaattatcactctggtaagaactgacatcagctgcttaaataatacattaaccctgtttccagaagctattgttttcatttgagtgggcatttcctctaaggataaactttagatttttacccaagaagataatataatttgtcataatttaaagaccaattgaatgttttgaatcagttttatagcagtaatgatataaattcccagagagcaaagattatggcataatgcacacttacagcaggtgtgaacagttgtccaattaaatcaattagcccaatctgtccaacaagaccaggcctttcatacattttctgcaatagcacaaatgtagaacaaatgttaaagatactaaatattgtgtattataatttttctatgtcctactatgtacagaaaagcttgcagtcatctgcaagtctctcaagtgaacatcctacttcaataacatcagactttttgtccttggtaattatggttaagcccaaatcattcccatgatctttctctgagtcgaggcctctaagaaaaacaataaatttatcaacataatgtcttccttcaggctcaaaattactgaaaaaaatcaatggacactttaatttttccacaaaatattactcttatagaaaaattcattcattcttaataagaataatagtacttaagtaacaacaacatacttaattcacaaagatatgttgttgacaaatcagcagttaagatttgtgctctaagttgttcctttgttttgctctgtgttttcaaagtagtggaatggatttacaacctcatcgtacacatacaagatggtaaaatgcctagacacttggataagcaccttgaaaaaaatgcccaggacagacatcagcagcaccttgttgtaaacaagtttttacatcttgtccttcatcacaccctaagcttcagagttttaagaataaaaacgcaaaaagtcaaatatgacaataagaatattgcttaagtatagccttgagggctacttcagcattgttttaagatgattactagacttagtccctctagtgttggatgttaaattccactgactttttttaaatttaatgacttgctaatgtaaacttccatctagaacaatcaaatagtatgtcatttattcaaatttacagtggctctaatgtgccagcaaactcccttgtcaaaacagacaactttaaaaaatgttcatttgagtcaggagtcctacttcctaaattagcaccaaagtgtcaccttgatagacctatgaacaacaaaatcatttataataaacccagcttccctctagagtggacagcctagttcatgcatctgtaggagttccaattattccctacagataagagagcacttggagatgctcaggcatcagcaatctgtcacctccaaatacaatcatctgataaatatatgcttaccaatctccctcgagatctgggtgaaggcctccacaccgctctcaccatagttcccctcagaagccagtgtcgaaacataattccatcccagtgctgtcacgatgtccaccatggcttgggcttggtaggagtcaggcggaaccactcgagagaaaaagtcatacctggtgttatcacttagctctggggctgtggatgcatagctgatttgaggtatctgcaaaacaaatgatgggtcatttcaacccatgacgaatcttgaagaatgatggattgtcatatgagctaaacagccaaggctataccagaaacctagacatatcaacctgaagccaaaatacagttttatgactaccaatttaattggaaagtatttttgaatggcccataggcttactttctctcaatgcacaatatttctaaacagtgagaaagaatttcattttgctttagtttccattgtttctggagccaaagcaaaacatttgtgctttttgttgatgttgctttttgttgatgttgcttttttagtctgtacatgataagctctggtgcagaaaggagagaaaaatgaaggcatatacatcagaaaaggtcacctctgaaactggctttggctttataggacataaatgctatacaatgactaacagggaatttaatataagatttttttatacttgataccatttcagtcttaagactatatttttagtaaattattgtaaatatatagttttgcaagtctattgactgtttattgatataatcagagtgccacaaaaagatttgagaattgccagcagccacatatcctctcatagaaacatcattctaacccccttcaaaacatcacagaaaagggaatccagaccataaattctttagaagagactatttttcttttaatggggtgaattgccagaaattctttgaaatgaggaatcctatgtcatttctcaataatgtgggagagtgagctatgtgattgtgtatagtaactcctctgctgccatgctgtggtatgagtgaaagttcagagatcaaagtgactccaagatgccctaattcaggtaacttgaagatgcaggtttgacttgtacatgaaaaaattaactttatgctacatcacatgttgcagctaatgtcagtgctcaaagaggatgtcggagttgcagttccatctttccccacagggctgcacactctgggatccaatagtccccactacagtgtagacagatgattcccaatctatataaacatttcaactccacccttgacatacttgtaaagctctcaacatctaaataaccttcctaagtctagagagtcctgttccctactagtggccagtgaaatgacagtgaagttcctaaaacgtaaaagtcatcccgggagcagcagcagagcaatgtgcttggagctgtccatggtgctgactattcattcagcttccatgtaacttggatccacctgcattggccgtaacagagagtacccagaatagcgtggcccatttaaccccaaattctttctggttctgttctcctagtggggactgtgttaacttatttgttaacactgtgggaccatgaaaaccatctgacccacctcctcctgccctttgccttctctgccagatatactgaccttaccttgacaaatttttcccctggttagattttgtgactgcatagtacatgactactcgcaaggacacccctccaaatctcaaaccacacaccaaatcttgccctttctcaccttttcttgtttgttttcagaggacctgggaaggaaaccatggataacttagtgagatctacctcttactaggtaaaaatttcccaaatatcaaaagtatgtgcattcctatatcctaacgaaaataagtcagccatctgactttcactttagaagaaattatatgtatgtgcgagtaggggttgtgtggggggaagggaataggggagcattctatagcaaaatatatagccctacaccatttctttgtcctatttggataccgatactcccacttcctgagctactaagagtccagcagtaaaatgacttacacaactcccaccctgcctataataatgagccaccctttctaaaaatgagcagaaagtgtgaaaattgagtgtttgaaaccaaaactaattatctcaaattactaccttcagtcagtcacttccaggctgtttaattagcagtcagcctcatgtttaggattaattaaacaggtgtaaagggtatataaaataaaagtgcagatagaagatggttgtttgattaattcagtaatggactttctccccaaagtcttgaagagttttctctttgcagatcaatgtgtgggaaagcaatgcaagagtatgcatttgtatttttattttttcactctacaataatacacatcagggtatatgaatagtatttcaagacaagttttcaagttttcatgaagtcacatctcatttttattttattgtggtagacccctaagcattggttcattaagcattttaatttctgtcccagcatccccagtatttctaccacccgcaaattaaaccctactggcaactgaagtaaaaattttttaaagacctggaatgttccttttattttccctacatcaaattcactgcaactacccacttaaccttggaggtttcatctaccagaaacacagcaatggaaaaaaaggtggtgaatggtgaagagaagcggaggaaaaaaatgaaaggaaaaagaagaaaagcatcccaagaaaagaagttgctaggaaaagcacccattatcagttcccccatcctttaaaaaaaaaagtagtgtcttttataagcctctgttaactcccatggccaatgtaaaggataaaatacaaactcttcggtctggttcacaaagatcatcagattctgtctcatcttcctcccctgacctgtaccttctctccatattctcacagcatctgcacccttctccataccagggagatttaatgctctcctctatctaatgatcctctatacaaattcaatatccagctcaaaagtcacctccatctggggacagttcactaactccatcaggcagagctgtcttttgctattcctgtcttccaaagcctccgccatctaacattagaatcatgactctgctggcttatgatcctctcaagaccaagcagggtctctgtttctttatttggcatccccaacaccaggcagaccaagtgctcaatgaatgtttgagggcaattaattaattaaactgctgcaggaaatttaatacagcttcttccccaccacctcctcccttgcattccaccaaaatattgtgcaggctattctccattcgaccctcctgatccttccctatcctgccaaagaccctaggaggctgctctctatgaccatactgcctgggcttccttgcctctggcttctagttgagtttgtcccggaggcactagcagaacatgggagggcgaggggcgacagaaagaagttagagtatttatcccacagtttctttttccactggctctgtttctccacctaacccctcacccacagctaaagcttttgccagattccagtgaccactctgtaccattgcccctgtaaggtctccccactgctgttggctccgaagcacttcatcatcccttgttttttctaactgtgcccacacttacaaataatctttttgtgaactgccctttcattacccctgggtgtgccagaagcctgatgaacactcccctatgacaagtctctgtagaagacaacactgctgtggctccccaatctcagccctgccctaacttcttagcccttctctagccacctgcccttccagccttctctaccactgtccctaggtgactttctcatttcctttcttcttcatttccctaaggcatcctactgcatatttgaaaacacctgtcattttgctttccttcatttcttattttctttgtgctgagacttcataaaaatatcatatgtgcttaaataaggccatatttctattactcaaatgaagcgtatttgagtcaattaattatacaactcaggacactcatcatcctctttttttaaaaaaaaattgttttggattccacttttctaacaattattttggttaggaaaaacgctttttcttctctcactatattctcacttcagcccacagaagaggagattcctacctcccaactccattctctttgggagctccagaacaaacatttcctctctcactctccgttcctttactgactttccccaacatggagggggaaagaaatcaaagccagagttctacgtttattgggcaaaaggggatagcaggctctctctttattctctgacctgtccacatacatctcaggcttcttttctctataatgtcatgagaccatgctgggcctcaattcttggaaaggaagcccaccctcttctctccatattccactggcaaccagacatttgagaaatacttgaagtccatgctactcactgcaagtgaactttaagtcttccgtgcaggcagaagtgggtcccaaggttgagatatggtgcaagagtaggaggcacaggttcaagctgaattatctcgaacgcagttcttagcagatagtcatgtgcctggggagttatttggtgcttgcccagatgttaataaagctaattacttaatctacatttaactagctattctgtgaatattggacttgcaaactctgagaaattccaaaaatttaacttagagctcaagattaaaattatatttcaaaagaaattcatttacatatattattaataggagttagcagagattattgtcttctagtgtctgttctccttctagatgaaacctccagtttttacctaaccacccagaacgtgactacatttcctggccttccttgaaatggtaagtgaagcttctgaaaaggatccttaaagggagaaggcatgcctttttcatgatcctccctctttcttgctggctagaatttggacataatgcctggaactccattagccatcttaggctatgacctagcaatggtggagcaaaaagccacaccctagtccaagccactgtgatatctggattcctaaagccacttgacttttcttcatgcttccattcatgctcttctcaaatctatgccacaccagcaagaaaactggtattttacaaaaacagatcttaaaggctgggtgcggtgtctcacgcctgtaatcccagcagtttgggaggctgaggtgggcagatcacctgaggtcaggagttcgagaccagcctggtcaacacggtgaagccccatcactactaaaaataccaaaacttagccaggcatagtggtgggcacctgtaatcccagctactcaggaggctgagacaagagaatcacttgaacccgagaggcagaggttgcagggagccgaaatcacaccattgcaatcctgggcaccaagagcaaaactctgtctcaaaaaaaaaaaacacaaaatagatcttagaaaaatcttgtttagagtccttcaatcatttccccattgcccttagaatatagcccagacctcctgtcacaggatcctttgaactggcaactgaccacctatccctctcactcacctgatccaactacactggcttcctttttgtttcacctgcagcactcatacatatcaccacaaacattttcccaagtaagtccttcctggcctttctcatccttcagcctcagctcaacagaccttccctgaccaccccatctagtgttgtctcctcaccttccattatgacctcatcactctacttatttccttcctctttcaccacctgcattaatttgtgtattctgtttcccctactaacatgtagattccacagggttattttctgcattgttcacagatgtaacatgagctcccatgagatagtaggtgttcaataaatattcattgaaagtaaaatgagcccatccatccattaatcaagaaccccttttgttattttcttccatgtatcctaactttgaaatatttttctataaaactatttaagttaaaacaccacccatttccaatattctcttttaatcaaagatctgttcagctgcaaaacttctgatcagcacaaggcatctgtttttaccaagctgaagtgatggaattccagttcaaatcaccgaagtgccgcttcagttgtagcctgtgcagtcttctcgtagggaagcttacaactgccactttgctttttgaaatgccaaaaatggccatgaaaacttcataactaccttggcaaacaccttgacagcccacggacttcaatgtgtcattaaagaataaaaattacatttctaatcaaaggtcaacatcatagattatttaatcatttaccccttctttcttatctttatctgtaagatagatattccagacagggaaaaaagtgcttacatctcccccaaaccaactgtgtctctccatgttgccttcactgagccttcctgtacatgactgagtgatgaaataaagggtctctgaggctccaaggggatcagagacttttagataccagaaatactttttgtggcccaaggaagaacaacttcagctgcctcaaggtttcccactgcttgcacatcaaaacattgcaataagcttgaaacttgccttgtctattcagaatgccataagtttttcatctgttcaccacagttactggtttgctaaatatcccaaggaagccaagacacccctgacaaggctagcaaaaagccacctaaagcacagcttagaggaagctcctccaaattctaggaaatttcaatctttctgcaagaaacttgcatacatctgagtacagatttgcagacagaagacaatttaagacctgaatcacgtatattttcaccatgaaaaagggtttttttttgtttttttcccccctgccaaaaaaggtttttgttctctgcaaacaaccttgtccattgatcatggaacttaattggtgaagtaggttggcggggtgggttctttgtgctactcaataacatcattggttttttccagtgaaagatcagcttgaagccacattcttcccttagggggtagtgcttgaccaagcacttttccagtgatggtggttagcaacagcggccatcaggatgatagcttcctaccacctggccttggggtagatttgtttttgctgcaaaactcaggtcaaaaaaaagcataattattatagccattaactttgtctttttatatacttgactgctctctagtattaaaactactagttgcttgtggcaaaacatcagtatataatcagaaattagatataaatgaggagttagggctagaagtcaatgtccagcactggcccaactctcccgacactgccctgagctttcatgctcctcccaccttcatgaaaacaggctaaggagagggaaaagaagaaaggaaatgtaaagccagagtgtgaaacaaaaaagaagatggatgactaccccaagtttgcatccaaaaacatgaagtagtagtattccttccccaaatcaggactggctcagaataatcctgtcctcatagtcgacagttattaagattcctgtttgtacaagttggtgtcaaataggaaattcagtctctgaccttttcttctcagttgagttcccatagttgattcagagcaggatgtgagcctttgggttttgatgcacaatggagtttaacaaaagcaaaggagaggaagcctattgaaatggggaaatcatggggtcaaggagagccaggagtacactatattgcaccatatttttatctatctccccaacatgagctcagtaagaccaagcaaagctttacatacacacctgcacaaaaggggcctgtggttagttaacacagctgagtgtaacacagttagtaggtttaaggtcatgagttgaattccattatgggccaggatgaagaccacacccctcaccagaatcttcctctcacaaacacagagcacataacaaagtcaaccagagagaggagagacaagatcaatccattctcactgctagatgaataattcaaagatggtttgctactaatggtgaacctaaaattttagcagcaaatcatgagacacactttcttcaaaacatagtgtttttgtatctatatctgcctgaaagtataaatatatattacacttacaaagtcatatgttgatttcagataattcatttgaatagaccattgaattgtaaaagggtacattttctcacctccttttcatgggtattgtatgagtcatagagggaaagaaaacaaatgactcaaggagactaaataaagggactattttcaaggcaggagcagcatatagagaaggcagtggaaagccacaacctagaaggagtcagaggtcgaggttggcagttgttacccatgagccctaagagagagagcagttacagagtcatgaacggaagccaccttgaggggtgcagtaatctctctaaaaggacacagccagcccctggcaacctcaaaaggaaattgcattctgacctctccctcatacacacctcctgctgggtctccctctgaccaaatctattggaagccagagagcaagagaacttgactttgcctgcacaaaggaaccttccacggcagccagcagacagcaaaagaaagtggttgtggcaggccaagcagaagctatctagcccaggcaccattaatcattgctcactggacatgtgaactaaatgtatggagagctgtgcagattttcagttttctacattatattactctttcataatttgatgctttcaaatatttttgacagaaaatctacactaagacattttgatttggctactgaaaatcccaatcctaagattagactaatgaagtctggatttcttatggaaaataaaataactaatatcatgttttagaaagaaatgtaatgattttaatcaaattggtaatggcattttgacttctaacctgtttacttaaaataaaagagaagcaatctatgaacatgaaataatttacatataagcaaccataattttaccccataagattaataaaccttttttttttacatctgctaattacattttacaataagaaagcacaacagctccttaggaaaagaattgttctaatccatcaagtcactagtagtgtggggatttttaagcctaactaccctaaaagttttactagcaagttggatttaaaaccttcactttcaaagaaagggactttaggctgggcccagtggctttcatctgtaatcacagccttttgagaggctgaggctgtaggatcccttaaggccaggagtttgagaccatcctgggcaacacagtgagacctccatctctataaaacattaaaaaatttgccaggcatggtggtgcacctgtagccccagctacttggcaggccgaggctgcaagatcacttgagcccaggaattctaggtgacaatgagctataattgcaccactgtattccagcctgggtgacagagaaagacactgccactcaaaaaattaaaaagaggactttaatattccaactaattttatagtttctctagtttatagcatctccttatcttcaattttgcctttttaaaaaattgaacagttttatttaaatttccatatatttcagtactctgtgattctaaaaaattataatcagtgcatatgcaaaattacacagaaatttagaaggctaaaccaatacatacacttcttctaatagttaaatgttctttaatggttacttttttattaattcattcaacaaattagctcccactacatgccagacacggtgacaggccctggagacaggactgtaaacaacacatggtcctcccagccccatggaacatatgaccaaatggaaaaagcaggcattcaataaataatcaaccaaataaacatttaacggcaattgtaatggttgttgtgaaagctatgaacctgccgctaagagttacagggccactcacctggtccgcaagggacagggcaagcttccctgatgaagtgacattaagttgacacattgaaaaatgaagaagaaaaaggaatgaacactgaacaccagccacagattgcctctcacttgagatctccttcagatgtgtatactacccaatttgcagaaatgaagaggacaggcagtctactgacaggtacttaattttagaaaacttgccacaggctgaaaaatattaaaccatagaccaccgtctcccatgcatattacaaataatgttttcaaatactatatgcaaaactggggttcttatgccaggactatcaagaaaatgctacgtaatttatcagcagggacttgcattacattctcacagatctctgagtcctgaggcttgtaagggtaaggcatgaataaatgaatggatagatgaaaggtaaacagatgaatgaaaactgaagacactaagaagcaactttaagtcaagagtccagaaaaaaaataaatgtatacttatattacttataagctctaatatttgtttccttccttaggaaagtaaaaaataagtgattgaaaagtaggaggaaactctcttctttgtactcaggcagtgaaggctttgggataggacttcaagctatatgagaagcaggttagaactaattctaaaagaacctggctttgctttgctttgctttggtttgtttctttacaaggtaatatatattttctgcacctctcaagaggaggaaagagaaatacatgcatctgtccacccctggaaactctgctcaatgaggcagcatcccagggagacatggagaactgcattccctgatttcattctttctgtttctgccagtttctttgatatcttcttggaaaagttttcaagcagtttgggatttcaagatgaaatctctgattattcttcaaaagaaaaattaggggaagttttgaaatgagctgcttaagacagtgaaagttttctataaagtgattttcttacatgagtacaaaaaataataaattacattgtgttataatagaaaaaccaaaacgatgccatggcactttattagcatcatttgctaagttacttaaaaatttaactctcccacccactcattcccatcactgctgacttcaaactatcacctagcatttaattttcctcttctgctgatttccttactgtgcaatcactgctgtggttcaatttttcccccaagcatgtcagcactagaacattataaaataaaaagtcagtaattataactaacaaattgaagtcaataaactttaagctggcaaatattcgatttagactggcattctgccagccaatagtacatgatttgactcctgcaaataaagaagaatgttgataaggacgtttatgcaagtaagtttcctggctggcaatttcatggatttttagtgattatccgcattcacaaaatcttagtcttcaagtcattatttatctcccagctagcattcaggtactgattctgaacacctaatagcactggaaattctcatttactttctgttacctaagttagtaaacttagtagattagaagaaggtacgcatgaggttaaacgtcttcattcgagctccatttacacagggggaaaacccactccatttgcaaagaccaaaaagctgatttcataaatggacatcattggtaacaggaaaagttgataaaaggatgtaaatgactcagagtcctttattccactacatactacagaatgcaaggatatgttcctctgagaaggcatcatctcagtatccaaagggcaatacattaagtttcccctaaacaaattgattagccctttcatcctatgaacatttttgggaagcctagcttactgctctctataagccttctttatgtgtcgtattccataatgtgtgcgtatgtgtgtgtgcgtacacatgtgtacatgttcattttgccaacatttatttaacatgttatattggccaagaactgtgcttagtgctctagcttcatttcatgaatgactaaaccataatctggagaagtaacttgcccaagaccaagtaatttgtaaatgacagaataagattcaaatccaggtagtctgaccccggattcatttcttaaactcctctactctccgctactttgggtccatttttaaatctgatattaattcttcagtagctttttttcccacaggtgttcagcttcctccccgtttccacctctgttcacatctacaactcctttatggttgtaagtcatggcttggctggagcttggacatcaccagccattgccatatatggtatcacagtgaataggagatactagcatctaagatcagctaaatattatctgcctccattggttttcatcaatcccaattgctactgttccttctggggaggggggcctcctggcccagttgggtaccaacaaaatggtctgagacaagtttggggcaggttggacagcaatcacataggtcaacaggggaaggtaagtgcaaaaagggctagccaagttcccaagttcagagagagcacatctaaatacaacaggcgatggggagcagaggcaagaaccaagaaatggggccaggcgtggtggctcacacctgtaatcccagcactttgggaggccgagttgggattgcttgaggtcaggagttcaagaccaacctggccaacatggtgaaaccccatctctactaaaaatacaaaaattagccaggcatggtggtgtgtgactgtagtcctagctactcaagaggctgaggtatgagaatcacttgaacccgggagacagagtttgcagtgagccaagattgtgccattgcactccagcctgggtgacagagcgagatcctgtctctctctctctctctctcacacacacacacacatgcacacacacacacatacacaagaaagaaagaaaaaagaaaagaaaaggtagaagatgactgaaaggtgttccaggcataggggacagcatctgacagaaacaaacctatgaaaggctatagattgcttaggaaaagctaacaattcagtagtcttggtgaaaggtgttcatgagcccagttcagtctgctttctgtttgtttgttctcgtttttcatttcaacaagtatttgttaagcacttacgatatgtcaacactctcttacttggcctaaatgagaactcactctccaattttcctcttaaatctctatctcctttgttggctattcttcccttgtttcatcctttaagtgttagcattccttaggatgtggcctagactcttttgtgttcacttcatacccactccaaacctataaatgcagtctaaatctctccagtgagttccagacccatgtcttacttatttgacctctctcttaagtgtccaacaggtatctcaaaatgacatgcccaaaacttgtcacgcacaccaatcccagcataaactgaagatcatctggtgcaccaggggtcctcaagtcatagctggccaattggctgggttccagaattatgtgagtgccacacactttccaattatgaagtttccaactatgcagctatcatctatgcatggctttggtctgccttgtttagccctcccttttttatacctctcagtggccagttggccaccagaaatgaagactctttaaaaattaaatttaaggtccaaatttcctctagaggaaaacaaatgcttatatgttttggtataaaagatatgttcatgttgcaaaagataaattcaacagtattgactacagtaactgtggtactaagttttctctacaatcttgctactcagtgctatcagcaaacccacagcatcagcatcacctgggagcttcttagaaatgtagaatttcaggccccaccccagacctactgaatgagactttgaattttaacaagatctccaggtgattcgtgttcacaataaaattggaaaagctctgctatagtatgaaacattgaatgtgtactcaagagccctgtttccttttgaaatttttccatatcatgctcaaagggatttaaacacattcattgcaaagattatttttgtagctctggatgttgtcatcatgaggagatataaaagctccctctaattcactttatgaagaagttgatgccttgaacattatgttcacttatcctaggatgaacatctcctgatcattagaaatttcttttcaaaaatattctgcatccaaatttctgtttttaagagtattatgtttcagttcttgcatcaaatgctagcatggagtttatttttagtgtcatgataaatctatagaccagtgaatatatcatatcaagagttgagtcagtaaaagctttttaaatatatttcttacttatttgaaaataacagatgagtttttgaaaaataaaaatttggcaaagcctgcatgatgaaatgccaaataaaagatgcaatgtaccttgtcatcgatacattttccatagcatttatatgcagcaggataatttagtaagatattcatttctgtctgattgttactgctttaggagacggatgaaaagatttattttcctttgcgccctctacatgagcaatcaagcctgcatgtcttggcgaattagctcattttcaggagacttggcctatagaggttatagagctgaattactagagcaggggcatctcccaaggtttgaggaggaggaatttgaaatggaaatagagggagagaatagtacttcaccagagacttgggaatgagtcttctctggtagtgcctgagaacccaggaaccctcaaagaagctcatttcccatgcttgccatagaaggaatggaatccccctccttttaacagcccacaggggctacagtgagcatctccgtggttatctcctctgtacctatattagtccactctcacactgctctaaagaactatctaagactgagtaatttatgaaaaaaagtcgtttaattgattcacagttctgcaggctgtacaggaaggatggctgggaggcctcaggaaacttataatcatagcagaaggcaaagggaaagcaagcacagcaggggtgagggagagagagtgcacgcaaagggggaagtgccacacacttttaaaccaccacatcttgtgagaattctatcacgagacagcactaggcggatggtcctaaaccattagaaaccacccccatgatccactcacctcctaccagtccccaccttcaacacctggggactacaattccacatgggatttgggtggggacacagagccaaaccatattagtagccttggcaactgaaggctaggtctccaaactgaatatgattgaattgttgacaccctagtgaatgtggctcagtgtcagaattatttgatatcaaagaaaaaaagttcatttcacttcagttttgaagagcaaattcatttcatacacctactttaccttagagagtaggcttatgagctgaggcactgggatacactgctattcttcagcagatcctaggaaagcactttgtacatagcagataacacatggacattgttgattaactgcttactagcgacagtaaaacaactcaggattcctggcttttaatatcaacagtctacctagtaaaactgcttctcaaaagcttcccacattttcggtgcttaaatgaaaatatacttttctttttttatgagtagctgaatccttttgcatagaccgtaacttagatatatgaagacatttattgtctttccaattctaaatttctaaataatctaaatatgtaaatgtctccataatgctttgctagagactgtatgtaaatatcattaggctttctatttaaaaaaaaaaatggaaaaagaaaaaacaggaaaacctcttaggcacgtctgtcttttaaaaaaataccatttcaacctcaaatttgatgagacatacacattgctttttggatgccctttaatttttttttaattctaagaaaaaaaatggaggagatttaaagtagtttgacatttaagaatataatctaacttaaattaggattgaggtactgcaaatgtagacattttcttttgtaaacaaataaatagaaagtaggacaacaagtagaattcaaggtagctcaaaaaatgcaggatgaaaaacacttgaaaagaaaatggaaatactgagataaaaaaaattcaacacgtcaccaaaagactttttgggagagggactgagaagagtagggggtagattaaatatactggttgagaaaccagcattagagaagactagggactaagggtaaggggatgagtggagaaggcagtgtggcttgagtcaacgttgaacttcaggaacaggagaagaagatgggaaagaggaaaagaaagacttttaatcccctgtagcaggagatggaataagcaaagaagtcactgttttccctccagccttccatccctgctaagtggctactattgaattaatcatctgtaaatcatcattctggactggcatagccttggtttagggtgtctcatttcatccatataatagtcgccagggctactgagtcccttcaaaactagtaatcagccagatgtcacaatcaaacatgtctgtgcctatacaactgctacggtttgaatgtttgtcccctccaaacctcacgttgaaatttcatccccagtgttggaggtggggcataatgggcggtgtttgggtcctggggggaatccttcctgaatacgctaatgcccttacaaggttgggggagtgagttctcactctgttagttccctcaatagctagttatttaaaagagcctggcaccttccctctgtctcacatttcctctctgtgtgtgacctctgcacactctagctccctttctgccttcagccatgagtggaggcagcctcaggccctcatcagatgcagatgcccaatcttaaactttccagccatcagaactgagccaaataaaccttttttcttcataaattattcttagcctcaggtattcctttatagccatacaaaatgaactaagacaactttattattctgcccatggtttctaataaaacattaccaaattttcttcaaaaattcctcagatctgtttcaatatgggtcaaatatttttcaaatattttgtagaatgtatctttttcttccccataagaaatagaagccatcagttaaagatacctcttaatttcacatcatcacatgacaaaccttcccttccttcttcctttccctttccctttcctttcgttacaagaaaaaatgtcacctttgctatctaaagtgaagcctcaactctgctctgaattgcacatgcagcagcctttttgagcttgacactgtagattattgcctctctctttcaagtcattaaccacatactttcaactgggtcctttctactggcatttgtgtatactcaagcctctccaattcaaaaagaaaacattttcaaaaaagaaaataaaccattactcaactcctcatccaactccagctctcaagctaatatttgtctaccttttacaaccaaactttaaaatttcaactaagtaccctctccattgtcttacctcccactcacttttcagcattgagaccggcttttgtcccagggctgtattcaaactgctctaagcaagatcataaaacttttcatgtcacaaaatccaatgctcaatttgctgtcctcatttcacttgaatcagcaactttaaaatctggacaatattttccttggcttctacaacacgctctcttggttttctcctacccctctagatattccttctttgtcatctcctctagttcatctttatttgcttacaatttaaaagtgaggttccctgaggcctgacctgagccccaatatttttgcaccctttcattctcacaagatgacaatgtccaacaagtttatgactttgatcactgtcagtataactacaatgcccaaatttatctctgaaatagtcaactcagacttctctaaaatgcaaacctactaccaattggataatgaacctccatttagaaattttaaatttaccttaaattcaacatgatcagaactgattgcacagacttgcgcttctggccaaaacgaaataactggaaccagatgtagcccctaccctttaacaaaatattgggaaatcaaccttaggagtatataaaaaattaaataaacaatgacaaggaatgtaatcaattcaccatattaacggtataaatacaaaaccataattggtgtagaaaaagcatttgaaaaaatttaacatccattcacaaaatagataaataaacaaataagtaaagtctcagcttattaagactatacagaaataccctcaacgtgataatggacatctgttgaaaaaatacatctaaaatcatacctagtggtgaaaggctcaatgcttttcccctaagagtctgcaagacacaagactgtccatttcactggaaattagcaagctgattctaaaatttgtatggaaatgcaaagaatttacaatagctacaataattttaaagaataagagcaaatttgaagaattcattaaatgttttctaaacaaactataaaactacagtaatcaacaaagcaaagattggcataaagctagatatagagattaatggaaaaaagtgaagagtttagaaatggctataaagatgccaagaaaattcaaaggggaaaggataacttctcaacaaatggtgctagaactgaataaccatatgaagaaaaaagacacttgattctcataccatgcataaaaattagtcaaagtggacaactgacccaaacacaaataataaaactatacagcagtacacgcaaggatacaaaaatactagaagaaaatctagggaaatctcttcaggacaaaactcttctagacaatgaattcatgactaagacctcagaagcacaagaaaccaaaacaaaactagataaatgagtacttaattaaactaaaaaaccttaacacagcaaaagaaataacagagtgaacagataacctgcataattagagaaaatattggaaaactatgcatccatcaggggaccaatatccagaatttataaggaactcaaacaactaaacacacacacacacacacacacacacacacacacaaataactattaaaaagtgagcaaaagacggttttcaaaagaagatatacaaagggccaacagacatttgaaaaaatactttacatcactaatcatcagagaaatgcacattaaaacctcaataagatatcatcttacactagtcagaaccattactattaaaaagtcaaaaaacaacagatgttggtgaggatgcggagaaaagggaatgctttatactgttggtagaaatgtaaatttttacaatctctatggaaaacagtaaagagatttctcaaagaattaaaagtagaactatcatttgatccaacaatcccactaccgggtatctacccaaaggaaaagaaataactatatcaaaaagatacctgtactcatatgtttatcatagcactattcataatctttgctaaagatatggattcaacttaagtgtccatcagtggatgactggataaaagaaatggggtatatatggacaacagaataccattcagccgtaaaaataatgaagcatgtcttttgcagcaacatgaatggagctgcaggccattgtcttaagtgaaattactcagaaacagaaagtcaagtatccgacgctcccacttataagtgggagttaaataatgtgtacacacagagtatagaatggtaggtctagtaccctcagaagggttgggaagagaaatggggtgggtgatgaaaaattagttaatgggtacaatgaacattattcaggtgatggatacactaaaagccaagacttcaccactatataatatgtccatgtaacaaaattgcacttgtactccttaaatgtatttaaataatactactaataaaactattagaaaaacttaagtgaaaattttcacaaaattgaggtaaagatgtttagaaaagacacaaaaagcacagttcataaagtaaattaacaaattggaattcaccaaaataagaaacctcttcacatatcattattaataaaatataagtcaaatcacagattgaggagaaaatacttgggggctatatctgattaaagacttttaccaagaatttttaaagaactcttacaactcataacaatacaaacagtccaaattttaaaatgggtaaaaaacttgaacagaaattcagaagagaagatatacaaatggataaataaaaagatgctaaatcatattactcttcagggaaattaaaattaaaatcaatgagatataactacatacttactagaattcctaaaggtagaaactgacaataccaagtagggcaatgatgtgaagcaacttaaactctcctacattgcagttgagaatgcaaattgctacaaccacttttgaaataatttggcagatatatatatcccttatgtgtgtggggggtatacacacactcacatatgtacatatgtatgtacacttataaaatataaatatatgcatctaccacataatccagcaattctactactaggtatacttacccaagagatataaaaacatatgttcatacaaagacttgtactcaaatgttcactacaattttattcacagtagcccaaaattgaaaacaacctaaatatccatcaataggtgactgaataaacaaactgtggtgtagcaataaaataaaatacaacttggcaatcaaaataaattactgatgaacacagtaatatgaatgaatctcaaaactattatactgagcaataaaagccaatcccaaaagattacatacaatgtgattctatttattgaaattccagaaaacacaaatctaacctacagtgagaaaatagatcagtgatttcctggggccagagcagggtaagaggactgtaaatggcacaaggaaagtttttaggtgacggaaaaatgctatatcttgattgtgactgtgatatacaggtttatatatttgtcaaaactcatcaaatactcatttacactaggtgcatattattatatgtaagttattatttaataaagatttttttaaataatcaatgcctggtctctccttccaccccagcacacacccttcaaaaacaagtcctccttaagttatttgaaatcttggtataatgttttcttacttccatatccttcaacactcatgttcatgcaatcactatattctgtttaccttcaaaatatctcggcgtcttgacatatcttatctccactggcacctttaggcctatgccccattagctcttactcacatctcttgtgacatctcagcaggcactctcatggccttccaatctattttccattctatttgcatttctcaaaaatataaaagataaagggtcttaaaaataatgtgtagctactcacccaatgatgctcaaagttggtttgaaaaatctgggtttgaatcttaagaagtggtttccaaagctgagtatcagaattacctgggtggctttttaaaaatcagatttattaacctcatatggagattctaattcagtttgaggatgacaccaagcactttctccaactatcctgataatcatctagttttgaggatcatactactctgatgtcagtggagttactggaaggttaagtctcatgccaagaccatcaagctgagtcattttatttataccactgtttccatacagcctggcagctatccactaggaaacctgcccaccaagtaccaggtttaccactcactcttaccaaagtcatctgtctttatctgaaagatcccttcaatggtagtaattattgtaatactaattattgtaaactttccaagcacttttatgtatactataacttttgcaactatcttataaagcagatatcattatctctactttataggtaagaaaactgagacttgaaagttagggtcctttgcttacaaacagctaatgaataacggtaaggtttaagccagaatctgtcagattccaaagaccacattctttctgtgatactatatagtttccctaggaataagcagggaaaaaaatgttccctgtcatattcactgcttcctttatatctaccttctgaatttgttcttctccagtcagcttttggatggcagctgccacagcagaaggcccagcaaacaactgaacaatagctaatatctgattacaacagggaagaaaactgacaggacaaaaaacaaaaccacatgaattaaggtcctatggcaactgcattatcaatattaatcatatgacttcataatgactccttattcaccatatccaacctgataaattggaattatttcttcctacgaataaatgatatgtaggaatgtctataagtatgtcaaaatttcatgcatcgtgaatttcatagcaggaacccggctaaagtcaacattcatatcctaacatttttaataaatctatagaatcaaaggtataaaccagaaaattattagcctttcagttgaggtataaacaagactgaacacttttatttaccattccttgctgaagctattagctaatagccttaatttatgaaaagatatttatttcctttgaactgctttccccaaatcaaggcaaaagtactcagcatctttgagaaactaaactgttggacataaaaccaaacttcttgttagtataattttaatcatcactttattatatactgaaaatatacatgtactcatgtaagttaaatattcaaaatagccaaaatcaaattcccaaacacttgtgcaaaactgctaaaaatttcatttttcatcctcatctagacatgacacagaacagcttgccatgatacgcccttctcaataagtgtaaattacacacagtaggggatttaattcccagaccatggaaagctaaaccaatgagaaaaatcaatccaaaagactgaccttggcagcccaatcgtgaatgtagttattttcccttcagccaaagtcacagtagagattctttactctttctagtttgtcctagaaaactaatacatgggtcaaacaataattttctgaatttggaccgctgttgcagccaatcaagataattttgaagctattcaatctctgagtcatttctcagtaatagaatttgtggcaggtcaggaagaacgatatggtttggctctatgtccccacccaaatctcatctgagattgtaattcccatgtgtgagggaggaacctggtgggaggtgattgaatcatggggtcagtttcccacatgctgttctcatgatagagagttctcatgagatctaatggtttaaaagtggcaggttcccctgctctgtctcctgctgccatgtatgacatgccttccttcccctcccaatcatagaagcatcatgactgtaagtttcctgaggtctcagccatgtggaactgtgagtcaattaaaccttttctttataaattacccagtctcaggtagtatttttatagcagcatgagaacagactaatacggataattggtacagggagtggggtactgctataaaaataacctgaaaatgtggaagtgactttggatctgggtaacaggcagaggttggaacagtttggagggctcaggagacagaagaatgtttagaacttcctatagatttgtttaatggttttgacaaaaatgctgatagtgatatggacaatgaagtccaggctgaggtggtctcagatggaaataaggaacttattgagaactggagtacaggtcactcatgttatgcttttgaaaagagactggcggcattttgcccccgccctagagatatgtggaactttgaacttgagaaacatgatttagtgtatctggcagaagaaatttctgggatgattggttttgaaatgtgaaaaaggcatgagatttgggaggagccaggggtggaattatatggtttagctctgtgtgcccacccaaatttcatctggcattataatccccaagagtgagggagggacctggtggaaggtgatgggatcatgggggcagtttcccacatgctgtttttatgatagtgagagagttctcatgagatctgatggctttctcctgctgccatgtaagacactccttgctttcccttcaccttctgccatgattgtaagtttcctgaggcctttacagccatgcagaactgtgagtcaattaaacctttctttatagattacccagtctcaggtaataattttgtagcagtgtgataacagactaatacaaaaaggtttttgtttgggagcagaattacaagagttcttaattgtctgagcatgtgttgcccaagaaaccttagtgcaggagttgcatggagaagcaagttgtcataaatgaaaatattcactaagccactgacctctgaaacaggctccctcccaaccttcacttttgttccaggcaaaattttttaatcaacttcttgttgattgcttacaatagccaaaagtaaaatgcaaaacaactacaaaatgaaattggagatcttataaaagatccagagttatagaaagtcactggaagcagcattgaaaacttgccagaatcatgtgcaaaatcatggacatatgacctttgggatgattagaccaagggacagacaacaaagttttcagaggaaagtggtttcataattttgttttgatttttgatataaagcctcaatcaattttttaaactatttatctggaaaagtttattcccattctaagtagaatcacatgtaagtgccatattccagggccagggactgtcagataacgagggcttccttgtaccaccttctcaattcttctctgcctgtggggacactggtttaaggtatctcacagtcccaagttcctaattttcttattttattaaaatgataatatgacttacatatttttaggaaatcaattttccataattttcatttctgtgttttttttcaaccaggctttaaagacagaattgactgaacccatctaccataattttgtggtgggagacttgctgcatgtctattatttcttgctatattactcttataatttaacatttcctcttttatcctttgtttcctggaatctgttatttatgcttaattatgttttcttccctaaacctatacagctctgaactcttaaatgcaagagtaatctgaacagcatgaacttaatttataactctaataacatttttcaaaataaagagtagccatttaaaacatgtcatttattttgaattcggcagtcttaaggaaaaaaataataaatagggacaaactataatccattatgcaccacagaccagtcttcattatctatggcaagctacaatcagccttctctgggatacagcaaatctgaggcctggatttggaatcagggtcttgctttgttagaaaaaataaagttaacagggacacagctgtttctcagaagatgaagttgggacacccttgttcactttcaaagttgtcggacaaatttgagattcacacgctaacagaaaatgctttcccctctcgcttgctgctactcatcccaattcctttgcttaggctataatgagaaagttacttttattgcattttgttccttttaattatttcttctccttttccaagctttccaagtcatccggtctttcattcattcatttctcaaatatttactgagtatctgtcacatgccattctgctcagtgctagagacacaataaaacagacatagttcaagaagcttaggatctagtaggtgatacagacaacaaattgacaggagctaatgaaagcggtacactggaaatagtgtgtgggagagatgaaagtgaggaggaatctcactttatttgaagggtcagataggcactttctgagaacatggcatttaagctgagatttgaaggacaggagggagccttgccttcctggcctcgcaagtacctgaggaagaggtttccaagcaggggaagagctgatgtaattatgccaagaaatgaaagggtctgggcactctaggacatgcttctgtggctagagtggatgaacggacaagaggagtcctagatgttcactggcaaaagcagggcacatagcatgatcagtccccagacccacattccccaagtaaagcccttggtagagtaatagctgggatgtttcaagaatttaattagtcccataaatctctaccaacgttttaaaaagcagataacaagctgggcacagtggcacatgcctatagtcccagctactcaggaagcagaaggattgcttgtatccaaaagttcaaagccagtagtgcaaactataattgtgcctgttcagaggcactgcagaccagcctgggcagcataagaccctgtctcgggccaagcgcggtggctcacgcctgtaatcccagcactttggaaggccaaggtgggcagatcatgaggtcaggagtttgagaccagtctgaccaacatggtgaaaccccatctctactaaaaatacaaaaattagccgggcatggtggcgggtgcctgtaatcccagctactcaggaggctgaggcaggagaatcgcttgaacctgggaggcagaggttgcagtgagctgaggtcacgccattgcacaccagcctgggcaacacagtgagagtctgtctcaaaaaaaaccacaaccctgtctctaaaaaagcaaacaaaatcccagcactttgggatgccgaggcaggcgaatcacgaggagatcgagaccatcctggctaacgcagtgaaaccccgtctctactaaacatacaaaaaattagtcaggcatggtggcaggcgcctgtaatctcagctactcgggaggctgaggcaggagaatggcacgaacccgggaggcggagcttgcagtgagccgagatcgcgccactgcactccagcctgggcgacagagcaagactccctctccaaaaaaaaaaaaaaaaaaaaaaattaataaatacaaacaagataaactggcattttttcacccttcttgggtttttttctttcttaattctctataatgtgtatgctactgaatgacaaagtagtcaaaaagtgttatcttcctaaaagttctagctgactaaaggaaaagtgtatttcttggcagttctagctgccaagaaaagtatatttattgagacagatgcactcattaagcacatgaactttggcatccaggcaaattctgggtgtgtacactacttccaccgcattttatctctgtgagttcggtattatctccattcatcctcataggtttatcccttagcttcctctttccaaaaagtaggcctaactatgagactaaataatacatgtaaagcatttgatacagagcctagtacataaaagtactgactaggcattagctgctatgattataatttcatgttattatcatatactctatcaggcactctattaagatttaacttccgggcaaatcaagaacttgttgctaagtacatttgtgctcagaaagtttccttcgttaagaaaaaatggcaaaaattactaaagaaaaggtgagaaaatatctactatgctgcagtaaagttgttcaacacttcaaagatcaatttaaacagtcacatcttgttacagatctcacctccatgaaatatcaccttgacttgttaaatcactgttacatgaattccaatgggcctgatttaccttaaaatctgcaatgattcaacaaagaaagtgtgagaaccaaatgggattatttgaagcatgaactaaaacattttgatatcaattgtaaagatggtcaaaatattaatagaatttgaattgtaggaaaggcaaaacaaattttaaagagaaaaaattaaaattaaaatgcaacattgttcatcttgctaccataatattttaaaacattataaatatcagagcagtgctcacatatttcctggtctgttaactgataggcattttcttatatacaaaaaaagttaagatcttaacataaaatgtaggcaagacatacatcttctggacataaaaaacattttagctaagtgaaaagtctatcaaaatttcacctagcttcctcctgagctctgaacataagtctgcaactttcacaaagacctttaaaacagctaacatttctgcaaacttcataaacaatttttaaaaatgtattaaacacatgaataacagaaatttaacatgatgaaaatataataggcaaaaagatttttatgtttaacacatcattgctaaaaaatgatgtgttaaataattctaatcataaaaatatgactacctgtcttttttttagatcaatgatttagactttactaatttggaattagagaagatttgggctgagtcagggtttatgtttctatcatccattcaaaaaggaagtttactcagtaaattcatatgatgaaaacattttcaggaaaaaaaatatttaacccattcaaaagaaactattttgtgaaatctaagaatgcccatttccatataaataaatctgagctttgtgtaaaactaattataaatctttttttcactattcactaaagcaggtgtacagaaatctaaccaaaaatgttcaaaattttaggtggtgtttgagctattatagatatttgaaaataatagaactacaatttaaaatatttataataaagacattttactaattccaactgatctttccccaccttccctccagatttaacattgttctgtagttaaggatgggaataggtgagaagaggctagttagaaagtcagagttgacagcttaagaattaatgagatcgcgccactgcactccagcctgggcgacagagcgagactccgtctcaaaaaaaaaaaaaaaaaaaaaaaaaaaaaaagaattaatgagtaatttttttcataaaccgggcatgaaactgttacatgcaattgggcagagagattatatttacattcgcctacaatcgtttttcttattcctaagaaaaatttaaatatgataagataggtcattttctccatttggtttgctccaaggaggttgttgatttctggcaaatagatcttaactattattatttcattagatagtaatttctaaaaattgagaattatttttcctcttcaaaccaactacatcttgcacaatgctctggatattgtaggagtcccacagaagttcatcaaattcaattgaaagactgaaattattcagtaatcttagattcttcaataccaaagcattaagataaaatcagacaagagcactgaattctgaactaattcaataaaagtcatcaattatgaagcactttcactaacacatggctacatatgggcacctaatttaaaaatggcttagttattaaaggacaaaaataacatgaatgtcacagaattttcaaaggagctttataatatgtgtaacttgctagaattggggttatcaaatttaatatgaacagctctcatcaaatttgaacttaatgaatgcagttgtgaaacaggcaaatccaatacactgcgaatagtctaactcttaattcattccacagatatgatttacccctaatagccagaagcatcacttctaatagctcacgttatggcagaatggattatgttgtattcattctacctcctggaaggaagctagtatccataatagtaccattcaactgtgtgttataaagcacaagccagcagaacttttataacataaaatgtgaagatatttaaaacataaatttagtaggttgtgacagatcagagacttctctctttccactgaagggatatatttttttattcagatctttcaaatcctggtaccgaagctcagctacaaacttacccagcactggaaaaacatgtcagcatctgtgctgtactttgagactcaactcactatttctataaacatgtatgtacacaggcaatagacgtctctacaaagagtaaatttattgttcacttaacaaggaggatgtgtcagcatttgaggatgttttggacacttacacttctttttctgagaggaatgtgtaccaagcagaagggctccagattgctaagagctcaagctctctttttaaatattccactcctgagaaaattccccatcagatataggcaatttctaaaagactttcaatctaaggatatttacatatatttctgaaaaaaaagaataattgcatattagcttgaaagaatgtatataagaattaaatcacaggataaaagtcacattgtcctgcaaagggcataggttttacggtcattcagacctccaagttcaaatctgaattctgttaaaaaccagctatgtgatcttggatgacttaatctatgtaagccttgattatctcatctataaaatgaagataaaagcaggactgttctaggagttggagtttatacacatacacatgcataaacatacacatacacacacacacacacacattccatatagtcaggtcattagcacaatgccagagagtaggcactttgcaaactggagcaataaatgcctagtaatgtggatacctctaagttgtataggcactatctgctcatgttctcaccacctcactacattatgggccattacagacaggaactatgtcatatccaattctgtaatcccaagatctaacacaacacatagcatataatagaaactaataaactgctacttatatttggtaattgcagttggctcctcctgtatgtgaatagattttatcaagtaaatcaaacataaaatgaagagtgttcattcttaacctattaaattttctccttctttaaacttacgtaggttacttggctatgataatgagctgttgtttttctacttaaaatttaaaattcttccattgttttgccatctttgggtttgtctgggtccctttccaaaatttaatttgctttgctattaaaaaaaaataaaaacagaactatgaatcctgaatactaggtgaatttcttgtttgattcaaaatgcaataatatttctgggtaaaaagttaaataacagttttgcctagaggcaatcttcttcatttactgtcctttgtgaaaaagtaaagaaattaaaatattttttacctgactctaaacccataggaaagtttcaatttagagtttgtactaattgcttaagctcctttccttttaaaaatgagattctaattttttaacaacttgtcaagattacagcagcctgtttgccacaaatcagatatttactttctccctctctcttctctaaactggttctccaatcccaatcaaaagtatacaagcagcacctgcaattccctcttcacaaagaatgttgaaaacagatagcacaagagaggttccacagcccttaacggttcagtgcagagctgcaaagcccttgcttcaatctacctcttccaaacaagaaaatcatgtaatcgaatcctcctccccacccattgcattcttttaaaatttttttttgttaatttcatataattgggccagtatacccagaggctcgaatattccctatacacatcatctcttagataatcaaatcagttagaatctgcagaacctttccattccccacacagggtccagaaacctgtattttcataagcactccaaatgatcctcatacaagaaatactgctccagcccttcacttggagaatatgcagcctaggcaggcagattttcttcatggcttctcatttgggtaaacaagctgagggttcctgtcatctgagtgatcccagggccaggatctgaatgacttgaggtttaatgggatcacaacatttccatttcattataactagtatttgggttaataaagcatttgtctcctggaatttgacctgcatcactataaattttaaaaattgtaacacacacatacacacatatgccaaggcaacttaaggaaaaacccaaagaaaagagataaaacaactctctttagtgacgaaaagcactgaagagtacccaaaagcacaacctacctgaaatccaactttcagctcaccctctctatcttaaacaagacgaaaatcagaacaaagaaaacagagtccaatgcaattaacaacaacagtgataataacaaaaacattttttctgtccttactaacactggcactctgtcaaatgagccacatatattatttaatcctcacaacaatattcctcatttcacagataagaaaccataagcagacagatatatgcgacatgcccaaggtcttctataataataagtggcagaggtggaactccaacttaagtgtgtctgacctctgagcccacaaattctaactactttgtcgtgctgacttccagcccatcagcttagattgggtggacagtggaaagaacaatgtgttctcatagtttcatgactgtaagttatccagaaacttctcccatgaaccaagacactgcactttgtacattaagtgtgacagtatctggaacacctcacatacctattgagggcctcatgttcttcttaccacagaaaagagataacaaaatgtaacctgagcacatccaaccttgaggcaaactatgacagtcacagtacctcatagtagtcacattagtgtggtaccatcttgaaaaatggagccatgaaagcaaaaatctcagaaagaaaagagcagtgagcaaactgcctcataatcaagtctaagtagatctattatttaaaaagtaactggcatatattcttcaagcaatattcacttaccccagagcaaagactttaagtttcagctttggaatcagttgctttttttaaagtcatcaaacctcctcaagataatcatcaatctctcatcagcaccctccactgcaagtacatcattacgattgttttcctttatctgcactaaatctctgtagctcatggaaagcctgtgttagagtagaccaagactgggcagtaggcagaaattcatggaaaaaaagaaatacacaagtccttaactttaagctctttctatcggaagttatacagagtgaaaaagagtagctggaaaggccatgtgatccctagtaaacatagtaaacattacacagaatcccatggaagctaggtcacaactggcgacaatgtgccactcatgctagaagcacaggttccctcacaggcccatggatcaatgttttccagggcagccccactatgcttgctggctgggttgctctgcatctccagggcagcatatgcctaggctatttactctctagtcaagtcatgttttgccaacaacaaagtcaaaactaatttatgtgcacccagaaatatattgcattgctcatataaattcaatattcaatcaagactatggagtggtaatcttaatctatttcagcttttctcaatctcagcactattgacatcttagactggttaattctttgatgtgaagggccatcctgtgcattttaagaggtttagtggcatccctggtctctattcattagacagtagcaaaccctgtccccaatcccacacttgtgacaaccaaaaaatgtctccagacattgccaaatgtccctgagacagcaaatctcttccagttgagaaacactgttctattttctcaattgtcccctatcaatggtcttgaaaggcaaatataatatttctacactacaatgtaactatttaaaagatatttcacaccccaggttactatcagcctcagtgattctgacttattctgtctaacttcaagtgctctgcccttctcattctggtgctgttacctgtacttcaaatgcccttgggtggagtatgaggggcccacttccagggccctgactgatttccatctctccatttccttttctgaacacctggggcccttgaacgccacccagctttagggtcacctccaattttgtctctcaagaactgatcttgatttggcaaggaggaatacgatcctcatattctggtagtcagtgtcaagttactcctgctgtttgtcattaaacccatccttgtgactcacttttgaaagccaggcatgtgccttgagctgcagacaaagtctccatttatcactccatgttgataatgtaagttgtgtttttttccctacactttcatcattggtctcatgctgtatgatcctctaggattaggaccctgaattattcttaccagtcccaactcagaatttgtgactgtctgcatgctgacagcaatgttaactcaatgttattttgtctggcccttggaattccaaatattaccttctttggaggtgaccatcactgagcttccacaatctgtcaacccttgctcattagaccttgctgcacctatatggtgccaatggccatattaggccactaccagctgccttctcaccaaccctgcggctctcatccttagcctgctggtctctttctttaaacctaacccctccctagtgcccatcccacccacacaactgaggggtttccaggtccagatcttggctcatgacattctagataccctggcgaagctatggcactcagacctgagtagatgctagaattcatgttcaattaattcttctagatagtttaccttaattttactcaagacttaagccagaatattgctttatctagtcagataatccaaaaaattgttgaggattagaaaatgtacagaaacaggatccccagtcctacttcacaatgaacctaacatttgaatacattatcctttttactctcacatattttctcaggaaatgaaagactttcacagttgtcacacctatcaaaacacttaattgcatcaatttctctacctcatctccttccttcttcatagctacagtgagcataaaatttaggtacagatacctcaaaaataaaaataaaaagaatgtaaaagtgttaaaatccattaataatttaatttcagcatctgtatggagaagaaatatgctcattgtggagagaactttataacaggttactgtttgcaatcctctgcctttatggagatctacatccaaaccagctcaggcacagaccaagactagactatggcaatacccaataattaaccattagcctggggcttcacaaaaataggacccactggagtgcagcaaatgctttcagagcttcccagaagctggtcaagaactcttaatactagttgacttgtctgtttttgtttttgtttttttttaagagaccgggtcttggtctgtcactcagcctggagtacagtggtgtgatcatagctcactacaacctggacttcccaggctcaagcaatcctcctgcctcagcctcccaagttataggtatgcaccaccatgcacacctaatatttttttaaaaattttgtagagatggggtctcactttgtcatccagcctggtctcaaactcctggcttcaagtgatcctctcacctcagcctcccaaagtcctgggattacaagcgtaagccaccatacccagcttatactaattgacttattttactagcatgcagttggttatggtaatatgagtgcacaagctagtgcatggactggggaaatacacaagctaaatgaggcactgtgacagcaagaaagagaagtcccaacgacacaagccagtttacacacaaagccaatttctcccagtgacaagtagtgcttttcaaattgcagatcataaccctgagtattgcaaagaatgacctattaaggttctctccctcaataaatgtactcaaattaattcagaaatttttttctttttatgaatatttgagaatgcactgtaagcaaatagtaagcataagaatgtttgatgaaatatttttccagataaattgatagatatatgatagatgattaataggcttgatagatgcatggatagatggatggatggattggatggatggatgggatggatggacggacagatggacggatggacagcgagacagattgattcaacaactatttattgagcatttaccatgtgccaagtacttctctagacacttggatacattagcgacaacagataaaaatccctgcatttatgatgtttagtagaacagacagcagagaaaaatatatttattagtgtaagtcatgatttaaaaaaaataaataaccatttgaaagccactgttgagagtaaggagatgccccatgcatctttccaccactccaaggagagaaccaaccaataatcatccttccacagtggaaaaccctagaggggtgaagtgaaagggacagtccaagtcattccccttctccctttcaagctggtctttaagattaagcatggcttcctgaagccaagctctctttgctctgttttgcatcttcccctttaattttgcctttttcctacagttctaataggtaagcctgttggaagggaaggaaaacagcaaacgaatgagctcttggtggatatttcctagtagtgtaacagatggagaggattcattttatccttaataaatagtcacttccaataatgggcaaaccattgaaattgtgatagcctattgtcttaagccagttaaactacacatctacctctgttgttactaaatctcttcagagatatcctaataagtattaactaatatccagtgtgatacctctcaaaataacttgcttatttaatttgtagcagctgtagctcacatttaggggtgtctagtataagcataagcccatcattgcaggctatgtgctttacctttaatcttcatgacgaccctgtgagggagaaatcattatctgcattttgtaaaagaagatactaaagcttacagaggttaaaaaatttgcccatgatcatttggctaagtggcagagctaaaattttaacaaaggccatgtagctccacaaaattactgatggtatccacattaagggcaaaggcttattatatatggaaaaaaattaaaaattattctcagaaaacttattttacaggcctatgcttccccttgtttgcttttaatcattctttaatatttaatggtcattaaaacactataaaccattaagtttagaactgaagagttaacacaagcactttttcttctctttgctgcaataggtataaatgtgtgagtgctaaaaatattttgatatctcttgcacaaaaccttttcaatacccataagtagagtaggagaataagaggacagattctgtccagaatatttcgcctcaactcccagcctcactgcttatttgctatgtggccttgagaagtctgtgcctcatttcctcatctgcaaaatgggaataatgatagcagatacaggattgttttgaggattaaaaggcatatacttggaacagtgtgggcactaaataaaactacatatttgttatgcttattattacttcttaagcagcactggctcatctcattccactagacattaaagtcataaagtttatcaagaagaaaaagaaaagaataagttctttaaacttgaagctcagtaggagcaaagagctatgtctattccatcatctgtcttttcaatcccccacgacttgtgttgctggtagggcacactggatgctattgctaaccagtgctgttttgggaaagcactacccttcataaattatttgaaaaggaaccattttgcttttatactgatctatgagatatcattgcttttcaaaacacaatcagcatatgtttatttactaaaaagaggtcaatgccacaggtttgcatgaaaaagaaaaatcatgaccattgttaaaagaaaatccaaaccaatttttcagcatagttctatatgttgttttaaacaactatttcaaatgttgctcaaatgaaaaggtcaagtatacatcaatataaaagaatataaaggttttcattatcttttagtctgttctcactgtcagtgaggcaagaacatgtttaaagtgcatctccccataatcaatttctttacttagaaatgtcattctgggtggacattttacagctgattaatttctgtccttctttctcatatgcaaatacaagactaaaatgcactctctggtagatttcctttctgcggttaaagtgctaatttcctacagatcggttatctacacagttctagcagaaaaaaatgatctttcaaactatgctcttatgtttctttaatatatgcatcttttccccaaaatatttgcattaagtcgacaaacatttgaacataaaaggtagaagacattgtcatggcttttgtcaaaaagtcaacatattaagtattgtgcacacacaaatgtactcaattaacattttaattaaggataacaaatagtaattaaacagatgacattttaattaatttctcaactgtaaacagcctgatgaaaattgttaaatctgattctagttaaatatctcttcttgcaaacatggtaagcccaaactaatcacgatcagaaacatttcccttttatgtacttacatagtcataatgtcattcgcaaataagtttttcaagttcctcagagttatgaaccacattctctttattatgtaggaagcaagtgatagcataattgtataataattgtttcaaggaacttctatatgtcttgtgaaaaagcacagtatactaaagtatttaatgtctttctacaattaaagattcatgcttcgctgttaaatccaaattaacaattttgtcaagcttagcaacccaattccataacatcaacttttcatattactgaacatctgtaatacctgtctctgattttgtaatacactaggggtagctaattgtgtcaaatggcattattaatttctcaaagcaaaattagatataattcatttatttttgaaaataaatatgggccattcaacactttgaagcagagtggcataataatgctgaaaatgatgcccaggatatttagtcagtgaattaacaagaaaacggaacaaaccctgctctgaggattactggatttagcaaaacagaacaaaaacgcaaataagtttgtcttttgttttctatattgcatgcaacatacttacaataaaagattattcactgtttatctgaaattcaagtttaattggcatcattttatctggcaaccctacttttaaaaaagcagtatctgtaagataaattcaccttgagaaacactttttttggtctctggtgcaaagtgggctatggcaaaatgggagcaatctggtggtagaggatgctctgggcctctctggggccctgagaggatactaagatgagccacagccagtattgagacagcatgtccaggagacaaatactctgtgtatttagtaagtcagatttgaagtttaaaaagttactgatctattttttaatctactctgctttgttttttaagtgtaatatagataggtctcatagggtagccagcctctctgttatattttccccttcagaatcattcagaaaaggcatgcagaccctaaggaaatacagcctacatcaggggcactctgtcgctgaagagagtgtaggagatacttgtggcattctatggtcccttgcatggcaatttctgaaaactgtggttcccagagctatggcttgaagagactcacaactgctctccacggcaaaagtgagcctcagaaaaaacagtgtgggggtctcatggctccaggagatagaggaacagggaaacaagggaaacccagggacaaacccaggaaaactcagagacaacaaattccaagttttggacatgtaagtgttttttcccaactgagaattctgaagaatatgagaaccaggacatatggtcttgaaattcctgttttaatctgcaagatcaaaacagaatattttagttcagttatccagatatttcacaaaagatgagtatcagctctagtaggacacagctaaggctactaatcccctccccttcacaaacatccctctgtttacctccacttactcaaaaatctcattaaaatttggtagtcattcatcttacagtaactctgtacaccacctcacctctgcagtcccatacctcttgagaggatcttccatgacctaaaagatgacccctgtcacctcttcaactcaaagaaaggatctccaacttaaaaagggggttgcttagggaaataaaaggggaacagaaactaatcacctaaaaccactgtctactcacagcgtaggaagctctttggtaggcattaggaaagcatctctccgtaagttagatggtatatttgtgtgtgctattattgctattgctatttaactgcaaatatgcaattatcacacctttagcatgaggttcagtagacatagaggcactagattcaacaatattgaatttacaaaagaatggtccaatgaatgaaagttgggcagccacagaaagcctcagagagctaatcaatgtttcccaagaagtctgaaccccaccaccaaaccaagcaaagctgaaagtaaacatgttccggccaaagtacagaaagtaaaaatgcttcctactgctgtggatgagggtcctctgacaggccccactgatagagagtgggaagctcaagtttaccttaaaggaccttgtttcctaatacatattgttaaaccctttcgtaatgctctctgcaagcttggctgggtacttctctgctaactactaataagctgcagttttctcttggtctctgctttgggcaaattccctcctatccccccactcaccttgcttcagctgtccctaaggcttaattccaccttctgccctgtacaagtatactaacttagtatatttctaatatcctctaatccacatttgccatatctttcaagctgggttcaaaacacctctttttagaagcttttcagaattaaccaatgtaactaatgcaacccaattttgctgttttctcctttcatctataatgcctgaatccttttacacttatatgtcaagactttaccatgtttttatgttgtttacccagagaaagaatattagagctttgtaaaattattgatgcctcaaatgcagctttaaaatgagttaaataaataaaaattagtatagaagagcacggtaagctttgttgtttgaaaagataacctatctactattgcccatcttcgaactcaactcttcaacacattaatgtggcccatccccttgccattgaaccagcatcatctggaaacttgttgaagatacagagtctcaggtcccaccttagacccactgaatcagattctgtattttaacaagatgcctccagtgatttgtagacatgataaagtttgagaagccttgaccttccccatactaggcatgaaatattctacaaggaatatctcttaaatgggtgcaacagagtcgattcaggtatctctacttctgcccaatccaatccaccaattagaaagcaacttttccactaaagaagtttaagggatcaattcatcaagaggacatggctattgtaaatatatatgcaccccacaccagagcacctaaatacataaagcaaataatggacacggggaaatagatagcaatacaatgatcataggggacttcaataccccactttcaacaatagatagatgaagcaaaaaaaaaaaataataaggaaatactggacttgaatagcacttttgaccaaatgggcctaggagacatagacaaaaatttctgtccaacagcagtataatacatgcacatttttcttcaacacacatagaacattctccaggatagaccatatgttaggccacgaaacaatcttaacaaatttaagaatactgtactcatatacagtattgtttcaggccacagtggtatgaaactagaaatcagtaacaggaagaatcttggaaaattcactaatatgtggaaattaaataacatgctcctaaacaaccaatgggtcaaagaagaaagcaaaaggaaaacttaaaaataacttaggacaaatgacaatgcaaacacagcatagtaatttttgtcaagggcaccaagggaaaacaatggagaaaggtgagtcttcaacaaatggtgcagggaaaactggatttccacatggaaaagaatgaaatcagacctttatcttacaccacacacaaaaatcaactctaaataaaagacctaaacataagaccagaaactataaaacttctagaagagaaggagcaacagctcatggacattggccttgatgactttttggatatcacatgaaaaggtcaggccacaaaaacaaaaataaatgagactacatcaaactaaaaagcttctgtacagcaaagaaaacaatcaacaaaatgaaatgacagcctatagattgggaaaaaaaatactgcaaactatatatctgataaggagttaatatctaaaatgtataaagaattcatatattaatagtagaaaacaaataactcaattttaaaaagacctcaatagacattctccaaagaagacataaaaatggccaatagatagatgaaaagatactcaataccattagtcataagagaaatgaaaatcaaaaccaccatgatataccacttcacacccattagaatggttattatcaaaaagtcagaagacaaccaatgtgggcaaaggtatggaaaaagggaactcatacactattgatgggaatgcagactggtatagccattatggaaaagaatatggaggtttctaaagaaatcaaaaatagagctaccatatgacctaacaatccctcttctgggcatatacccaagggaaataaaatcaccactttgtaaagacatctgcactcccatgttcattgcagcattattcccaacagccaagacagggaaacaacctaagtgtcagctaatggacagatggcttaagaaaccgtggtacaaatatacaatggaatattgttcagtcttaaaaagaacaagattctacttgccacgacatggatgggactagagggctaagtgaaataaggcagacacgggggaaaaaaatcacatgacctcacatgtggaatctaaaaaatcagagatagagaacaaaacagtggttatggggtcagggtgggggaatgaagaaatgtatgtcagaggatacaaaatagcaggtatgtagaatgaagaagtctagagatctaatgtacaacatgaaggtcataggtaataaaattgtactctatatgagattcatgctaaatgagtgctctcaccacaaaaacaaagggtaactatgtgagataatggatacattaatttgcttcactatagtaacctttttactatccacatgtatcccttaacatgttttataccttgaatatatacaatacaatttattttataaataaataaaattctatttcccttgcctcaatgaaacaggaaagaagacaggcatagaatggagggctcatatgaaagaaaaattctgcctcctggaaaacaattgctaatgaattggtatttgacagcagaggcattgcaatggcagggacttcaaaaggaggctggtcactgaaaccagtggctgttctcaagacagtggaacaggagcacatggacatgcaggagggctctgtagaagccaggagccaccagaacctgaccagaaaagaagacaaaggcatcaggctgtccaaagtcttaatggggaaaaactggaaatttaaatcaaagccctactggctctcttttgcactcagtgttggtggtgcccagtgctacactaagcactctacctacctcattgacaacgactataatagaccataagtgttattattcccattttgcagacgggacaactgaaaaaaacagaaagactgtaaaagtcacatcccaaacacaccacttaaagtgatggcatgggattcaaaatgaatcccactcccagttctgtcctcaacctctatgctctactgcctccttctgttcaaggagagtagagtctgtatgggtcttattacacagtgtgggcccaccattctcagctgacccttgggttggcttcataaagcccagaattagagaaaccctccagatgttagtacacacctgtatctgaagtaggtaagccctgcctcaaaaacaagattgctatcatggtgagtctatgaaatgctgtcttaagaaggttgttgtttttttgttttttgcagtttgtacccatcaggttttagcagaacaacaggttttagctatacacattgggttttagcagaaatgaagcactttccttccttggggaacaacatatgctggcatcgctaagtgtgtggctgcctggctccttggtacacaaggactctgtaggaggtcaggcctccttaggacagcactggagactctatactccaaaagtctctccacctggcctagagggtatgtttttagtcctcacaggttatgctattccagatccttctccagccttgacctccatagagaaaatcacatgacacacttcaataaactcaaccacctaagggttcttgtggttcttgaccatacagaccaaccacctccagcaaatctcccactagcaaaaagcaacttatctcttccatggatcttcctcggatttctaccatttcttatctaaggacctcttatttcttccaaagatctgtttgtgtcataaaagaaaaaacaccccaaaacccaattatggatggttgtgaaaagccatgtcaaattaaggggatcatcaacaacgttttctacagttcacataggaggcgatcgggatgctgttcagtcacgctgcaacatctgcctttcattatcattatcgtcctcacagagttcttgagcccctgagtttacggctttctactgggattttaagaaatacacagagatgtatcaaaagttgaacctgtgtatttacagagaatctcagagaaaaatctcttccgtatgataaaaggcctagggacttgtactttacagaatacaaatctaaagaagagatattatgtgccttgagagcttgttagaaagctagatgttacacttttcttctcttggaactactgaatgtagattatagtctatattctgaggttttgtaggtttctcttttgcattccaaagcctttaattctgtagattaaaaaaagaagttaatattagatgttcctagtcccctttaaagttacttacgatttctcacttgccaattgttgaattttcatgtttatttttagtgttgaaaatagggaaactgctatctgtccttcacttcctgccaccttagggaaaagtgaacaaagagtagagaaactacagagacagggaagacagcaagacagacagagtgggaaggggccagagcatatgttttaagtcattcaggcctagttcccatgtgagttttatcacttagtgagtaaacttgagcaagttcattaacctctttgaaactcattttcctcatttcaatcaccttgcaggagctggtctaagggtatatagcaatgcaggtaaagcacttggcacaatacagaaatccaaactatgacatacaggatgatggtggtggtggttaacaggcaaaagtggcaagacagggcagagaaggtgaaggtagcaaagtgagaaagaaatactagatatggttttccctaaaatccaaatataagcatgattgagagtatctatggcaaaggaaatattctaccaacctgattaacaacttcattctgctttgaaagacactcaacctggattgcaaattccatgagaatcagcagactagctaatctcatttcagtttatctccacagtaatcaataattgatcccaggggaaggtcagcctagtgtccttaggtgactcttcctttgccaatttgttttgagctctctttatacaagagtgtaggtattatgatacagagattatttctttaaattggagatgcatctgatgacacttggagaaaaccatctaaagatcaccaaaggaatttaccaaaaggtaaaaccatgaataaaaataattttcagacatgtttcataggactacagttcaactgttatatattacttatgttcttaatagtttggaaccacttgtcagtcaaaattaaatcataggcattccatttgtagaacaaattagtcaatcttatttgcatgaatcacaaaattcttacagctcttcattttcttaaagtatttaacaccctccccattttctcaacgtgaatatcagggtacattagtcacaagaccataacccaattacttaaagggcatattacataaatgattacacaacctgctgtgaaatactgtatctttagcatttggaccacttgggacattgagaggaaggattcattaatgaagtgtgaagctcatttttatttatagtccacaggaaaggcatatttcacagccatcagaagcacttctgcaggcaagaagttacagctaatccaagtgctataccaagctagtacaagtccaatcctggtgtccctggcagtcagaaatgttgtaaaggggaaaggaattttataaaaaaattgatagcacaaggagtatgagaatgtagaagatcaaatccagaccacagccgaaaccttgataggagggacacatgatgaattagcctataggctgaaaggtctggaggaagttgtgatggtatgggtcagatatcttccacttcctctgtgaagtagtagaaagtcattttttgagaaagcggaagtggggagagtggtgacttgaaagagtcactttgggatatggtagagcaagttaattgggaaatagcggataattaggcaatttgaagttggtgactatgaactttgagaagcatcaaatctctcaatccatttctgtcaatttaccctactactgaatgatttaattcattttgtgtcaccagcacctagcacagctcctggcacaaggtagatgctcatatttgactcaattagaaatggcaaatatctgaattgtctgaacacaaacagtaaatggtaaataaatactggccttcttttaggtttgcaaaacacaattgatttgatagtgaaggccaacatatacataaagaaaaaccagaggcctcgattttacattcaaggtaggtcactggtacacaggaagccagctgaggagaggtacaagtgaggggacgtgaggagcacgggtggtgagtatgagatggctgcccagtcacctctgctgaaaaccacctttgagagtagcaggattctagaaacaggatcaaaagaatcagtgtagcaccatatatcactgcctctgtaagaaaactgtgcttgtcaacctggagtttggggaaaagctttaaaggaaacctgtcattctgtactccagcttccaactttgcaaaaggcacttttccttggaactcaggcagaaaaataataaatcacgcctagctctcttgctcaggatccagtcccggttccccacctgtagttccctccagctgcttcctgctacttccattcctgcaccttatgctccagctattccaaagtacttcctggcttaaaacaccaagtgatgttgtaagtcccaagctttgtaagtgatgttctctctcactggagtcctttctctccccagccccttccattataaattcccactcctcctcctcagatgtctcttcttctacaaagcctgtcccgcccctttcacagagtaaagaagcccacccctactgtgtccctgaacgtggctttaggcatggaagaaactacatttaacctttgttccccataacttgaaaagcaactggcacatcatagattctcaatgcatgtctgttgaattgagttttactgttcatctaccttgcagacaaatggcatttcttagatatcaattctttttgatttcctttttccaacccatggactataactttttttttttaactaatttcaggaacacatacgatgtatgcactactggagtctgaataaaatttctaaaaagtagaaataatttaaatgaaaactgatttctttattctatcagtttttgaactcaaactgtctagaaacaagaaggttcatattgatttaaagatgtataaaatataacaaaagacatgcgggttatggaaataagactgttcattctccaaattcacaaatattagaattaaaggcacccctgaaagcctgaagaaggtggctgtagaataaataaaaggagtgccactttacacagcaggtggcaaacatgaaacgttttattgtaagaattggtacagacttgaaagtataagtacgttccaaggaggacttagctataatctaggatgatggttccagcatgtcactgggtggaaattagagctatttactttgtcagcagggcatgcccaccccacacttactcacgaagtgccacctgtatctttgccactgtagctggagcaccgagcaagatacatccagttggtctgatctaactcagcacagcatttctggtgcttttatactctctagaatcatagctatgttgtttggagaaatttattttcttgaaataggatgcagttctttctttgattcatccaacgtaactctcatcgatcttttaaaataaaatatcttccaaaatatttacttcattgaacaaatacatgagggaggtcaaagagatatattgcataccccacccatctgcatgctgaatgtctttctaaaccatcaacccttgagaagggaaaggctgagttaccaagtggactgaggtggatatgtggcaattggaaccatattgaaccatgcaggaaacaaaaagaaaagcacagaaagaacttatctggaactaaatagcaagttcggttcacaaaagttttattcacaagtttttccatgtgaagaccttaaaattccactcaataaacatgtttataaaataagcacacaaacagcctggaaacacatgttagcattatataagaagtagagaaagacaatgaaatcagtcctgtcctccttatgctaattttgatttaatgtctctagggacctgtgctcatggaagaaaatcaaggaacatcttaacatggaaaacaacagaaggctaaacttgtggctcagcacaggagagggtagtagaaaacctggaattgacgccctcttgaaggctgccaatgtttaataacccccagagcccattgttgtaagatgtggctaattctagcagtagttactcataaaagacaagggtataaatctggaaacctaagataaagactatgaagaaactctgaggagaaagagattggtcgtaagcaagcgtggaagaaaagtggcagccagtgtggaggaaggaggggcagtatgtgagtggataggctggggctatgcatatgagttgtgttctctttgctctgtacaacttcacttgccctcttaccactggggtggaagaatagcagcaccagcccaccttcgtagcagttatggggtatatttggggcagagctggaatctgggctgcattgggagaagattagcctacccctaaacggttcctccacctcactgtccctctccacagcccaaagcttaggacttgacaaccaagtagcaaactaagttgtaaaaagagagcaggctcagagcagaggcatagacagttttacctaagagcagagtttcttataaagaggcagcaaatgctaacctcaagtacaggctttggtgatatgaactctgtgtcctggggcactccatcaccctcctcttcttaaactcaccaggaatgacaaagactaggatctggctctggctcttcctctatatgactgatacctgaagcagacaaagtgggatagggttcaaggcagcagtcatgatgagaggcaatacactgaacaacttacacccaataaatcagaactaatgaaaacgagaaatcgagaagttaaaataagcaaaataaatgtcatcaaagagggaagagagattattgataacatgaagcaggaacaagaagttataaaaatctgaaaagaaaaacaatatatgaagaatataaagttgaaacaacttcctagatggaataaatagcagaatggatacaaccaaacaatgattgagagcagatgcagaaattatctcataaggtattggaaaagaaaaaagatataaagtgtaatagttaagatctgtggaatatacaagtgtccacatctttttaacaacagtctcagaggagaggataataaagcagttgaggaaataactcctgaaaatttctatgaattaaagaaaggggaaaaactatagattaaaggtctaacaaggaaaagaaggaagagaggaagggagagagggagggaaggaggggaaagaacaaggaaatgagaacaaataagaaagaggagaaagaaaaagaaagaaaagaggatggggagaagaaaggaggagagaagaggacaaaagaggacaggagagaagagagggaaaaaagaagtcaaatgtatagaaaagaatcaaggactaacagactacactgaaggttcttaacttgttttggtgccatgaatcactttggcaatctggtgaattctatggactcattctaaaatgaaaaaattttaaaaattgttattaattgcataacacaaaatacataagattataaataaaaccatttatgttgaaaaatagttaccaaaatattttttaaaaaacaaatttatgatatagtaataggtgttctcccttattaatgagaacacaacaagacttagtggatggtctaatactgtaattttgaagaaccacagccaacccattttatcatggatgaaaaaaatatacattgttgctgacacaaaaatgtaagttggttgtaactgcagcctaaccaagtattaatgataaacatagctacatggataaaagtagaaaacaaagcaagatttatagtacgataccactgataaaaattaaaaacacattcacacgcaaaacaataccacagacttaacaaggttacacacattatgtaaaacaattacatcaaagacaccaaagtgaatgctaagggagaaaagggaattggagcagtgatcagagaagatgaaagagaaagaaaataagacaagaagaaggctttgcaccaatcagtgatggcaatgtgctctaaactaaggataatgattaacataactctcagtacctaagatctaattaaaacaaacaaccccatcaaagatgggtggaggctgaaagtcagacattattggcatttgagagaatagaaaaaaaattacaagatagcaactaaagattttatacaagtaaacccagactttgtcagctctaatagtcctaaaattgctgttttcagagatgtccttaccccacctcaagagagtacaccattgagaccaggtcaggcataaaagcctgtcagcctagagaggacatggaatagctctcagaactgtcctaatctgaaaggccagccacaaattgtcttttccagttcagacaaaggacatcctcaccgtccactctcttgtcagtggagacagaaaaaaactcaggaatccaatggttgtccagacatttgggtgaagacatgacattccatttgtcttcaatcattactgccgctataataaaaataccttagtctgggtaatttataaacaacagaaagttatttctcacagtttcaaaggcagggacgtccaagatcaaggcaccagtacattcagtgtctcgtgagggcttgattgtgcttcaaagatggcaccttgctaatgtgtcaccacatggtggaaaaggagcaagggagcctcttttataagggcactaatcttatccatgacagtggagccctcatgacttaatcacttcccaaaggccccgcctcttaatactatttcatcaggtattaggttctaacatgtgaattcgtagggggacacaaacattcagaccatcacaccatctataccaaaaaaaaaaaaggctgaatatgctctcctggtctttttactgccccctagctgtaggtggtagcaataaacaactggttgttttcattctgtttctctatctgcctcaccacctctagaagggccctaacttaagttggagtgacagcatacaaaactctccaagcaagtcctcttggtcccccaatatgccatgaagcatgctccccaggagaaagcctgtatggaaattacgctgatgcattcctccttgcattcaggtttggtaagagcaggctgtgtgcaagtggttacagctgctcagtggaccaggctgtggaaaacaaaaacgaaggctttgatttcatctctcccgggtattctccacatcacttttgttgtgtgcgaactaataataacagatctgatctacatacagttcttcttgtctaaaattactcatttaaattaagcattttagtcactgtttgataataagatgcaaggtaaagtacttgtgagcacagaaaattaatagaaaggaaacactgagcgtatgttgagtttagccaccagcatctatttttaaagatgacctaattaattgttacatagaatgtcaggagaaaagaaacactggcaaagcttttagacaaggcaactactaactttaaaagtatggcactgctgaaacagctgtataaaagcttgcagcatgatttcaacacagttgtcaagcatgctggaataaatacatggcaataaaaagccatgtaaatttctgggagaaaaaaaaaatgacaggactgaaagttgaactttaaaaaaattgtaatttttaaattgtgtgtatctccttaagataatcctcatttagtaaatcatatttacagtcattttgccacaggcttttcttccctagctatacatgtatacagcaccatgaagctttacactgtttttcataagagttacggttatttaaatggcaaataaaccaaagacaaagacttggtttttattaaattacagcatcctaaaatttaaacaaaataatccaaatgctgaattcctccctgaaaaactgacataaattgcaataaaacatgctcgcaaaactgaagcatcctactttattttcacaaataaaaggtgattctgaaaattgacttcacttctaaagtaggaaagcaaaactaaagaataaatactgtaatggaatgtaaaagaatatgtttaatagagaggttttataaaagcattgcctaagcataagaaaactagaaaatggtattttaaagactattaacatacatctctttcaagaaaacactaatctaataccacataaaaggagaggtagcatatatacacctacttagattaaaccccagccaccaatatacactctgaggtctttataacccctccttgcaaaaaaggagggtgtttgattagtgagtttaccaaattcacattaactgggagtggaaacctgccaacgggacttgcagggttgaaggatagaagaaactcactcatgtcatgtccctctatccaaatttaataagataaacaaaaactagcaaataaaaattaaaacaaaaactcaccaacaaatagcaaacaaagaaaaagccacaagccaaggccattacctcagaaaataatgggtgaggaaaaacaaagaagattccagagcagagcagggcggcctgtgtaagggtgtaaggaggctccatcacgcgcgcgcacacacacacacacacacccctcacaagttacacagcagagctgcaaaatcctgcaccctcacatcaataatggatctggaaagaggcgaacttagtagggtgggcctttttcccttttctggggagctgtggaagggatgctagggagaaaaaagcagttttctggcaaaagagaagcctctaggctacaggatgaattgagggaggatcagaagcaagtggggacgcctccagggatagaggtcacccccctccccccgcccttaggtgaacatttagcattacctctctcagaggtgagaatccagactaactcctgcacccacctcgactgagctctctggctcccagcctattcccaggaaacagaaaagtggatcaaacaccaaaaagcagagcctgagtggtcttttcttagtagaaacaagagttctcagattagaagagaaagacagtcaaggacgatggttatttctggatgatgggattagaggtcattctttttactttcttctctgtactgttccgagttgcttaaacattctttatcatacacttaaaatttttacttacaacaaaaacaattttaattgaaagaagaaacgcgactatacaaatttttaagaaccatgaacctgaggtaggaaaacaacaaactacataatgttcctgtcttcacaagataaatcccacctgtgtggccctttgatctttgagagaagagcaaagaaggaaaagaggagggaaacatcaagatttagaaaaaacaagatgcacaaaagaggaagctgatctgtgagatagggaggtccaggctctactggaacagctggagagatagaatctttcttccagtcctagattttccctcccatttccagcctatactcctacaaattgattcttccatcatccaatcaccaccaaaccctgacactcagtctcagtcagctctagctagggaagcaattgcagggggctgatgtgagaattgcattactttagtgcatgtgtgtccatgcatacacttatgtgtgcgcatgcatgtgtacagtagagctgctgaagcaaaagacttattccaaacatgaacgatgatatctgaaagaaaatataccttctttacttgaatgcactttttctaccaaaaaaactattaaataactaatttctataagacatgaataaagacaactataatgacaaacaagattcaaagggtaccctagaacttaaagtataataaaaatatatgtataaaaaaagatttaaagggtgcatcagcagaaacacacactattctgtcactgtttaccctatttcagtggatttaaggatcactgattatacgatgtacccttattttatgtgctactatgagagaaaaaaaattatcaggtaaattataactcagtacttcctcatcacatcaactgcaagacacatgctgatcacagggatgttagagtgaacacaatggaatattactcattgctcacacacctgtcaagatgtgtgatccttgatgggtcctttaactcttctggttatacaatgttgaactatatagcatttgtaagatcctcttatgttctgaaaattctgtgcttccaggtctgtggttttctcccagaactaagatattttggagccctggggccttccaggccacaaagaacaggagctacaggtgggatctgtggtttggaaagactaagaggctccaagcctttggggcagccccttcctcagctctaacaagaaggcaccagtgaaaagacagctttcctccctcagccaccgcctctctctcacccatacctccgttcagggctttttcccacttattcctatttcttggttcctcttttcccaggccagaagagaaagcagcagaaaggaagatcccaggcctttttcttccatctaatcaagacttcaggatggctttcttgcagtcagggaatggttgcctgggtaaccaagtattaactataaggatctccccttctctctttttgctagactaaccattctggtttctccctcctgtctgagtagggagttaatagtaaaaggatttatttaactaggctctggattttataacccttgctggcttccaacagcgaactccaaactgccttttactggaggcttgtcttaaatgaaccagaactactttttctcatctattattttaaacctaattggaacacagcaaagcgaaacaagtttgaaaggcagtcagagtagcttccctatgccatgatttatcaatgtctgaggctagcatattaaaatatagctcttgttttgtaccatcaagattggatgaaaataagaatgcctttagaagggaaagggctttcttaaccaaaatatctaactctactccttatcactgttcacagagtagattattgtatttagttatgtggatgatgggtggggcccaaagaaatagatccggggtctggggtacagtgtggtaaatgcaagcctgaaaagatatcttcagaagaaggtgtgtaacagagggataggggttgtagtaggctgttcttgtattgctataaagagatatctgagactgggtaatttacaaagaaaagaggtttaattggctctcagttctgcaggctgtacagggagcatagacctggcatctgtttctggtgaggcctcaggaagcttatcaggcaggggccataacagcctgcccttctctctggcttcttgttgagtttaatcagtgcaaaggacttgccagggatgagaaagtaggaaagacaaattgagttacgtataacaccctctttccctgctgggttggcagtgactgtttctctgctgaaggccacagctcctgcctggcagaactctcctacaaatacaacctccatgggtttcagcagcttcttcaagcctaggtggtagggggttccccctgtaactagggcatgggtgcttcaccatcccatgttgaattcccttaattccttttataaataaatccttccataaccactttcttcagaattatttatccatgtataagaatgatactgtgattattttttcaagtgggctttaccttttagagatacatcctgaagtatttagggacaaagtgatatttaaatgaagcgtgtttggtcatgatttgataaccgtcaaagctaagagatcatgatttggtaatcatcaaagtaaaagcgttcagggtctttataattttccctctacttttgcacatgtttaaaatttttccatcataaagaaattttttaatgataaaaaaaatgtttaagcacccctttgggagatgctgtttcccatagggacctggactgacacaggagcagaggaggaatgagcagagaatatcagcaagatgaatgatatagtttggataattgtccctacccaaacctcatgttgaattgtaatccccaatgttggaagtgaggcctggcaggaggtgattagatctggaactgaatttctcatgaacggtttagcaccatccccttggcactgtcctcaggatagtgagtgagttcttgtgagatccgatcatttaaaggggtatagtaactcccccctcactctcttgctcctgctctggccatgcgatgtgcctgctccccctttgccttccacaatgtttgtaagtttcctgaagcctccccagaagctgagcagatgccagcatcatgcttcttgtacagcctgcagaaccatgagccaattaaacctcttttctttataaattacccagagtcaggtatctctttatagcagtgcaagaacgactaatacaataacaatggcctacttcataattttgcctggagttagccctaaaagtaaaggctgcaagtgatgtgtttgtggtcctttctgaactgggactagacagtaaaatctcaataattcactgtaattaggaaaacaattcaatctgactcagcaaagatctgtattataaactatttcttaaattcttttgaaacttgaacaatgtattcattcagtttggactggccttcacacacacagactttggagagttccaatcttatttctcagcacaccttgttggaaatctttataaaaacctctttcatagccatcgtaggcagcttttcctcacactatcatagagtacctggccctctctccacttcaaaacactcatctcaaaatttagcttgtttcacctctcctttaaagtctgtcttaaccatattggcccaaaaggaactcttcttagaaattattatctcacctccaccaatccctaggtgaccttgggcaagttacttaacctctcagacctcagttttatcatctgcaaaatgggactaataacagtacttatttattagaatttatatcagtattgaatgagtctgagattggctaatactaggcattcagtcaacgttaggtactatattaccatttattcagcaaatattccactatatacctggttttttctaagtcctgaggatgtaacggtgaaaaacataaagcccctgccctcatggagcttcctttctagcaggagaggcagataataaacatgtaaacagatatatatatatatatatatatatatatatatatatatatatatatatatattcaggtttcaactagtgctaaatgctatggcaaaactaaaatgagtaaaaatgatggaaaatatgatttttggtacagtggactgggatgccctttctaaaagggtgacattttgatgataaaacacatattgaaattagtttttaagctcattttactgcctaaaaagccctcttaaatatatatcaaaagctttcaaatatttgggaatgatatattttccaactcagtagccatgataatccagaatcccaacctgggttggcagactcatcggtggacaagttcacatcgtaaaccttcagcatgcattccaaacctgccttttcctttcattttaaatgttatcttcctcatgttgtcttcctaatactgacctaatttttcaaacatggtgctttgtcaccgcaacttcttcacactgttgacagagtcttctcttgctgccttttcacaaaggtggccttttactttcttcacctttgtttcctaagaaattgcccacagcctgccttacacctttaaactggtttcatgccactgttcagctgttttccttttatatcagagtcactgtcactgaattattccacctctttactccctcttctttattctctttgctgccatatatagccaaagtgaaaggagatcccaaaagaagctgctaactttggggaggtgtgtttttggtactggtaggagtgggggaatcagagaaatctgggcatgggagagttgaagcaacatgatccaagagctctgacatcagttttctgacaatttcaaaatctgtgaataaaataaggatgtgtgttataaagtatcaggagaatcaggaagataaataggatgctttttcgcaagggaaaagaatttctactaatgaaaatcatcaccaatgactcctttgtaattgggttaatggaatgattttaaaacacacacccacctctagctatataaaataatacaggatactttaatcctgagatcctggacttttcccactgtgaagcaataaatataaataaatatcttggcttaacattcctctttacctcctgcttcttctctctggtgattttttttccttcttctttatgcacaaggccccagatcactcaagattagaaaacataaaaggctcagaaattaaattcttaagattaaggaattcacttaagccacataaatttagagcctttctttgccagccaggaactcagcaactcagattaataaacctcgtttctgaagttgtgataaatgaaggccatacaaaatcagccaggttttcagcttgttgcagggtccacatgagtgctgggatggagccatcaaccaaagattggctcatgcacaaaacattccaggagccaggaaaggcggcgatgggactgaacacaaagctctttagtatgtgcaacaattaatgttttaaatattaaaacaaattaatatgagagagaatgttgctttcttataacaaaaactcaatctcatctcacaagttaaaatattacagagaagaaaagatacctgaaaatgctagctttttgcactctcacatccttatggagtcctcttatgaaaatatcctggattgttctagtttaaatttttttaaaggatctgaatatttgttcttaaataacttgtttaaactagtattggtcaccttcaagtgccctctggtgtaacttattttaatcttccagacaatactttaccctgatcaaaggaaaggattctttttttgctccttttgtgtttggattaaaaattatgatctgcaagcatgagttgaattaaattgaaagtttcttcactaagagtaggaaatcactaactctaaaacatccttttaaaatctgggcatagaaggtttagagtctggcttcccagtgtggctgaaggtggaaagtgggggcaatctgcaggcaaaaaggaggcaccctgtctgtagagaatttacaaacataacaaacactttatacaagtaataaagttttaataatgaaactgaccaaaaaccagtctgctccttatcatcatgtacatgccaacaattctaactaatataagtgataaaatgctgttccctccccaccaaaattttgttgtataagttctaacaattgttgtggttactgttgggttttaataatatatatgcaaactttaaattagcacgtttttactgctcatccttttatacaggcatacgttttattgcactttacagatattccatttttcacaaatttaaggtctgtggcaacctttcatcaaacaagtctatcgctgtcatttttccagcagcatgtactcacttgtgtctctgtgtcgcattttgatcatccttgcaatgtttcaaactttttcattattattatatcctttatcgggatctgtgatcagtgacttttgatggaattattataattgttttggggtaccacgaactgtgcccatataaaatggcaaatttaatcaataagttttgtgtgtgtcatcactgctccactgatcagccattcctccatctccctccttcttctcagacctttccttcctattccctcagacacaagattaaaattaggccaattagtaaccatacaatggcttctaagtgttcaagtgaaaggaagcctctcactataaatcaaaacctagacttcatgaaagacctaaaaccatgaaaaccctagaagaaaacctaggcaacaccatttaggacataggcatgggcaaagacttcatgactaaaacacaaaagcaatggcaacaaaagccaaaattgacaaatgggatctaatgaaactaaagagcttctgcacagcaaaagaaactatcatcagagtgaaaaggcaacctacagaatggcagaaaatttttgcaatctatccatctgacaaatggctaatatccagaatctacaaagaacttaaataaatttacaagaaaaaaacagccccatcaaaaagtgggcaaaggatatgaacagacacttctcaaaagaagacatttatgcagaaaacaaacatattttaaaaagctcttcatcactggtcattagagaaatgcaaatcaaaaccacaatgagataccatctcacgctaggtagaatggtgatcactaaaaagtcaggaaacacatcctagagaggatgtggagaaatacgaatgcttttacactgttggtgggagtgtaaattagttcaacattgtggaagtcagtgtggtcattccttaaggatctagaagtagaaataccatttgacccagcaatcccattactgggtatatactcaaaggattataaatctttctactataaagacacattcacatgcacacatatgtttattgcagcactgttcacaatagcaaagacttggaaccaacccaaatgcccatcaatgatagactggataaagaaaatgtgacacatatacaccatggaatactatagagccataaaaaagtgtgagatcatgtcttttgcagggacatggatgaagctggagaccatcattctcagcaaactaacacaacagaaaaccaaacactgcatgttctcacacataagtgggagttgaaccatgagaacacatggacacaggaaggggaacatcacacacgggggcctgtcgggtgggggctgaggggccaggggagggatagcattaggagaaatacctaatgtagatgacgggttgatgggcgcagcaaaccaccatggcacatgtatacctatgtaacaaacctgcacgttctgcacatgtactgcagaaactataaaaaaaaaaaaaacctctaacttttaataaaatgttttatttatttctatgtggaataaaaatcaaaaataagccaggaaaaaaaaaagctagaaatgaggaagcttaatgaggaaggcaaataaaaagctgagactggccgaaagctaggcctcttgcactaaacagccaagtcgtgaatatgaagaaaaaattcttaaggaaataaaagtgctacccagtgaatatatgaatgataagaaagtgaaacagcattattgctgatatggagaaggttagagtggactggacagaagatcaaaccagccaacacattcccttaagccaaagcctaatctacagcaagatcttaactctcttcaattctatgatggctgagaaaggtgaggagccagcagaactaaagtttgaagcagaggctggttgatgaggtttaaggaaagaaactatctccaaaacataaaagtgcaaggggaagcagcaagggctgatgtagaagctgcagcaagttatccagaagatccaactaagatcattgatgaaggcagctacactaaacagattttcagtgtagctgaaacagccttctattggaagaagattccatccaggattaactagagaggaaagctcaatgcttggcttcaaagtttcaaaaggcaagctgattctcttattaagggctaatgtggctggtaactttaagttgaagccaatgctcattgactgttttgaaaatcctagggcccttaagaatgatgttaaatctacattgcctgtgctttataaatgcaataacaaagtctgaacaacagaacatctgtttacagcatgatttactgaaaattttaagcccactgttgagacctactgctcaggaaaacagattcctttcaaaatattattgttcgtagacaatgtaactggtcacccaggagctctgaaggagatatacaaggagataactgtgattttcatgcctgctaacacaatatccattctgtagcccatggatcaaggaataatttcaattttcaagtcttattgttaagaaatatattttgtaaggctatacctaccatagatagtgacttctctaatgaatctgggcaaaatatgtagaaaaccttctggaaaagatttaccattctagatgacattaaaaacatttgtgattcatggaacagacagttctcaaaagaagatatacaaacggccaacaaacatgaaaaaatgccccacccacatcactaatgatcagggaaatgcaaatcaaaaccataatgtgacaccaacttactcctgcaagaatcgccatactcaaaaaatgaaaaaataatagatgttggcatggatgtggtgaaaagggaacacttttacactgctggtggaaatgtaaactactaaaaccactatggaaaataatgtggaaattccttaaagaactaaatgtagagctaccatttgatccagcaatcccactactgagtacctacccacaggaaaagaagtcattacataaaaaagatgctttcacatgcatgtatacagcagcacaatttgcagttgcaaaaacatggaaccagcccaaatccccatcaatcaatgagtgcataaattgtgatacacacacacataccatggaataccactcagccataaacatgaagaaaataatggcatttggaccaacctgaatgggactggagaccagtagtctaagtgaagttaagtcaggaatggaaaaccaaacattgtatgttctcacttataagtgggagctaagctatgagaacgcaaaggcataagaatgatacaacggactttggggactcaggggaaagggtgggagaagggtgagggataaaaaccacccactgggtacagtgtacactgctcgggtgatgggtgcaccaaaatttcagaaatcaccactaaagaacttattcatgtaaccaaacaccatctattcccccaaaaacatattgaaataaaaaaaatgaattaaaaaaaccattcgtgactcaggagatcaaaatatcaacattaacaggagtttggaagaagttgattccaaccttcatggacaacttggagaggttcaaaactttggtggagtactgcagatgtgatgcaaatagcaagagaactagaattagaggtagagccttaagtatgactgaattgctgcaatctcatgataaaacttgaacagatgagaagtcgcttcttatggatgagcaaagaaagtggtttcttgagatagaatctattcctggtgaaaatactgtgatcattattgaaatgacaacaaaggatttagaaaatgacataaacttaatttataaagcagcagcagggtttgagaggatggactctaatttttgaaggaagttctaacgtggataaaatgttgtcaaacagcaaagcatgctacagagaaatattttatgaaagagttaattgatggggcaaacgtcattgttgccttattttaagaaattgccacagccatcccaaccttaagcaaccacgaccctgattagtcagtagccatcaacatcaagtcaagactcactgaagccttagatgatcattagcattttttagcaataaatttttaattaaggtatgtacattactttttagacataatgccattgcacatttaatagactataatatagtgtaaacataacttttatataaactggaaacaaaaaattttgtgtaattcactttattgcaatattcactgcattgtgatcatctggaaccaaacccacaacatccccaaggtatgcctgtatatattataatctacaagtaagctaattcagagaaatcccagttatacagctgactccagacacatgcagtcttggacacacacatatgtgttccataagcaagtttgtgaaggtttgggaatcattccagctcacttcgaaaaaacttatgatactccatattctgacatttaaacagaagattcaaaataaataattataggatattacttgcaaaaaaaaaagaaacaagtaaattcatcattccacatgattaatggaatttttgtttttaaaaatgtaaagtgacgaaatgaagtacagaatgtgagatgtagtatttttattggtaagtgtaaactttatacatgattttgctaaactttaataatatctttaaaattgatatttcttttgttattcttgtgattatttaataaactttaatattatttattactgtcataaaccaataattggttctttccctttgtgcaaaaatttatactaatgtaattaaaattaccaatccattacttttttccttttatgtacataacattttttatgtttctttactttttaaaagcataattatatatatgaagtccagtaaaaaatttccacaatttggctgggtgtggtggctcacacttgtaatcccaggcctttgggaggccgaggcaggtggatcatttgaggtcaggagttcaagaccagcctgaccaacatgatgaaaccccatctgtactaaaaatacaaaaaaaattagccaggtgtggtggcacatggctgtagtcccagctactcaggaggctgaggcaggagaatcacctgagcccaggaggtggaggttgcagtgagccgagatcatgccattagcactccaggctgggtgacagtgcgagactccgtctcaaaaaaaaaaaaaaatccacaatttgtatttcctttatggccattattatgcatattatatattattcatataaaataatttttaagataattttgtcacctaaaggaaggaggattaaaacgttatgtgctctgagtgcaaacatgctttgtaccaacatgctttctggagttttctcagattctttgactttcttactttttgtctcatacaagcttgcatcaaaattgtgagctggcttaagatggtggattataggaaaactagaagaaaacacttcctagaaaggaatagaagacaagtaactaacatgcatttattcgcccctttattcattcaacaaataactattaaccatctaccaccataccaagcactggtctaggcaccaggaatattatttcatgccgtctggaaggttgccttttaatagaaaaacacagacaaataacaaacataatgaacaagtaaattatgtaatatgttagaatgcagtaagagctatagaaaaaaataatgaattcagcatgataaacgagtgccaggacattggagttttaatagggtagctattggttattgggaaggtatcttttgatcaaagacttgaataagttgagaattagccatgtggacatctagggaaagtgtattctgggcagagaaaaccaaccagagcaaaggtcatggggaaggggcatgcctggatcgttccaggaaaagcaagaaggacacgaagcagagagtgaaagggaaagaaaggagtagtagatgaaattagagaggtcaggaggatcagattgtacagagctttcttaaacctttaaaacgactttgtcttttactctgggtgaaacagggaaccactgcagggctttaagcagaggaatgacatgatacaactcatgatgtttaaaacagtggccttagtataagtgggttgactaccttaaaagccctccaatcttcctggagcgatatggggtggcccacctaagacatctgtccccattcatcaccaagattgatccgtctgatctgactgactaggagtaccattcttccctgccttcttgccttgcatcgtcctaaaggcgcacacctggtcaaccctttcagatttaggagaggcattcttcaggtaagggtctagaggtgctacctgatgctaaaactttgaccatttgagattatttttcacctactatcttcaagactcttctgtaaaactataaattgctcttgaattcttaacctatgaaaactgactttttgatataaattaaattagcccttaaccgacaattaagcagataactgacaggtgggaatgaacaccagaaacattcacagcaacacacacacgcacccctagacctcaatatttagatattcatcatacatacattttctatccacaattgactacaatgctaatagttctcaaacgtacacaagatgtacgtaatgtcctgtccatttgtttccctctttcactgtcataactgaacagggattattggaggatatagtgaaaagaagggcaaactcagatgttgtgcatggcagccatgctaggaagtaggaaaagtagaggcaagaagacccctggagaaagatttgtctgcctaaagtttgaaccaaagccagcttctacctcaggccaacccattctctgaacagaaggaaaggatgcttcctgaggtactgacctggcctatgaactttaccctcaggagagctgaccaaaggatgtctcctggtagcctaattggtcctcttggtcctcaaattctcttttttaaaaactattacattcattctacctatgcgttttttcaataaattgtattaatatttcttagtcacaatagaaggcttttaacttctcaattatttttcagtctcttccaagggtagtactatcagaagcaagatgaaaagcatcaaggtgggtaccaatttttacccacacttagcaccaaaagttgaatttgaagctaggattgggcaaatacaagaatgactatttcctaaccatgtataaaaagctgtttcaaagttttctctgatgttcataaacatcaagtatcttaccagtaatcacagttctaagctggtaattttccagtacgtaggcttccatacttctgaagcctacatgtgaatgcttatattacaggtgcttctttcccttaaggtagtcacttatgggaacagcttatggacaaacagggagcttttgtgttgagtgtaatagatcagcctctctttcataaatgacagcttctacccagattagttttataaggagatggcaactccctatttgatataattttacatgcactagaaagttttccttgactccatcactcatgaagcttacccacctaatgaaaaaaatgtctaatgataaaattagacagcatgcaagaacagatgactaatgtaaccaaaactatgaaaagtcttagaatctaaaggagatgctagagatcaaacactaacagaactgaatatgccttttatggactcctcagtagactgaacatggctataaaaagaatcagtgagcttgaagatatgtcaatataaacttcaagaactaaaatgcaaaaagaaaaaactatagtggaaaaaacagaagaatatattaaagaactgtgggacaatttcaaaaagtgtaacatacataatttgaataccagaaaaagaagaaaaagtggagcagaagaaatacttgaaagtaatgacaaacacaaaaccacagatccatgaggttcagagaaaagcaggataaacacttaaactacttgtaggcatagcatatgcaaactgcagaaaaccaactacaaagagaaaaccttagaagaagccagaaggaacaaacactttacctatagaaaaacaagtttaagaattacagcagacttctcatcagtaccatgcaagcaagaagagaatgaaatgaaatatttaaagtgttgaaagtcaaaaatcaccaacctggaaattctatatctagcaaaattgttcttcaaaagtaaaagagaaggacttccttcatgcaaaaaataataataactaccctgagggaattcattaccagaagacctgtaatgcagaaattttttaaaaaacattatttaaggggaatgaaaatgatataggtcagaaactcaaatctatgtaaaggaaaatcaatacagaaggaataaatggagatacaatcatctgataactgtttacttaaaataataatagtaacaatgtattggttgattatagaatatgaataagtgaaatgaatgacagcaatgtcataacagataggagggagaaatgagggatactgttatgagtaagaacctgaagtgcagatgcaatggtagagtgttattagaagctggatatagacaagttaaaaatttatattgcaaactctagaccactattaaaaaaatttttaagaaatgtaattgctaggaaaggagataaaataaaatcacatgaagtgctcaattaaaaacagacaaggcaggaaaatactggaacaaaaaaagaaacaaatgcaattattataaaacagatatgaacatggtagatatttatacaactataccaataatcactttaaatgttaattgtttaaaaacacaaggtaaacaaaaaggttgtcagagtagattgaaaaaacaaggtccaaatatatgttgcctaccagaaactaaatattaaaaactcaagtgggatcatcatggcagacaggaggcaggactagattacagctccagagacagcaacgtacagaagctcacactgtgaattttagctccagaacgactgcaattacaaaccaaaaatcccaagaggacccacagaccctctgaaggaagtggactgctcctgcaggacctgggagacaccccaaatactgtgagtgccctaactgcagaaatgggaaaaggagactctcctctcacagggctccatgcagacaacccccagtaccagtccagaccctcaatggagaagctgaaggtctgtttgtgggagaagtttccaactttacctggagctgagtcaatttagagaaccaagtgaaatacaggggagaggaagcagcagaaaggccttgggagcttgctgtgtaccctagcagcccattcctgcctggcaccacagggatccattgggagggtgaccagaggagcaggggataaactccacaggaggaagaaaatctctagctgaactttgtaacaatttgaagggtgggaagcctcctgctcagaagtcacgggagggtgcaaatctggtgtgcagactccacaggcaggggaaaaaccaagcccttttctttcgcagctgggaggtgggtagcccagtgcaagttttctagcctgtcacaccctccgccaggaaacagactcggggctactgggggtgggggcacagtgggagtgagaccttcagtttatgtgggatctggatgaggtctgtgactgctggctttcccccatttccctgacaacctgcatgactcaggagaggcagccataatcctcctaggtacacaactccagtgacctggaaatctcaaccccatcctccacatcagctgcagcaagacctgcccaaagtgagtctgagctcagacatgtctagccctgcctgcacttgatggtccttccctatccaccctggaaacagaagacaaagggcatataatcttgggagttctagggcactgcccactgccaggccctctccatactactacagctgatgctttctggaaagtgtcacctcctggcaggaggccaaccagcacaaaaatagagcattaaaccaccaaagctaagaaccctcacagaatccattgaacacccctgccacctccacctgaacaagcactggtatccatggctgagagacccatagatggttcacatcacagggctctgtgcagacaacccccagtaccagtccagagctgggcagtctcacggggtggctagactcagaagagagacaacaatcactgcagtttggctctcaggaagccacatccacaggaaaatagggagggtactacaccaagggaacacctgtgggacaaaagaatctgaacaacagcattcagccctagatcttccctctgacagaggccacccaaatgagaaggaaccagaaaaccaaccctggtaatatgacaatacaacgctcttcaacacccacaaaaaaatcacactagttcaccagcaatggatccaaaccaagaataaatccctgatttacctgaaaaagaactcaggagtttagttattaatctaatcagggaaggaccagagaaaggtgaagcccaatgccaggaaatccaaaaaataatgcaagaactgaagggaaaattattcaaggaagtagatagcttaaagaaaaagcaatcaaaaattcaggaaactttagacacacttttagaaatgtggaatgctctggaaagtctcagcaatataattgagcaagtagaagaaagaaactcagagctcaaagacaaggtcttcaaattaacccaatccaaaaaagacaaagaaaaagaataagaaaatatgaataaagcctccaagaagtctgggattatgttaaacaaccaaacctaagaataattggtgttcctgaggaagaatagaattctaaaaccttggaaaacatatttgggggaataatcgaggaaaatttccttggccttgctagagacctacacatccacacacaagaagtacatagaacacctggaaaattcatcacaaaaagatctttgcctaggcacattgtcatgaggttatccaaagttaagaggaaggaaagaaacttaagagctgtgagacagaagcaccaggtaacctgtaaagaaaaacctatcagattaacagcagatttctctggagaaaccctacaagctagaagggattcagtctcctcaaacaaaacaattatcagccaagaattttgtatccagcaaaactaagcatcatatacgaaggaaagatactgttgttttcagacaaacaaatgctgagagaattcacctattaccaagccaccactacaagaactgctaaagggagctctaaatcttgaaacaaatcctggaaacacatcaaaacagaaactctttaaagcataaatcacacaggacctataaaacaaaaatacatgttaagaagcaaaacaaaaagcaaaaaaatcaaagcatacaggcaataaagagcaagatgaatgcaacagtacctcacatatcaatactacattgaatgtaaatggcctaaatgttccacttaaaagatacagaaccacggaatggataagaactcaccaatcatctgctgccttcaggagactcacctaccacatacagactcacataaacttaaaagggtagaaaaaggcatttcatgcaaatggacaccaaaagcgagcaggatagctactcttatatcagacaaaacaaactttaaagcaacagcagctaaaagagacaaagagggacatcacataatggtaaaaggccttgtcccacagaaaaatatcacaatcctaaacatatatgcacctaacactggagctcccaaatatataaaacaattactaatagacctaagaaatgagatagcaacacaataatagtggagacttcaatactccactgacagcactagacaggttatcaagacagaaagacaacaaagaaacaatggatttaaactataccttggaacaaatagacctaacagatatatagagaacgtttcatccaacaaccgcaaaatacacgttctatttaatagcacatggaactttctccaagatagaccatatgacaggccataaaatgagcctcaataagtttaagaaagttgaaattatatcaagcactctctcagaacacagtggaataaaactggaaatcaactccaaaaggaaccttcagaaccatgcaaatgcatggaaattaaataacctgttcctgaatgagcattgggtcaaaaacaaaatcaagatggaaattaaaaaattattcaaactgaatgacaataatgatacaacctatcaaaacctctgggataaagcaaaggcggtgctaagaggaaagttcataaccctaagcacctatatcaaaaagattgaaagagcacaaactgatattctaaggtcacacctcaaggagcaagagaaacaagcgcaaaccaaacccaaacccagcagaagaaaggaagttatcatgaaagatcagagcagaactaaatgaaattgaaacaaacaaacaaaaaagataaatgaaacaaaaagctggttatttaaaaagataaataaaattgatagaccatcagcaagattaaccaagaaaagaagagagaaaatccaaataacctcactaagaaacaagacaggagatattacaactgacaccactgaaatacaaaagatcattcaaggctactatgacgcatttacgcacatagctagaaaacctagaagagatggataaattattgtaaagatacaacccttctagcttaaatcagtaagaattagataccctgaacagaccaataacaagcagtgagattgaaatggtaatttttaaattaccaacacaaaaagtccgggaccagacggattcacagcagaattctaccagacatccaaaaaagaattgttaccaatccttttgacactattccacaagacagagaaagaaggactcctccttaattcatcttctgaagccagcatcaccctaataccaaaatcagaaaaggacctaaccaaaaaagaaaactacagaccgatatccttgaagaacattgatgctaaaatccttaacaaaatactagctaaccgaatccaacaacataccaaaaagataacccaccatgatcaagtgagtttcataccagggatgcagggatggtttaacatatgcaagtcaataaacacaccacataaacagaattaaaaacaaaaatcacatgttcatctcaatagatgcagaaaaagcattcgacaaaatccagcattgctttatgattaaaactctcagcaaaattagcatacaagggacataccttaatgtaataaaagccatctatgacaaaaccatagccaacataatactaaatggggaaaagttgaaagcattcactctaagaactggaacaagacaaggatgcccactcttaccactcctcttcaacatagtactggaagtcctagtcagagcaattagacaagaaaaagaaataaatggcatccaaatcagtaaagagaaagtcaaactgtcactgtttgctgatgatatgatcatttaccttgaaaaccctaagaactccttcagaaatctcctagaactgataaaagaattcagcaaagtttccacatacaagattaatgtatgaaaatcagtagctcttctatacaccaacagcaagcaagcagagaatcaaatcaagaacccaaccccttttacaatagctgcaaaaaagaaataaaatacttaggaatacacctaaccaaggggtcaaaagacctctacaaggaaaactacaaaacactgttgaaagaaatcatagatgacacaaacaaatggaaacacatccatgctcatgggatgggtagaatcaataatgtgaaaatgaccatactgccaaaagcaatctatacattcaacacattccccatcaaaataccaccatcattcttcacagaattagaaaaacattctaaaattcatatggaaccaaaaaaagagcccaaatagccaaagcaagactaagcaaaaagaatacatctggaggcatcacactacctgatttcaaactatactataaggccatagtcacccaaacagcatggtactggtataaaaataggcacatagaccagtgaaacaggatagagaacccagaaagaaacccaaatacttacagccaactgatcttcaacaaagtaaacaaaaacatcaagtgggaaaggacacccttttcaacaaatgatgctggataattggctagccacatggaggagaatgaaactggatcctcatctctcacgttatacaaaaatcaactcaagacggattaaggactgaaacctaaaacctgaaactataaaaattctagatgataacattggaaaaacccttctagacattggcttaggcaaggatttcatgaccaagaacccaaaagcaaatgcaataaaaacaaagataaatagctaggacctaattaaactaaagagcttttgcatggcaaaagaaactgtcagcagagtaaacagacaacccacaaagggggagaaaatcttcacaatctatacatctgacaaaggactaatatccaaaatctacaatgaactcaaacaaatcaataagaaaaaaacaaacaatcccatcaaaaagtgggctaaggacataaatagacaattctcaaaaaaagatatacaaatggccaacaaacacattaaaaaatgctcaacatcactaatgatcaggaaaatgcaaaccaaaaccacaatgtgatatcatcttacttctgcaggaatggccataatcaaaaaatcaaaaacagtagatgtcagcatggatgcagtgaacagggaacacttctacactgctagtgggaatataaattagtatagccgccatggaaaatagtgtggagattccttaaagaatttaaagtagaactactatttgacccagcaatcccactactgggtatctagccagaagaaaggaagccattattcgaaaaagatacttgcacatgcatgtttataatggcacaatccacaatagcgaaattgtggaaccaacccaaatacccacaaatcaatgagtagataaagaaagtgtggtgtgtgtgtgtgtgtgtgtgtgtgtgtgtgtgtgtgtgtgtgtgtgtgtatagacagatatatgatggaatactatgcagccataaaaatggataaattaacagcacttgcagtcacttagatgagattggagacgattattctaaatgaagtaactcaagaatggaaaaccaaacaccatatgttctaactaatatgtcagagctaagctatgaggacaaaaaggcataagaatgatacaatggactttggggacttggggggaagagtgggagggggactagggataaaagtctacaaatatagtgcagtgtatactgctcgggtgatggatgaaccaaaatctcacaaatcaccactaaagaacttactcatgtaaccaaataccacctgtactccaataacttatggaaaaattaaaataaataaataaaagctcaaatatgttaaaagtaaagggatagagcacatatcattctaatgctgaccaaaaggaagctggaataactatattaattttagacaaattaaacttcaggaaaaatacttaaataaaggcattgcagaaggtagacaagtatccacaaagacataataatccttaacatgtatgcacatcttctaaagctcacatggaatactaaccaagatagaacattatggatcaaaaaacacattaacaaatttaaaagaatagaaatcatactaagtatgttttcagatcacaacagaactaaactatagatcaaaatcagaaagacaactggaaaatagaaaaaaatgaagattaaacaacacacttctaaataacacatggaatcaaagcggaagtctcaagagaaactgaaaatattctgaacaaaaatgaaaacatagcaccaaaatttgtggtattcagtaaagtagatctaaaggaaaattatggcactaaatgcatatgttagaaaagaagaaagacataaaatcaatagtctaaactttctctaaaaaaaaactagagaaaaagaacaatttggaagcctgtaacaaaaagaaacacaataaaagtcagaatataaatcaataaaattttaaacagcaaacaatagacaaaaatcaatgaaatcaaaagcagctctttgaaaagctcaataaaatttataaacctctagttaggctaaccaagaaaaagagaagacacaaattactaatatcagaaatgaaagaaagatcatcactactgatcacatggacattaaaaggataataaagaaatagtacaaacaactctctgcccacaaattagataaagtgaaccaattcttcaaagacacaactaccaaaagtcacaaaaggaaaagtagataatctgaagaggaccatatctaccaatgaaattgaatcaataattaacaaccatcaaaacaaaagcaccaggctcaaatggcttcactggtgaattctaccaaaaatttaaggaaaaaatgatacaatttccactatctcttacaggaaatagaaataattcctaactcattctatgagtccagaattaccctaacaccaggagcaaataagaatattacaagaaaggaaaactatagatcaatatctatcatgaagataaatgtaaaaatcctcaacatattagcaaatcaaatacaacaatatataaaaataattatacatcatgaccaagtgagatttattctagctaggcaaggctgttttaatatttaaaaaccaatgaatgtaattcaccacattaacaggctaagggaaaaaaaagcaatattacattacttggtacagaaaaggcatttgacaaaatcctatatccgtgtataataaaaattatcagcaaactaggaatgcagggaaagttcttcaacttgataaagaacagctacaaaacacttccttacttaatagtgagaaaccagtaactctctaagatcatgaacaaggcaaggatgtcccctctcaacagtcctagttaacatcatactggaagtcctaattaaatacataagacaagaaaaggaaataaaaggtatacagattggggaggacaaaattaaattgtctttattcacaattttctctgtgcaaaatcccaaaggataggggaaaagttcctggaattaatgagtgagtatagcaaggtcactatagaagaatagaaggttaatatacaaaagtcaattgctcttctatataccaaaaatgaccaatttgtatttgaaatgagagaaaatacatttgcaatggcaccccaaaaatgaaatacttaggtataaagtctcagaaaatatgtataagatctataagaggaaaactacaaaactgataaacaaaatctaaataaatggagggatattccattttcaaggataggaagactcaatattgttaagatgtcagttcttcccaacttggtctataaattcaaagcaatccaaatcaaaatcccagcaagctattttataaattacctgattctaaagtttatccatttaagttttaaacctagaataatcaacagaatacagtaaagtaagcttgaacgacacataataggcaatttcaaaacttactataaaggcacaataatcaaggcaatgtcgtattagcaaaagaatagacatatattactagataaatggaacagaatactgagctcagaaatagacccaaacaaatataatcaactgctctttgacacagaagcaatggcaattcaatggaaaaagagagtattttcaacaaatgccatgggaatatttggatgtttatatgcaaaaataagaaaaataacttagacataggccttatacctttaacaaaaattaactccaaacagaccataaactaaaatataaaatgcaaaagtataaaatttctagaagaaaacataggagaaaatttaggtcaccttgagtttgacaacgaatttttagatacaacaccaaagcataatctacgaaaaaaaattggtaagttggattttatgaaaaagttcattccttacccaaatgaccacccatgtactgggctcagccaagttcatcagctcaggtgtcaatattgtttaagagaacttgttgcatttgggagattaagaaggaagagatccaggatccctggcaatgtagtatccaagaaataggtgatcccagcaagaatctatgtatacaatttggtgtgagtaatctttcacttggccacaaaaaattttacccacttaatcatctgaataaatttctatctctcatcctctttctcattaagtatgcattactatctatttcactagggtattttgtgacttaatagtgtgcactgatttgagccttaacaggggaaagagctaaacaaaattctttatgtatgtatttgtactatggagaatacagaatcatgataaatatgcaataacagtataaaacaaaaagagctttaggacagacagatgaaggaggtgatgtggagaacagagacacagacattgtataaaccacggctaaagagataactagggcagatatccaggcaagaaaaaccagttagatcagttgtaaatcaaatatatttaactattaatgtcttggtggggtgaggggaaaatgaccttatattttgattagacatggatacatatgaatgttcaaaccaagacttgtagcaggtattgctagatattatccattgcctcttcagataacactttctaccttgtgtccaatctgccccagcagtctggcctttatggtctacattaagggatcccttcactctggcgtcccaggaaggccaagtggcaggagagcagaaggcaggaagagagtgaagcaagagtatttatcttttgaactccctcccttctgtgctgtggtggatgatggctgggttccttccccaagttcctagcagatagcctctcccagctgccttctgctcttgcaccacccctcattagcttttcttgaccttgcccacatctttgaaactgttccttagtttatttctcttcatctgttacctacctaaactcttactgataaaagcataaaacgtgtacaaagagaatatgaaatgtattaatttgctgatgagagcttttcagttgtaatgcaagagatcttatgggaaaaatagtgtaaataggatgcacctgctctgtggagcctactctgaaccccagaagttggttatgccttctttgttctccttgccctttacacatagcacatcattattgtgggactgtggtggacatgaaagaacttagtcaaagggacctcatgtgggaagtgtttcatgaggtgagggatctgagaaataaaggaatccctaaagttctggcagttggagttatatgaactcagtcacctgaggttggcttccacagttgtgaacaaccaagagacagcaagtgctgcacaattcagtgaggcccctcttaccttcaatgcatccatctcctcagacagtgagagcaagatacacatctgtagatctcctactctagttgagaatacacaataagaacatagtgtttattaatgagcccagaactgccttcttcctagtggtattccctgacaaagacaagtacaagctgtttaaaagaacatcgtttaatatcaaaacatctaggttatgataaccccaacactacacaccctgagacattatatgtatatgtatatgctttttatccccagtgccaaaacaaaactattttgagagaggatttacttttttaaagaattctcatgtcaaagcaagcaggagtggttttttaacatctaaattgaaataagaactgcatgtctgtctgcatagtttaagtgagtctccaatccctgaagtcagaacattaaattcagggtttttcatacaaatagcaaacaggagttcacccagataatctccgaagctaccagctaagaggccataactggcactaactcctttgtcacatacgcgcatttggtgttctcagctctcctcttaatcactaactcctggctctttctctgcatgatttttgggcatgtccctccatcacggcctctgctgtgtcaggtctaccattatagaccttggagcccatggttcctgttctcacttccttgactcctttcatctttccacccaagaataatttttctccaatacaatatctttatatcatcttcctgttcaccaggttcaaatgactgaatgtactcagacctgttttctcatctgtaaaaatgatactacaatggggctgaaagaatcaaaggtctcttttatctctgatctcattattcctccaccgaactcatttgatctcatgtaacaatcttttttgtggttggccccttgctgtcagccactcttcacacattcatctaacaaaatttactgagtgcctgcaatggaagaacacaagtgctaggttctagaaataaaattaaaaattcctttctttgacatgcaatagcagttatcatttctgagcacttctacatggagtatttcaggagggctcattgtatcctcacaataaacttatgacagaagcattattgataactccactttatagatgagaaaactgaaacacaggttaatacatggcccaagtcatataactagtaagtgactgagccaaatgtcattggttctaaatgattatgcctctgaaataattacagtgaaaagttcttaaagacattaataaaatactgaacaggaagatcttagctttgctgcagtttctaggatgaagggctacttgagctccaagaagctttccacccctaccccatgccgatgccatgccccatctggagcactcatcacatagtctcagccaagtcatttccatctcaagcattgtgcaaaagacaaacactcaccttgaaaaaaaccatcttcaatgaatggactgccatctgtgctttattattttgtacataagattgttactttgtacatatactacatttgacataattttttttaacttgttctcatgccatgcttaatctccccaaccaatctatcaagaacacctccagccaagcctggtatagtgcttatcaaatagcaagcaaagcttgttaataaatcaagcaattcactttgtccagggagtcaaatccaaaccctccagacaagtttgatgacattcactaaccttgacctggcagagcctcccccatcaatccaccagggctgagttgacaacaattctcctccaatcagttctccacactcctatccctgtgacttttatcttgtattaaacgatcacataaacactgagcctccaaagcagtgaaaggaacttttattttctcatggtttccatctcccagcttcttctattgtatcgtaaatccaaaactgccataaaagttagaagcttcagaagtgtcttttataggaatttggattgtagtcaaacatctaccctcagtgttctctttccagtgtggcatttcctccctaccacctaatacaagtatacacagtatggtaggaagacctgcagacctaagcaggtttgagctatttttccatcactcatcattacaaatgtgtttgtgttttcactgtggggtattcttaaaccctgctgctggtgatgctttctgtaaacagtaattctcaagtgccttattgtgaatacaatgagtcatctccagtgcagagaagtggctttatttaggactggccagagggggatgggcatcattatattcagtttgatagaggatctgcagaattctctcattgccctgtacagcaggtccagtttctttttcgttctcctgatagaaggactgtacgcctaaatattcagcacatatccccaaattgatgttttacctaaattgtttcttaattggctcaaattaagtgcattttgcaaatcctccctcagtctagtctgtggcctaatgactgtctgacataggaagcactaaatgtttagttaatatttgctgaacaattaaaaaaaggaaaaaatagaaacaaaggaaaggaggtaaaactgataactgtgggtgaaaagaagtcaaggtcaaagcctgcatctctgtctggttcatgaacaactgagccttacagggttaaaactattctgtgacccccaggagccaatcagtcccctcaaatttatactgttaggagaaccttttgaaagaaagcaaccagcttacagcaactcatccccactgctggaaaaatacaagtcaacatattttgacctctgatggtagagccgcaaaactaatgtatcagatatctacttccataatagtactgcataacaaagagccacaaaaacctcagtagcattcagcaataagcatgtattgtttatgcctgggccagctgagggctggctagatggctctgctaatcttggccagacttgttcacgtctgcagtcagctggcagttagctgatatcagctggccttggctggggaaacagggattcctctgccctgttccacgtatctctcatcctctagagcaggctatgcagacatgttgtcatggtgatggaagagaagcttgccactagaaatacacaagggctcttgaggtctaagctcagagctggtataccctcatctctacctcattctagtagccaaagcaagccacacagcagagcccaggaacagagaattgttaatatgtcctgcctttggagttcgagaccagcctgaccaacatggtgaaaccccatctctactaaaaatacaaaagttagccaggtgtggtggcacacacctgtagtcccagctactcaggatgctgagacaggagaattgcttgaaccctggaggcagaggttgcagtgagccgggatcgtgccattgcactccagcctgggcgacagagcgagactcggtcttaaaaaaaaaaaaaaatgtcctgccctcagtggaaatgaactgtaaagttaaatggcaaaggaagtggtacagggagagatggagaattaagaccagtgatgcagtctaccccaggtatatttacataaaaataaaaagcagagtattatgaatttatgaattgcaaagatggaacccatgcatatttatagattctgaagtaaccaaactaaaagacagtgcttattttttctaataaatatctagctcagacattatttttttaactcattcttattgtcattataattagttaaatattagcttgaggtaaaaaaaatcatgctgtgaatgaattgatttctttcttctatgggtattctttagtcaaatggtctggtaaaacacttttatgagctactaaaagctttgaacgtttatgtaagtctatgacaacagtacatttttccaatttttacagaggagaattaaaatatcctatctgatataacaaggattatgaatagattaaaaaattatttcagtattttaaatttaatactctcatttaacaggtttgacaaaatgaaaagtattagattctgattcctagatttgtatttctcatctgattcaattatgtaagcttatattttagaaatgccaactcctttacatcagggccaagactaaataactctgcaatatcagaagaagcgtcacattgaaagaatgctgaaatgaaattacatttcatctctacaaaagtcagagtctctatttctgggttcaatgcatttgacagtttaactacctacattgtttttatcatataaaaaaggagagtgttttaatttcaatcccttaaccttctagcaatgaaatagttccagagaatataatgaatataaaaggggtcagtgttcaaattatattcatttatagctaattggaaagtttcttttgttgctgaagaccaggacctttttcctgtctatctgctagtgactatcactctgatgccttaatcttcaagtggacattctcttcattcagtgcaattatagtaacctgaaaggtaatgtagtctcataagagatatgccatcatcacacagatttatgggcagaaccacatccataaaatttagaaaattgcttgtgtactaccagcctattttgcctgttaatataaataatattttcaacattagctaccaagaggacaaatttctcataactgactttctgcttaattctgtcagataatctctgctgtaatatgatgaagaatatactgtgaagaatttctgacaagcttcgtttttctagggtgttttgctgaagaggcccaatctgttgtttatttggggctggtaccgcattaaattgatttagggacaccattttccatttttctatcttccatgctctgttaacttatgtcatatttattacaactcttggttttgcatgtatgtttcaatttgtggtagcaaactgatgaaacacgtttctccccttttttgtaaaatggtgtttaacaactgctactcctattaatgtattgccaccttataagtaaactcaacatgaagagatctacacaatattctgattaagaaattctacctggggcacagaatatatgtgaaataccttttcaaataaaaacttggaggaagtaaacagagcaaatgcataaaagaagaacatatgttttatgctaccaaattatgcatcattattttgaatagctaaccaaagtttgttacagatactaaagcttcgtttaaattttagtccatttgcagtttgtcattgttgtttaaaattcctcaggcaggggtgtgagtggaggaagttacttctctagggagatgaactctaaaatcttgtttctgggagatactgcaatttgtggtctcagattctagactattccaaagaaagctctctgagctcctgtgtgttaatttatgacatatctgctctcacccgataggtttgtgctttatcacgagtctcagggagcccatcagggctcacaaaggaaagaagtctgagacacataaaaaatatatgactccaagccagggagcactttacgttgtacacagcaaaggaacccctggtaccactgaacatgaaggtcatgttctacgcaagtacaaggactgggctgccatccttacattcttcatgttattaaaacaaaatgtctaatcatgcctgaagctgcccaaagccttgttggcgaagagatatcaagctggaacacagcaagtccacaccttctgctttcacccactcccactttctgtatgcacactctgaccctgctctggccagactgacctatttatccccttcccctaaaggtatctcatgtttcccaccttcaagcctctccacacctatattttactcatcttttaaggtccaatttcttagagtactccaaatccaaagtcagtgcgatctccagagagaaacaatacttttaatttctctactgtccatatagctaccataagacttatgtaagtattcactgtttccctaatagattacacattttctaaggataaaaccatatttgaatgtccagttatgctcctaagtggctaacattgagccttactcaaagtaaatgcataacacaaatttgtttttatgcttttaatacatgttggtatttttaatatttttcttctcgacaaaagaacacaacatcatcatacatacaaccttcaaacataaatgagaatgtaaaagccataacctccatcaatgtccaatcaaagtgctggtcaatggaagagagagtttacaccattgacccaagcatatgtttcaggctgtggtgaagcttgaaattttcatatcatttatttgctggatgacccaattaggtcaaaacctacttttctttattggaatgaatcccctagcaggtaggtcaactccgcaggacaaagcttctaagcaaatgtgaggtcggttaattctcatatcaactctaatttgcagcaagactcccatggcatttcaagaggctttgagtctttctgaggcttaaagagtgaggtagtagcttcttttgagcaattggtaatactttgggtcaagaacggtagctatggaacatatcctaataatcaccttctcaaatgttacagagtcttgcaagtgacagaaaaagatggaaaaaaatactctcacagtttaggaaactgctttcataagctttggcatctctaaaacttagattccagcccatccaaagagctctttctgcagtatctgttttcaggaaacattttcatcattgatccaagcatcagaaaacaaaaacaaacataaaaatacaacataagatcccaaaagcatcagcattcaatcactgtcattacatgaattatacttgaagcatgagcaagacacatgaggccctatctcaaagatgagccacccctactggtgatagagggcacccagagagaagcaagaccctcatttaccaccagctgacccacaggctctgagctcctccaatgactgagtccaaagatgtagcttcccctcactctttcaaaactagtcctatgttttcaataactagcttttctctgcctcagcatcctcgagtatacaacaaaacagtagaggatgatagaaaaatgtgggctttagagttggagtccaacaaaccaaggttatgatcttggataacttcatcaatctctcttagctttagtttcttcatctgtaaaataagaacaatgtttgcaggactgcggcgtaaataagctaatacacaggtgagagtaaatgttagctattatcattatgagtactgttattatcagggtgtcagattaggttatcttctaaatatccattctacttccaaggcttataaaatagagtttgaataaagcccccattcaacctttaataaccctaaagattaatttgctccttctgcataataatgaaaggacaaggtaccttgcggatcctagggcatatctgttcaagcaccaaatactttttaaaattaagaaaataaataatacttggaaaatggccccattccaacaaaacccttaatgtttaatccgtaagaagtcatctgaactctcatttaactagctttcctgatggactgattgtatgggggacatggaaaatgtgaataccaagtaatgagactgattttggcaagacatcagagaaatcagcctaaattactccttagtcacacttacataggaaaatcattttaagagactttatatcaaaaggattaataaataccagtcaagtcatgttttccagggacttccaggtcacatggtgatttacaaacaggtgtctaaatcccccttcccccaccccagattccaggtgaaatatcaagtagaatattaaaacgtgaaaataaagtttcatgttgacttctctagttttgtcgggctatttatagggatcaaatagtgatcttattatagatcactcccacagcaacttggtccttgcccatttctctttgccatccttcccacaatgggtgcttcaactttcattccactcattgtatctgatacatatgtacaaattctgtcagttaaaaataaatttttaaaaattttaaatgtactatctattctttaaaattagtttatcctctattactattttaatgtagatatagagagaaaaacatacctacacatgcttacaccatttaattttatatgtagttttctttatggaacatgggatcagtcattcaaaacaaataattttgtcatcttcaaaaattccagagtctagatattgttatgactacctggacgggggaaaatcttaactaatcattaagttaaaaattagctaataattattagagctcagaatgaacaaaactagttaagccgcataccttacagaattctaccttgtcaagtcaggccttttagattcagcaaccctaattatccatttcagacctgttgaattacttaaagtactcaatgtggccagttctatcccctccggacctatgcactttcacctccctctcctgtcaacttagaagggccttccccaccattttcccaggaacacttcctactcttccttccagacttaactcaggtgattcctctgggcctcctttatgagcctatccagaaaaatgaggtgctcttccctctgctcccaccaaaccctgagcatctctcttcacagcattcctgccactgttttggggctacttgtgtacttgcctatccacccccttccgcaaaatgcctggtttttatctttaaaggtaggtatttgtttttccttatacatctttgtcttccccgacacccaaatacagcctggtgtaaactaccagcatttaataaatattgaataaataaatgaatggatggaaaataaacaaaaagcttaagtctctctctacattattataacctcttagtgaaggatatatgaaatgacatcacctacaagtattaatggcaaaataaaaacatagataatgagcactttaatgtgctttcattaatttatttatgaagaaataatgtgacattcaagtttggggggattcctataccctaatatctaccattattaaataatagttttcagtctctgtctacatagtcattatataacaagaacacatgcccagctgggcacagtggctcatgcctataatcccagtacttggggaggttgaggcagggcagattacttgaggtcaggagttcaagaccagtctggccaacatggtgaaacttcatctctactaaaaatataaaaattagccaggtgtggtttgcatgcctgtagtcccagctacttggaggctaaggtgggagaatcacttgaacccaggaggcagaggttgcagtgagccaagatcacaccactgcactccagcctgggcaacagagcaagactccatctcaaaaacaaacaaacaaacaaaaaaaaaaacaagcaaaaaaccacacatgcccctaccagccaagtatcctttagataacatattattctgcacatgcttccacattgttacacttccctcataattatctctagtcttgccaaataacctgttaatttattcataatttaaaggcaataaagcagagccttgagcaaggctgcctgagtttaaatctggactctctcactttgcaagtgtttgatcttggataagtcacttaacttctctgtgcctcagtttcctcatcctgtaacatagagatgataataagagtgctatcatatggttttggtgaagactaaatgagctaatacatttaaagtgatgataagaggtggttttgttttgagactgggtctcactatgttgcccaggctggtctcaaacctgttggtctcaaacttcgggctcaagcaatcatcccatctcagcctctcaagcagctgggattacagggaggccatcttgaagagttcttgatacatggtacaaacgctctaactattagctatatatttttattgtaattctgaattcactaatattggtctaggttgtttctatattatttgcatcacactagcacatttaagcatatggatttgaggatggtttcttgggtagttggttttgtttcaaattctcaagatttctaactaatttccaaaagggcttctaatctactttttaaatgctcatgtaaaaattacttaattttatatgtgtaaactactttttaagaagatacttcacaaaatctcgacaacctacacagatagacaattgtcaaagaagttggaaggggccaacattttagtttgtacttgaagcttttcatctcagaggagttgctaagttactatctctatgcacatcctagcaagagggagagggttgtgaccaaagaaacaatacttttttcctactgtgcttcacaactcaaaattcattgattcgtatgtatattttgttttgttttgttgtgactaaacaatcctagtttctttcatctctttcaatgaaaggaaacatgtctgtcaaaaaaaaaaagggggaacagcaaagggaaaacatccctcagagaaaggagtgaacaatataaaggtaaacaaaccagggatttctttgatattgcccatttgtttgtgagaacaaagtaacaaacactgaaggagaaccaagtatagattaggcataaggtaaaagggagaacattattcttcattgttcttatctcagaggcatctactactaaatgatgtggggcacagaaagtgggcaaaggaaacactcatactctataaacttacctcctctgggtgataatacatgtacacccagtgccgtttctttagcaaaacgtatttgaaatgcaaaccccaaatcatgttcatactctatgtcttttgctttctagatgtggaatcaaaaaaaaaaggaccttttggtttatctaggcctaatgaggttgtctttgattcttgattatcaaatagttcatttgtttaaccaatattcatacttttgtatttttgatataattgtacaaatttggggaatacatgtgatattttgatacatgtatataatgtataatgatcaaatcatggtaattgggatatccatcacctcatttatctgtgttgggaacattataaattttctcttttagctatttttaaattacattattgtaaactaatttccttactgtgctattgaatactaggcacagatcacaataagatgcacataaactggacaaaagtctttgtcaccacgaacacagatatgtactgaatttgattcccaaatctgctctgtggccttagtcaagttactgaactcacctgagcgagtttcctatgaaatgaaaatgacagtaattgtggtgcatctccttgtacagctgctgggaaggccaaatgggctaattcttataaagcaccctgtgcatagtaagccctcaataaatgctagctactgttgctattgttcctttcattgagagatgttttgtggtgggtttttgttgttttgtttgtccattagccaagtcagaatatgacctctggcttgtattgtccagtgctatttttcatagaaatgaattttttttttttttaaagagacagggttttgctctgtcacccaggatagagtctggagtgcagtgatatgatcatagctcactgtaacctcaaactccagggctcagtgaccctcctgcctcagcttcccaagtagctgagattacaggcaagcaccaccgtgcctaattttttttttttttttttttgagacagagttttgcccttgttgcccaggctggagtgcaatggcgcaatctcggctcactgcaaccttcgcctcccaagttcaagcaattctcctgcctcagccttcctgagtagctgggattacatgcatatgccaccatgcctggctaattttgtatttttagtagagatggggtttctccatattggtcaggctggtcttgaactactgacctcaggtgatccatctgcctcagcctcccaaagtgctgggattacaggcgtgagccaccgcacccggcttttttttttctttaagagagaggggtctcactatgttgcccccaggctgacctcaagtgatcctcctgcctcagcctcccaaagtgcaggtgttacaggcatgggccactggcacctttcctagaatggattttcaactctgtttaaagacgattgctaatgcacagccaattgaatgcttattaagtagaaattaaacttgctttcaaataatgagaacatatgtcacagatgaagagttggtcctagtgcaagtttacaaataaaagacaaagaacctttcagctattgtgactagttagtcccttcttttacagatgtgcccatctgtgtgacaaaagaagcaaggccttttcaaatctttgcagagatggcacatgataaaagtcaggttccactggcttggatgctgattgccccttcaggattacaaccaccccagttccctgcattgtttgtgctatatcatgagagaacaggggcacatgaggacaagatttcttttcatttcacctttcagcagccttgtctgaaaccacactgactgttgttaaaaatgatgcaaattgtgcctcctttcagaaaagcacaaaccattctcccgttttcccccagtccaagaactgtacaggaccttcattagctagaggaacacgatgatggcagtgcctattttaagcagaaagatgctctaaagggaaaaacctaaaaggcttcagacaaaatactattcagtttattatactattgatttttagaatactcttcagctttgctttttttgcggatatatgtcaaataaccagcagtgctttaagttacttgtagaagtatttatcatatatattttttcttagagaagagaaataaagctttggtatggactaacccaaaattgtttgggaggtaaaacaaaactttcagatcagttatgtggcaataatcaagacacccaacatgattttaattttaaaagggagaattccattataaaaatctaccaagtttcctcaggctcatccccacacataccttttctggtctatgtaagttcacctgtttagcaaagggatgggattgactaattggacactcaaagctttcccccagctctgagttcatcccagcttctttagattttttttaagaacaaagaaaaaccaatattttgggaactcttacatgtagataatgtcagaattaatttccacttgtggcaggatttcagtaaagttataagacctcatatactttttgtctaagttaaagcaacatctttacatcactttaaattatacaaacttctaaccaataaaaacaggagaagtatggtgtgtatttgtttccatgggcttccataatgaaggaccttcttgggtggcctaaagcaacagcaatttgttatctcacagtcctggaggctggaagtctgccatcaaggcatcagcaggcccatgttctctgcaggctctagagaggacccttccttgcctcctccagtgtctggtggtcactggcaatccttgcctcctggatgtatcactccaatctctgcttccatcttcacatggctttcgcccctgtgtgtgtgttttctcttcttataaagacatgagtcattggattagggcccatcttaatgtggtatgatctcaccttaacttatttaattaaatatgtaaagaccctatttcaaaataaagtcacattctcagattccaggtggacacaaattttggggaacattatttaaccctgtacatatggagtgcaaaactactcacctttcctttaccaaggaatttctaagggagtcaaattaatttaaaatcttcaccaacttctcaacaagtgcacagctttattatatccaagatcataaaatctgtcatttttcttgcttatgttgatattgtgctttatatttacaaagttttttcatattgcttcatttgatactcacaagcacaaatactcattctcacacaagtaggcagggtgactggtctctttttacagataaagtgagggagaagggaaggaagcttaccttttatcaaataactactctgtgctagatactgttactagtgcttcatgagttgtcttatttgatctatataaaaaactcaaaggttactgtaagtagtattattcccattctgaagtagagtatagcataaaatagcactaaataacttacccaaggtcacacacagctagtaagtaacagatctggggctgccgctcaaatgcacctgtgttctaagtccatcatgtttccattcttccttctcaattaagccttcttcctaacaagtctttaactttgttcatggttagaatttgctaaaatatgtttggtggttgaaagtcatgacaaactcagtgatctcattaaaggatcaaccggagagatctaggccacttaacatgacacatacaggggactatgctttttgtagttatccttcatgttgcaataaaatgcaaaattttcctaactttgaaaatagaggaagaattgtggtggtaagaatcgtcaaaaatttacccacttttggaatagcctcaactagagtaaccctctaggactttcatttattcttctctgtgagtaccaatagggtgaagtcaaaaaatgactccaccattctgtggatggcccaaatcatgagaatgaaggaaaagaagttatcataaccttaagaaagaataagtgggaaaaaccattgttccaaatgtgggcttgaatatgctgtaatgtttcaaagcagcaagtaaagtatacttgttaaggatactctacccacctatgaaccattggagaaaatgaactattttgatgctgcctttaaagagttgtatcttcagagaagccaaaattcactgctgaaagattccttcttgaatctgtctcagaaacaatcttggatttagaatgtacatgtatatacttgtgtatgtgattatacttaacaccatcagttctaccttatattataaatataccatgataacagaactttcttttcagattgtgtcaaaaaagaaaaaaaaaaagggtctcactctgtcacccaggctgcagtatagtgatgccatctctgctcactatgatctgcctctcaggctcaagcaattctcatgcctcaacctcccaagtagctgggattacctgcgtgtgccaccacacctggctaatttctgtatttttagtagaaacagggttttgccatgttggccagggtggtctcgaactcctggactcaagtgatctgcctgcctcggcctcccaaaatgctgggattacaggcatgagccacctcacccagactcttttcagattcttaatgcattctacgtatttacaaataaatattgctaatagctaccatctattgaatacctactgggtgccaggcagctaagcacttactgtacatattcctagttgtcacaataatcctacatggtactttttactgatcctcattttactggtaaaggctctgagactgagaagtttaatgtcattcaaaacctactagatgggtgagccagaatttggactcaagttcacataattccaaagcctgccaccacacaaggaaaatatccatttattcacttatataagattgttgacctctttaaatatgccggtttcatcctaatcctctaaaaaaattagtcattctcatcttttgaagtccctctgacctaagggtgattcacagaggatcaagtaggtaggatcaagaatcctcatcttccgaatacattcatctttttagcttgataaagccagaatgttggggcctaactacgtagacaatttcctcacatttaattagaagacagacctaagacttgtctttgaggccaaatgctacataccaagttttcaccatgaattatgtttcatgagaacatggttgaatccatattaatactggatatctaatagagatcatgttataaatgaaacaaccatttatggataggtaaatattatcaagtacatgtttacattttcatattacatagcaaatcgttaggaaaccaagtgattaaatttggggttttgatggggtacacatggatgtaaaaatggaaacagagactgggggttataaggggtgcaggcatagggctgaaaaactacctattggctgctatgctcactacctggataacagattcaatcacactcaaaactcagcatcacacaatatactcttgtaacaagcttgcacatacaccccctgaatctaaaagttgaggccaggcgtagtggctcaggcctgtaatcccagcaccttgggaggccaaggcgggtgaatcacctgaggtgaagagtttgagactcacctggccaacatggtgaaaccctgtctacactaaaaatacaaaaattagccagggatggtggtacgaccctgtaatcccagctacttgggaggctgagccaggagaatcgcttgaaccagggaagtggaggttgcagtgatccaagattgtgccactgtactccagtctgggcgacacagcaagactccatctcaaaataaaataaaataaaataaaataaattgaaaaaaataagaaccaactgttgaaacctcaaaaaaaaggggggtgaggcggtgggggtgagttttgaaaggtttaactttgcatgcattggtttaccaaaggaagaaaaagggagtgggagagacagaagaaagagaaaaaaaaactccataactagaaaataaatgcctgcattgtagaacttcttaaatgttattttcataaagttatataaacgtatgtcatgcaaataaggacaggtcaaattgaaatgtttataaaatatgctaaatttaagagttgtagtcaaaatgtattatagaatctaactgtggagtttattaatttacattttcatggcataaaaatagcaggactcaagccatgcagttaatgtacacaacattcactgaattgtagacacaaagaggctaaacactagaaagcagcttttaatattctgtaatgttctttatcaagctgtttgtacaagactttatgaaacacagcacacggcttaacaatctccagtgcattattatacatatctaacttttgccttcggatactcccagcaaaggacaacagattctcaactttactgtaccaaagcaatgtggtcaggaaagcagcttccccgttctgcagcagctaaatgtcagagagccaagggttccaccaagatttcccaaagcacagcagttgccattagaaacttcctaaccctccaatgttcactttacagagtgttcagagggtgataaacagatcttttacttgatttgccatctgtgaattttaaagctgttaaggcacttttctgtctttatttccatgatgctcctgatcccatttgctagttagatgcactcactaatatattattcagttctattgagaaaaccatactgaggcatctccgatttgacattactgtccaaatttttttttttttataacatatcaagtaaaataaaccagcttgaaaccctggccttttttagtgcttcaaataattcttttcatttctttgttactgagagctcacattagaaagctattaatacatttgagtacaatttatgttttcaatgcaacccagacaagaaatgaaaaggcatggagaagaaacatggccttcctggacagcctgaatcagtaagtcgttactcttcaccaaatgtagcttatgtacaaatggcttcatttccattccccttcgctgtgggagcctcaagaaccacagttacaggagctagaggatgacgctgacagcggtcacacaggcagtacccactcgtttcaatagccttcgccttttccatttgttggtttgcggaaagacaaaactgtgctgatcctgattgtatgagacaagaaaatccagccaattctattttacgtggtactcttgccttagtttctttttcagtgagaacagacgcgccactgctacagctggccctgtatgttatttttttccagcattagtaatggagtcattgattcaatctatatgaatggagtccctactaagtgccaagcatataacagtgaacaaaacaacctctggcctcatagaactttcattcaaggcggtgagatgggaggagccaccaacatacgaaaacaaatgtagtcacatttacattaatgcctgaattaccaagactcgggctttctttgaagccttccccagccaatttgagggcactatcagatgtcctgtaatatgcacaaaaccaaccactcattttcctccactttggccttcttgctagttgtctccttgtggggcaggtaagagacctgacacactgccacatctacagggctaccaccaggtcactgacataagagtcagcatctccaccactgttcgccactctctaccgctctgcagaggccactggaagggtccagggtaagaaacctcacctggggtctatggcagggtagagagagaaagctggaggctcccccacctgctaatattacagttggttacctcggccctatggttctgtttgtgcccaaactttcacatggtctttcacaaacacgactttttccccttctgaccttcacctttctcttcacccaggctccatgtattcccttgtattctcatctctttccctcatctctctccaggcacctatccacaaaataggttcctcttttttcaccagaagcagaaatgtatatgaccattatctcttacaaccacatccccatagggatgactaacctgatgctcaaagagccacagtccaccttggactccgttaggaagccctgccaggtatagatgggagaactgagctaccagcatcaaggacaccagcaccagaaccagtctttgaactattcaattttatttcctaatgaatgtatttctccacccaaatgctgtgcatcccaggctcttcctcaacctctacctacagagaggatgatcagctcttgtgggtgaggtacagtcacaccagtccagcaatgtgctttgcgattccttgccaggctggattccctaaccattctggtaagcctatcaataagcttgcccaaatgcggtgaagacctctctcagaacagccggagtatattaatccatttaacctgggttttcctaatcaatatggaaatgtttagcctctgaattctgaaggattgattccatactcctgtatggcattccctggctatcaactgccctgagtaggttagcctcaagatatgtgtgggctttgctaaataaactttgataaaataagtaacatttttctgatatatatgaaaatggttttctcatctgtgttggacttttccacagctacatctcctgttctcatgagaagttttacttcctcagaattagtgtgcctccgtaacacaaaacttcagaaaactcccaggcacatgcatgtcaaatgcatgtccaataggcttccacagcaatcttctcatctgtaattcacccagggaagaagcaagcacctccagtgttctgcagactcacagtaatccaagctgcttaaatccttcataaatcctctgtgcaaaaacactaaagagattgtcagcaggaaattcaaccactggttacctcggacattcctagaagacttttccttaattatcagccagagcactatgtcattaatgcagacaagagttgacagcagctggtctaaggcagtaatagcagagacagacacacaaggcaggttcagaagctaaccaggagatgaaatgggacatggcttgtgtgaccacaaacatgaatgcgtgtgaggaatgaaggaaaaataagacccagcaatgattccccaggtttctggcttagatatttgagaggatgcagccactttttattaaacacaggaggaagagcagacttggggagatatatggttaactgcacactaatttatatttgcaaaatgatgaagcacatggagagcaattttttatttttattaaattgctgattatgttcttaagagaaaatatttgtatttactatctatgcatttgaaccatcagaacccttattttcaggacccttattcccaagttttctatgtgtctcggtaattcatcaaataatattaaccagcaagggagggaagtaattaagtgaagatgaaatttttattaaaacactaatcataaatgctcatttacttattcgacaaatgcttactgaatgttggcaatgagccaagtaccaatgtgaacgacagaaacatagataacaatgatactgaacacataaggagtaccagccaccacaataagcacgtcatctgccattgacaatccccatcataatcctgctaggaaggtgttattacaatgactattccatagatgatgagaactaaaactaaaatcctaaacccccaactggctgaacaaatcccctcttggttaaggggaccccagagaaaccttagaaactgagttcctggccacggtgcgatgggaagccagacccgtctcattacatcccctcctttttgtggtttagacgcaacaactgaccagcatcaatgttaacatagagatcctaagactaacaaaatggactctgtggcaataagataccaaattataaagattgcctaaggccatgccaggcaagggttaagtcatgcaccctccacacttaaagagtaaattctgttccaactgccacaagtttttctttttctctagcagttaaaccagcaccggcctcaagataagcactattgaaacaactgcagcactctcaccaccagatgctgacccccggccgattccacaagccatacccacattttttgattggaaaagagacagctgtggttcagtaactttctcctaataagagaccatggaccatggactgatctggctggtttacagaggctgtaaacttgagggccttcgtgtccctgccttacgttttgccatataaggcctaattgtaagacacttaaatgttaagtctccaccccaaagtgaacatgggatgcaggtaatacgcatgtttgcttatcacacgtgtacctctcccacttcatgattattcatagctcctcctgtaacctattgaatatgtatacttggccaacctcagcataaatccctgttccaccccttcctccctcaaagtgtctgttaatagcctctgcaagaggctacacttcccagccttcaaaaatggccagaccacaggctataaccctttataagaaataaagtctccttcacagatttaaagatcttgtgatttttccatgatgaaactgacatagcaacgtgttgagtaacttggctaatgagtaggaaaccaaagtttataccaaaccctgggactctagagccggtctctgccatgcctcttccctcaaggaagtcaggatcctcttgggaggcagaccatacatgtcattagaaagcttttacaatgatcaccttgcttgttcatctcaactctcgcagatctgccactttcttcagtcctctaaccacttgattcggtacacttgatgtgatctagcattaccagtctctcctccaccacatgctgcctgtaattgtagcagtcacttgttttcagtcatatcattacagagcagcattgagttttccagtttataagcagcccaaatttgttttcctgttgagcttttgccttgaatgtctggcttttccttggggatacatagttcccagttccatttcccacaggagctttactctggaatgtctaatagtgtgtgtttgtttcaacatcggggatataaataggtaaaatgaagttctgcttggtgctgctgcacggctgcaagaaccaagggccagccaatcatgagctgagggacttactgtgtttgtttaaatatagttcaggtttctcccttctctctacctcaacaagatttagcacctagaacaagacactacacctttagtttgcactccgaaattgctaggaagtaaatccatctggaaactgcactggataaggagcagggatacacagcagtggctggaaagaaattactcaagtacgaaatcaggaaggaacctcattaacaccccaccaccttttgtaaagtcaataatacactgtccagtatgaaacccagccaagatctcagctgttgactgttcagtgaaagaggaacatgaaagtgacagaaggacattcattccagaaaccctgagaatccagcagcccctacctggtctccagctccatgacttgccaccgccctcactgctccagtctaaattccacaccttcagagctagagtcagagtttccagggtggcaggagtggagtgaaccagggggatcccagcatcctcctcaaatgtagggactaagactggcggggaaaaggggcagggtcctttggggattgtaatgcacccaaggggaaatcccagagatccaggttcagtcctctggccctccccagctagcctgatgtagctccatcttcactgaagttcctctggtgataacacatcatgttgaagaggatatttagggcttcctgagacaaagctgtgctaaacacatgaactctcagcaaatactagcaagtgaattaaaaatgaatgaatatcctataaaacaaagcaacaaatcagacaacccctacccccgaccccatggctcaatgagagcttctggacctgcagcatccccacaacatataattcacccactaccccatactagagaaacctaggaggctctcgtgtcctggggagcaagctgttaagtagaagtgggagaattcctaaccctgttaagagttggaatgttaaactctaaagataagcctgaaaaccagctttaaaaaatgtgagcattcctagttaacctagataggcagaattcttttccctcctatcaagacaaacccacagtagctcaatgcctggattatgaggccacatcacaaagatgttagttttttcagtttgggttgttgctgaaaagaaagtaagaatttaggcattacaattcagactagatccattcattaggtccacaccacaccagtaaacagtgatacagatttgcatagtgtttttttaaattaacatttaataatgttttacttcccaagccccttatgagctgggcattggctaaaaaggttttggctcagtacaaagaagaatgttccacgcctgtgaaacaccaaacaatggagcagtggtgttgtaagggagtagcctctggcccattcaagtcaaaactggataattatttgttgcagatgctttaaagagttctaataatttaggtgttaggtgagaataaataatctctaagatgtcttccaatcctagcatacatgataaattttttctgtggaaaaagcacccaaacagaaagtgaccagtgactttccctagtcacacaaccagaccctccagcttctagcctaacactctttccactggatggtcttcaccaccaccagtactcagccccaagacaccaggggaacactggcactgtccctttggtttcatagaaaataagcacaaataaaagattcaacatctgaccgacatgctttcccatattttataagaagatcaatttagtaccatataggtaccaaggtactataggtaccacataggtaccaagttactataggtaccacataggtacattagacagactgttttgtaaacttctgaaagccaatacaaagaacatctcagagttagtatggtagaaccttctagaacacttgtcatggcctgaatcttcatgtccctccagaatgcatatattggaacttgtattagggttctctggagggacaggactaataggatagatgtatatatgaagggaggtttattaaggagtattgactcattcaaccacaaggcgaggtcctacaacaggccatttgcaagttgaggagcaaggaagcgagtctgagtcccaaaacctcaaaagtagggaagctgacagtgcagccttcagtatgtggtcaaaagcctgagagcccctggcaaaccactagggtaagtccaagagtccaaaagctgaagaagttggagtctgatgtttgagggcaggaagcatccagcatgggagaaagatgaaggcgggaacactcagccagtctagtcattccgcattcttctgcctgctttattctagctgtgctggcagctgattagattatgcccacacagatggagggtgggtctgcctctcccagtccactgactcaaatgttaatctcctttggcaacaccctcacagatacaccaaggaacaatactttacatccttcaatcaagttgacactcagtattaaccatcacagaacttaacccccagggtgatgttattaagaggtgaggactctgggaggccccaccttcatggctgggattactgcccttttaaatgggttgagggaacaagtttacccccgctttggctccttccaccctgtgaagatgcagcaaccagacaccatctgtggagcagagggcaagtctttaccacacaccaaatctgttggcaccttgatcctggacttaccaatctcaaaaactgagaaataattttctatcatttacaaattactcggtctaaggtgttttgttatagcaacgggaacagactaacacaaccctatacttcagtatttgggataattggattaaactaataatttcactattaccccataatcaaacataatggcagcatttatttggctgagtttcatgcttagagtatgggaataagaattgttccattataaaggtcacaaccttacataatgatctcccttacataatagtcacacccctatttttggaccggcagagccagcataaaaagtgttatcattacacaaatacagcactttagaggtgtttttaaggacagaaatatattttcaattctattactatttttcaaacagctgaggctagacagagattccaagtgccctgcttcgctgtttttgagctgtcaaagaaaatgaatcaactgactacagtcacgtatctaagacagacatagaatttcgcaggaagtctgaggttatttgggtcaagttcatacggtatttgatctacagcctgataatacagcttttgtgctatatgagcacactaggacatggtgttatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacatggtgttattttttaactgagacataaaaaccaaagtaacaatctacttgtattcattgttaagttttcatatccttatagccaaagaaaggaaaaccacttccaaccagcctgcttctattaatacacacagtgatctttgacgtaaatgtcacacatgttcactttaggcttctggtcaaatttgcatgaggccaattaaattctgaggtcctgaatctcctctgtaaattcaacagatagatttctcttcttgtactaagctattgtttggtattgttctgaactactcaacagctgtaattctgcaactcactggatgttgaagggtataataattgtaccgagggatatgaatgtgtgtaaacccaaagcccagtgctgtctctacggtgatacacttatccacattcctcccactgtcatgacacagtcctcttacttcaactggctcacttctccgaatgcctggaacttcactcaatttaccttcccttatacaccttagatgtcaccttagatagtgcaccttaaatgtgcactattatggtagccactagccatatgtggcttctgagcacttgacatgtggctagcctaaactactgagatgtgctgtaagtacaaaattatatactagattttgaagacttagtatgacatatgtaaaatacctcaataattttcataccagcctgctgaaatattttgcatatatcaggttaaataaaaacatacatattatacactagaaaattttaaattatgtgtgtagctcacattattggataatattgagttggctaattttaggctctctttccctgactccattctactgagctctcttcaattacacataaattgggtcttctaattttatcctttatctcttaatctccttttctatccttttgtttttcctgtgctgcattctgggtaatatctcatatttatcttccaaatcactgattctttcttcactaggtctaatctgttgttaatccatccatccattacattaggttttatgtttactttgttttgatgttttgaatatggttttgtttactgaacttccagacaagatttcatctggtttagaaaaatattggaaaccattaggcaatttctactaatgctgaatacatgcatactctgtcaccagcaattctactcctaggaataaacccaacaggaaaaaacgatagcccaaaactgaaaattacccaaatgcccaacagctgtagaatgtggcatattcacacaatagaatactaaattaaataagaaaagtataactatatggaaaaatatgaagttcttttatcctttttcatatgttgagagacaaaggtcatatacaaaagattatatagtatataaatccatgaataaaatctttttaataggcaaaattaaaatggtataagaattcaggatacttgcataatagtcacacccctatttttggatactggttgaccttggagtaatactagttgaccttggagtaaaagattacatgaagggaacagaaagggggtttatgagatgctggtaatgttctgttccttgatctgaatactggttacatagtacattaatttatggaaattcatcatggtatatccttatgatttttaaactttgtatataatttaacagtataacaaactcaaactctaatcagtgattttcagaaaaatatttggatgttgtattagtctgttttcacactgctataaagaacgacctgagagagggtaatttataaagaaaagaggtttaattgactcacagttccaagtggctggggaggcctgaggaaacttacaatcatggcagaaggcgaaagagaagcaagtcacgtcttacatggcggcaggagaaggagcgtgttgaaggaagtgccgcacttttaaacatcagatctcatgagatctcactatcacagaacagcatggggaaaatctgcccccatgatccaattacctcctaccaggtccctcccctgacaggtggggaattacaattcgagatgagatttgggcagggacacagagtcaaaccatatcagatgttaaaaccttttttttcctttttgagttgtcagttttgaatataattatttcaaaaatttcattttgtttccttttcaaattctgcctagacatttttaatagcattttgctcatgttttcaaatccatcttttatttctagaaacattttaggacatttcatttatattctgactgataattcttaaattcaagttcttgggaagtctaattctactgtttgttgtttccactgatggcttgtttactctgtgtaactggaaacttttcattgtgaagtcatatgtggttgattttaatctgtgagaattctaaagagccccagctgtgggaacattcctacaaagctgattctcttccgattctgctggaatcctgagtctctctcaaactggaattatcttaacaattcttttgcttgaggtttcctggacggcatatgtggataatgtgagtttaagccctaaaccttcatgagttcagaattctcagcagagacatttccccacccccagccaaggccagaacaatttctcatagcagtttttctttgccaaatggatttttctagtccatcttttcactgagggtgtagatcttcaagattcctggcttttgcagactcttaatcagttccgttgaccttgtaacagcgcccaagtcctcatctcccattccacaatgcacccctccctactcatccctgttgtatggcaattaaaactgaagctttcagtttctgttatctgcacacactcccaaggcagcccatatcttagatcctcactcaccaccctggtgtcagctctctctccatttttgcctctgtagagacttacattcaatttttgtgagcttagctacatatttaaaaggttgttttttatattacattcagcatttctcagtgtctgtaattgggagagtttctccaaatatctattcttcataatactagaagcagaagttcaacaggccttctctatctgatgcttaaaagctagcgaggcagtcatttcagggctttggagaggtcctactctgttacctcccagcttaattacaactgaattttctagaactaaaaaaaatgtttaacatgagcagaggtgaggtgaggtgtcaatcaatccattttcacaatatgctaccacctactattcagtggacttgctaaaaagtcacctagcagagagagctttgccactttgttatgccaaaggatcaaataatgcagaaaccattcattcatacaataaatattcaccaagaatctgctctttgcaaggtacaaagtgctaggcaaacaaaagtgattaaaacaggaacttggccctcaaagagtttagctagaatgcctaaaaattttcttgccttaagtgcaaattgatcaataagtagagattgcctggagcattgtattaagaatctgaggccaggcatggtggctcacgcctgtaatctcagcactttgggaggccgaggcgggaggatcacgaggtcaggagattcagaccattccagccagcacagtgaaaccctgtctctacgaaaaatacaaaaaattagccgggcatggtggcatgcacctgtaatcccagctacttgggaagctgaggcaggagaatttcttgaacccagcaggcggaggttgcagtgagccaagatcgcgccactgcactccagcctgggcgacagagcgagactccgtctcaaaaaaaaaaaaaaaaacaaaaaaaaaaaaagaagaagctgaggacaagtctaaactagtgagtcatctgttaaaatacaaaccccactatgccatttccctgttgaagcacctctaatagcttcccattactcccaggttgtaatccaaactctgtggcctacaaggaggtcctcccagatgtggccctgcctgtctcccagtcttcctcttgttcactccattctatccatactagcttccttctgctcttcaaaggtgcctagttcattctcactttagctcttttgcacatattcttcctcccacctagaatattcttagttctttacatgggtcccacttctcatcatgagtctcagcttaaatgagacacactttgagagggcccttccctaaagaccctgtaaaaaggatctctcccaccatatcatttatctgtcacatcaccctttttaaattttcttcacagtccatatcagtatcttaaattatcaagttatttgtatattttctcatttattctttacttttctctatattctctaaatgtacctggcatatgtaatgggtgctctgtggtatacatatggatgaatacataaatggataaatggtcagtgatgtctgcaagcatgcaaaataggagggtggctctacttgtactacctaagtgcatcagaggaaaggtgacagtaacaaaaaacatcaactaagtgcaaaaaatgccgttaggttcaggagtgatgaaaggggacataatgaactctgttgggagcaagtgaaggacacaggcagggaaactgtccttgaaaaggcagcttaccaaagaccctaaagaaaagctggaagttactggcaggcatggtggaaaaaagcatccagacagaaaaagcacatgcagcaacaagcagctgtgagattcctccttacttcatgctatcaccctgaattcagggaatcagaacttcccaaagggttccagttttggcctcttgtccagagatgtccaggtggccaaatatcaaagtcctgtttcagactttcccattaactaatcatatggtttctaagagagtcattctacccctgggggcccccaccttcagcagctataaaaccaggatgtggctcgtaggtctctcatatcccttccatctctgcaggtctgttagatactcccgtgtttgctccagcacacattctgaattggccagtactggaactgtaaaacatattgattccttttggtgatttcttttgtgctggtttttgttttttaatgattaagagatagtctacagaatatcagtgttccactctgtcactcagttatagctaaacaaatcaattataaaattaagctctgaattttggtaaattccaaagccttgcacatgccgcctctggccagtctgaagtccaccgctccatatcactgaaagcccttctttagaatgcaggtgactgggtccaaccatttaccatccaaccccccagagccactgaattagcatctctcatgagtggggcccagaaatccacattgtcaacattggtaatgcccagttaattctttcttattcaccctcaaggagagaaccactacctcttagcttcgctctgttccaggataaaaacaaaacaataaccaaaacactaacagtggccagcatgcattgagtgcttcttatgtgtcgtgatttgtcccaggcttctgacttcctttcttgccccaacagtgttgaatcacttgcccaggttcacatagcaaccagctggggaatgaggatttgaatccatgttctttggactccagcatccatgtttccaactgctaactacactacagcagggtacaatgcttaagagcctcattcagctctagcatcggacttgatgagttcaaatcccagctgtaccatttactagctgtgtggccttgggcaagttattttgcctccttcagcctcagtttcctcaatgtaaggtgaggataataagcattgctacttcatagggtgcttggttgtgaaggacaactgagtaaaatgctgagaagggaacctggtgcatagtgagcgtcagccatgatgatccagcctccctttctccaggcttgggctccttggggcgtggtacttgtcccaaaggaaatctctgtcaagcatgagtagacggaactgaagaaaatccatcctctctgctggaaagcaacccacagcccatggtctactgacagtgggtcagtagtgttgtctttggagataaagtatggcacattatttgaacttgaatgttcaaagggcatcaactcctttctagcacacaacactttcagccttgctgcttctttttctttcatgcctcctaatggttctgtctgtcattatgaacctttcagctctgcttccacaaagcacaaagggatcccatcctttaatcctcaaaatagtttgtctttatagtttggcaggtaagagttggttgcagcagtaactcctgaaacctgcctctcattatgccaagaactgcaatgtgtttgccacataaaagcatgagtgataacaaatgctttccgatggtgagaactgctctttatggcctgctttccaagtgccctcttgacatagaagaactttttttttttacaacatcaatcatcattagtagcaaatggtgatatctgtatctgtccaggtgacatctcagccaaggaaggaagccacatcctgagaatgtcagctgttacctcaagactgaaatacagcaatagttacctcaagatagaaatatagtaaagaacttttgtctttcatgacagaaattattccataggtcatatttttactaaatcttctaaggaggtacttaaaattactttttcgttgtaaataaaactagttttagagtaatgcataatattttattcttttatttttgagacagggtctcactctgtcatccaggctggagtacagtggcatgatcctagctcactgtagattcgaaatcctgttccagtggtcctcccacctcaacctcctgatcaactgaactacaggaatgcaccaccaaacccagctaattatttttttgtagaggtgggggtctcacaatgctgcccagactgttctcaaactcctggcctcaagtgatgttcctgcccaggcctaaaattttaagtaagttcctatttatgaccacagatattttgagagtccattgccatgctagccttatgcaaattcagcgatgtacccatgaaccactatacccaccccaaaagctccacccaggggagacaaggcatctgaggggcacaagccccagcagaccaccacggatctgctgacctgggagcaaacagactcctcctcttaaaagatctacccactcagcaatacctgaactttgcaggagccagcaaacaagcacctcactccttggtaagactttccttttgctgcaccaaactggaatcttcctaccgccccaacctactgaatctataccattatttcagcaagagaaactgagcaaaacattgactacttgtgttagagaacaatgaaatattctcatcagaaaccctatcctagagaaggaaactgtctgcagtagagggaggagctccactaacttcgaacagctccaggactgacatcgctaaggtcttcccaactttatcttttctcactagcccccagagctgtccagttccagcacatggacatatatgaaaatacaatatcatatgcctcctccactgaccagggcaaaagctgcagtaaaagaactatcaagtcaaggaattatcttaaaatattactaataacattaccaaattacaaaaaaaggatctttaataagccttccatctaatgaagaatggaatgaaaatcaagaaaaaatgttgacagaatacaaaaagctgaagttcagatgctgaacacattcttttaatgttttatttatttattttgagacagggtcttactctgttgcccaagctggagtgcagtggtgcaatcatggctcactatagcctctacctcccaggcccaaatgatcctcccatctcagtctcccaagtagctgggactataggtgcatgccaccatgtccagctaattttaaaaaaaaaaaattgtagaaacaatgtctcagtatgttgcccaggctggtctcaaactcctgggctcaagtactccccctatcttggcctcccaagtagctgggattacaggtgtcagccactgtgccccagccgctgaacatatttagtcaaacttcttaccagagtaaatcccattgtaaccactgaggcaagcttggctcctcccagaatctgctttctaggctcagtccttcacatggtcttccttcttgtccccttggtcaccaagccatgcagcccttccacccttggcccatgcaggtataattctggtccctagcccccaaggtaaggaagcctcttcacttccaagtccccaaagtcacctgcctgggccactagccatgcagcagtaacttcatacttccctgttttgctcttcttgaaggttcctattgtccaaccataggccaggaagccctgctcttactaaatcaagtgttctcaatcaactcacctgagtcaaacaggccttaaaagtctacctatgccaatcttgtcatttacatgtaaggcagagaggctgaatgacttgctcaaggtcataaagaaaattaaggagtacaagccaagcctcctgttacccaggccagtggttttcacatggtaccaccgatgaagcctggggctgtagaccccgttgagccctgcccagtattccttttccacctgtcaccagtgctactgctaacctcacacctctaatcttctcgagagaaccactcttgggtgatatagccaccttgcccaagtatgcccgggaattatcacttaggaccaggttgcccgtagctcaagactggttgatgcaaagatacaaaattcctactttcctgcctcaaggaagaacacaccctgctatgattgatgcttcagagcatccacaggatcaggctcagaatgggcctcacctgaaagtgcatcctttctcctgagaatgctcgttaataactcattttgctaagattctcttatattcagctctgcttctagggaatctaacctgacactggggttctctctgagcattccaagcaagtatactggtccaggccccacagtgctcaaatggcctccatgacaatctttatccagagcccatcaacattcaatccagtccctcagtcaggaatatcccttgtcccttccagcctagaagtccactcttcctcctgagagaagcaccaagtccctccctcctgccctctcaagctctcacctgacttgtagttaggatctgaaagaaactctgaagtcagtgaatcatcaagctgaggtcatcagcagcataacactccctaaaatatttagtcttcggtgctccttagggagcagagaaatgcccccacagtgtcccttaatttgcttcttaaatggtgaaatctcttaaacagagaatgagggttttcattacagcattaacatcaccaacatgcagtggctcatgccagtaatcccagcactttgggaggccaaggcaggtggatcacttgaggccaggagttcaaggccagcctggccaatgtggcaaaatcccatctttgcaaaaaatatataaaaagtagctgggcgtggtggcacatacctatggccccaactattcaggaggctgaggcatgagaatcccttggaaccgggaggcggagactgtggggagctgagatcacgttactgcactccagcctgggtgacagggtaataccctgtctcaaaacataaatcaccaacaagccacccattgcttttgaagatactctaccctactttctcagaggaatcactgttcttgctacatgttctaactgatgttcttatctggatacaaaattaaaaaggtttgtcactctggagtaattatttaactatgacttgtttacataaaacagcatcctagaaaatgagtttgcactggtttctttcacagcagagatcagattattgacaaaatatccggagaacttataacctgctttgtaacaataatggctattcatgtatagtgcccaatatgttccaggcaccagaaatatgtcccttctaatccttgcaacaggtggggacaatactggtcagagaagttaaataacttgatcaaggttaagcaacaaatacatggtagaaacaggatttgaacccaggtctgtctacccacaaagcaagtgactgggccacttcaccacctctacctcctgttctccagtgcttgagactggttctaccctgcagcagttcctgttccaagctaagcttcgtacaagaattaatggacgttctcaaaagtacaccctgttctctgaccttgagagaggaacaagaagaagagcatctggtgtagacaaatgtaaggatcaagaggggctttgacaggaaggcagagtaaatgttctcttccctgtttctcccataagtctagctaaaaactgagcattagatctaaaacaagcataagaagacaccgaaaggtggggagctgccaagtgggttaaggacctcaggacccagggaatgacatggcaacgagttcctgaattttctttttccctcatgtatttcctcatctatacctgaaaagccagcaacctggaaacaccaatacacatagaccaaaaacaaataagcaaaaaaagctcctctctttgtccaaagaaccaggaaaggggcagcctagcttcttttagattgaagaaaaaaatgaaaacttttagataataaccactctactcgaaacacaccacacacacacacgcacacacacacacacacacacacacacacacacacacacacacaaaactgtggacccacccatacaagcaaagacctagtggggaacctagacagtagtgaggagccccaacacctccaccaggatagtttctgagaggctgagtgtggaggctggcctttcatctctgctaggtggcaatgtggctgcaaaggtgtcagaggaggctggtggagaatcaggtcttacccgccaccactcagcagtaatgaagccattccaaccgtgggagtggaggtcacatggagaaccataacaggactcctcctcctggcagccagatggatatgggtttcaaagagcaactataaatgttcttgaaacaaaaaactacaaagaactagcaaagtaatgagaagtatcagcaaagaaacagaagatagaagaaccaagtagaaactttgggactgaaatatattataaatgaaatgtaaaaaaaaaaaaaaaaactcaatggatgggttcaatagcagaataaagagaacagaggccaaaaaaaatctgtgaacttacagataaaacaattacccataaacaatcaaaataaattaggctggggaaaaaaatgaactaagcctcagagacgtgttgaactacaaaaaaaagatgttaaaggtaggtcatctgactcccagaaggagaggaaaaagagggtagggctagaaaagcatttgaagaaataatggctaaaaactttccaaagttggcaaaagacagaatcaagaatctgagcaccaaatgggataaacccaaagaaatccacaccaagatgcatcacagtcccacaaaaagacaaaggaaaaagccttgacagtagccagagagaaatgatgcatgaagccataggggaagaacaatttgaatgacagaggatttcgcaaaataaaccaaggaggccagtaggaagcagtgcaacattttttaagtgctgaaagaaagaactatcaatccaaaattctatatccagagaaaatattcttcagggatgacattctcagatgaagaaaaactaagaggatttgtcaccaggagacctgccctaaaataatgactaaaggaagttctctaaacaaaaaggaaaagataaaagaaagaatgtctcagaacatcaggaaggaagaaaaaaacatggcaaaaatatatataaatacaatcgagtttgctttgcttctcctcttgagttttctagattcagttgatgattaaaaaatcataacactgtctaatgcagttctcaaggtatgcaaaagaaataagacaatcatataattggaagggtaaagggaggtaattttctttttcttttacttttttgtagcaacaaggtcttgccatgttgcctaggctggtctgaattcctgaactcaagcaatctgcccgccttggcctcctaaagtgctgggattgcaggtgtgagcccctgtgcctggcccatgtctaggtttctatacttcgctggacctaataaaatgacaataatagtaggcaatgataaatcatgtatgtctacatgtttaaaaagccatgtcaaaagatacactctaaagcaatatagataaatcaaaattggattctataaaatgctcaaagaacccacagaacagcaggaaaaggtccaaggagaaactgaagaggaggaatggaggcatctgcccctccttctgccagggtcactttaaaactagacccttttcacaaggtggggagcacagtcatttctgctgttctgggggtacatctagggtgggacagggatgaacccaccaggcttttccacagagctttgccttgcattggtgaatgtgtgccctggtgcttatggaaggctcttctcaaagcccgcaggctgacctgccagcacacccaaagtggctccttgtcaaggctcagggtctcagctcaccttcagcatggtggagtttccctcctgggggagaacagtacatttgcactctgtttacaaaaagccaaaagctatgctttgtgtgcaacctatctgctggaaaaaaaaaaaaaatggaactaaggtgtctttgagaatgatctgatgcagctaggtcagggggaagaaagaaacgcaacaatttggagcagtgccccaaacgcttaaatgagctgggtacaaatcagtcagcgttggtaaactctacctatagatagatataatatctattttataatagatagattatatatttataatatatatactatatattatatagatattttataataggcattttctgacttagaaatactaagacaaaacagatactaagttccagagaacctccctttaattttattagggacaggagtcctgaatccttccaggcaagaagatagccccacagtcttgtagtaaaccgtgtgctgctgtgtttctagacccttaactttgtacctcctagaagaatgcttctaaaaactttcattacacttgttgataatgtttacactttaaaaaatacatatatctgggaaggtatttgtacacgtcattcattattccaaatataagggtatttgtacattacatgtcattcattatttcaaatgtaattttaatcagatcaacataaaagcatcttaatataatcagtagtggcactggtaactttaaatattaaaatctacaataggaaaaaaggagctttgattcattgtctcttttcaaattagcacaatcaacttagcacacacctctaacctttctttccaacctctcatgttctttctgccttttctcttgcttctcactcccccagcccatgatataacaaagagaaggctgtagagggcagagtcagggttgacaaaaaacagattccaattattccttctccttgcacgtattcaaaaacctatagccttttataaaaatatttcgattttttcccaggaaatctactttttatgtttgccctgtctttagccaactctaatagatttttctgttgagttctgatctgtacctgagattcttaagaggtatatttgcagacaaaaccaggaagatttccctgaattttttggaaacaatcttccttacaccaaaaagtaaattgcccaaggaagcctctcccacctaggacttcctaagagcagaactggcacttgtaaaaactcaggaaggttgcaaaaaaattggaaatggggttccatggtttcaatataacgttaaatttgaaaattaacgcctcaagttaatttggctctttctgtcttgagctgattagtgaacactagaattcatgctagagctcccaaaccatttgcctgcaatgcagggctcatgttccaaattctgctttttgcagtaaaaaataatatgctcacatcatttcatgactgtggtgctacagtgtttctaccggcttgcacgcctcctacgggtgggctgatgtttattgtattagtacataatgctgcaactttccactggcacacaaagctagtggttttctaaagcagtcctggaattcattaccatggaaacaaaaggtataaaaagctgtttttatctaataggaaaacttagaggaactctaaaaaagatcaaaagtgttttcaaagtaaaggtagagtcaaatacattaagtttaggttaaaggagcctcggaaaggaatcgcaagggttaacagaggaaggaggcggactctgtagtgatgggagaaaactcagcagcgccactgggaggctctgaaactgggacaaggatggataagtcgggctgccgaccaagtccacccccaaaaaagtggctgaaagaacccaatactcttcctctgccaaggtacaggagacatggttagaactccagtctctccccacagaggtgaaaatgagtagtttgttcttcggacataaataatatcatacacaccctggtcctaatacatccatccaaccattctagactctagattctagacatggaaacgagaagcaaatgaaaagcttaatataaatatgttcattttatcaactcatcatttgatctagagcttgatctcatgtgttcaggaaatgctgtcacaggtcctattttagtttgggaaaggagtaagcgcaaaccacaagtatttattttggtgtttacggtgtttccctaacatccaaataagttcaccacatcctgccatcagcttcaaaatagaattttggatatattcttccttccatggaaaacttcctgatacataaactgctctgaccatctgtaataatacaaactcttatccagtatcctcctcagaaaacatctggaacaataggaagctcccatcaatgctgctaaaggaacacaacgtttctggaagccatgtgatcattccggcagcagggaagatacatggggtcacaggcagtcagactccatccttgtactgaggccactgcccaccatgggtgtgctggccagcccatctgccattctagccagcgatatacggagagtatgaggcttacagagctgaagtcttctgcattaaaaggcttaattttcctgctcaaaggcagtcttttagaatagcaaggaaaaattattttaacttagaatggggttaaactaacagcaggactgtgtttagagaaaggaaaccatacagaaataatttgaaaacataccatctaaaaggcagtaaaaagcaatggttgaaagcatggacttttgagtccatcagacacataggtttgaatatcacatgcccacttactttccatgtaaccttagataagcctcagttcctcatctgaaaaccatacctatctgacagaattgttgtaaggatccaataagatcaggcgtgttacatgtttagcatagtgcctggcatatgggaagctgtcaataaacattacctcttgcactgtttctgttacagggagcaggtgatgtttagcctggagaactgaaggctcaggaagaacggggtcttcaaacacctgaaggactgtctcatgaaaaagagatgcacaagacaggagaattgagcagagagatgtttaactcaaatcgaagaacaaagacagcattgaatcaccacctatcaagggtcttacttgaatagactttggtttggatgagaggctatagaagaaaacctcaaaagtctcttccaattctaaggtttcatgattccaggcatttggagaattaggaaaaataatcacttaaaaaaaaaactatttagtgccaagcttcctaaaacatctttaaaatgtccaatatccatgaatcatagggtattatccattttatttgaaaaccatggaactctactactagaacttcattctaggttgtttaaaacaaagtacaatgcaaaactgtcttctttcataagaaccattttctagatgggcatagattctttgagggaattcttatcatgcagatattttacttcaaaatctaaacttgtaccactttactggaatgaaatattaacgctattaatttaaacatcataacattttttaaaaataaggtgttaaaataatatttattcatcaatcctataccactacaatattttagatcagtgatttaatatctgaaaaaatttatcacatactatgcataccactgatcagcagaggctgaaattttactgtaacttcagtccaaagatacaggttttaatttgagttctccataattcacagaaatatttaagggtaaatataagtcttaattaaaatccctattctcccagcatgtgctaaacccaccctgctccacatgcagacccttggccccaaacaatcccgagaggatgttggctcagagcagcaaggagctgacagatggggcattcggtaaaggagtggtgctgggttttttcatttttgttagagacgaaagctgtgggaaaaacattctccacttaatctattttattttcagcaaggttttacctgtaaatattaatttatacaccagcaaaactcactagatgcctgggctacatgaatataaatgaaataaagctatccaaactaaaaaatgaaatttcctgtatcttcctttctcaggcagaggaaaaatatccaaggatttaaaattctatccagtggtttcaaaggcaacaaaagatctcacattgagctctcatttaaataggtggggttaaccagggtagaaattacaagttaaagtgctgcagcataaagaagaaaaataatcatttatgccattttcaatacagaatttatttccaaatcaaaaccctttacacttggaatattgtcaaatctcaaatttttaccttgctgagatctacgaccaccttttgaaactgagacagtgtaggtatgattactccctgtatactcaagggttaggaaaatggaaaagaaccgtgagcccctcaagaatggtggcttttcttattggaatgaagtaaataaaataaattcattgacaatgcatttaatttctttcttagcaattaattgtgtatctacattgaatgataaccgtgtaaacagtcaagatatgcatgtggcaaatgaaaaataaagcaaaatgttttatcctgagttacatggattcccagagtgcaacggatggggaaagggttggggggagggattctcctaggtttgataacactttccttaaattcaacagcaattcacccctgtttagctgttctacaatgctgattaagagggtacagcattgtgccctctgggtgctctgtgctcactggcttgggtttttactgggacccccagttttgtgtccaatggaagttgggaacacagcactccaaccttccccatttttaatcctcctagagactcctaaaataatcctttgaagttttgtcatagcagagagatgctgtgagagggaaagaggtttccacatacttccacccccacatagctgaacatgagctggcatcaggtaaaagttcacaggattcccagtcttggaagactcttcctcctctcccggcctctcagtttgcacactcctatccattcctttaagcccagcccagcccaatcccatattactgcatgaagccttgtgctatagaatgaatgtgtatcccccaccagaattcatgttgaaatcctaaccctcattgtgatggtatttaaagatggcatctttaagaggtaattaactcataagcgtggagcccttgtaagcgcccttacaaggagagacaggagagagcttttcttatctctttcagcaccatgtgaggatgcaacaaggagacagcatctataaaccagggagagggccttcaccaagaacccaccaagctggtaccctgatctcagaattccagcttccagaaatgtgaggggaaaaaaaggctattgtttaagccacccagtctaaggtattctgttgcagcagcctataacagagctgattgagaaaccttggctgataactgcagcttccttggatgaagtcagcctctcttttaaaccccaggaccacactgtagccctttttacacggttttatattgctcgtggttattttacaggattttggtcatttcccctcaactacagtacaagtaacattgatggcttagagtcttcttttctttcatattatccactacaatgtcgaacatgcggcatatacctatgggatgctgcatagacctgttggtgggttgattgaatatcacctgcctacctgtattactaagttacagaaggagaataggtgggttaaatgctagcatctcttacactattctacttctcttgatgggggaaaaaaaaaagatttagcacttactgggtttagaagctataccaggcactgttcagcactgcctcacaatgctaggataggactagaccacattaaactctgcactgatttctttccctgtgaagtccttttacatttgagcaaattatccatatttgattgaaatgagaatttactagggcataattgatatgtttgactgaattagtcacattttaaacaggtggcacaagataggtcatagtgtgaatcagaatacatttagttccactgtttttctgattgtcctaaaatgaatgtgacttctagaacaagtacttctgaagccttttagtgctttcatttctgacatttgtatcagagatgataggaattagtgtcatgtcagccatctctggcagaaaaaaaaattattccctcaacaaaaggtaacattcttcatctggtgcaggcctgtgtttctgtccttaccacacatggaaaagaaagggaattccaacccaaaggacaggcttgagggctgccacccacccctggggttattcagctgttcatgctcaaccacaactccaccatcaaacctgtggcctctgtaagccagaattggtgatttttttctttttcttttttttttaaacaattgaatcctaagggtatttttcttttggcgctgaaacgatattaaaatttactgcaactttatttaaaaaaatagaaaactaatgtttctctgggtcttccattttttgaataaaactgactcttaccacccaacacatggatttggaaggatagcagtacaccaccttcttagctcacttggctggaacatgagctgatgaagtcctagtctcaagtttggccttcaagaaaactagataggcttgccctatgccagagccaatctagacctgccatcagttctgtttcttctttgtgtgtgtgtgtgtgtgtgtgtgtgtgtgagagagagagagagagagagagagagacagacagacagacagggtctcactctgtttcccaggctggagtgcagtggcatgatcatggctcactgtagcctcaaccacccaggcccaagtaatcctcccacctcagcctccagagtagctggaactacaagggcatgctaccacacccagctaattcttgtattttttatagatacaggatcttgtcatgttgctcaggctggtctcagatgcccaagctggtcttgaactcctgggctcaagtaatccatccaccttggcctcccacagtgctgagattacaagtgtgtgcaaccacacctggcccatcagttctgtttcttgaccaatgactatacctttaatgctaatctgcctttgttcacaaaatagggcaagtcagtctgaatggctgagaaactggaggagaggtaccactcaaaatgaatatcctcttaatagcagatgtaaatatcttcctcctcattatcatcatcataacaaacatttatggtgcctcctatggagcagggattttgcttaggactctgaactatatcttacttgtcttcattaaaaaccttatgaaaaaggtactattattaactggggttttttgtttttgttttgtttttgagacagagtcttgctgttacccaggctggagtgcagtggcgcgatcttggctcactgcaacctctgtctcccaggttcaagtgattctcctgcctcagcctcctgagtagctgggattacaagcacatgccaccatgcccagctaattttgtatttagagacggggtttcaccatgtttgtcaggcttgtcttgaactcctgaccttgtgatccacctgcctcggcctcccaaagtgctgagattacaggtgtgagccaccgcacccagcctgggttgtttaacagataagaaagcttaagaattagagagataaattatcttgcttaaggtaacacagttaacaagcattaggtcaaagtttgaactcgggcagtctgactacagagcccaacctatttcatataattcatattaatctattttactcacgagtatcagcaccactagataaatacgttaaaataatctataatttgaacagacatctcctaataacaaacataatatctataagtcgcaaatatctaagaaatttacatcagtatgacatggtatttgttctagaaataatataagttcaaacactctgagatgagacgataaatcactctgaaaactaacaaataaaattgccacaacataaagaaatagtacaagcactagtcaaagctagaggtcactctcaatccatgtgagaggaagcaagagtaagacactagagcaagaataagtcaccatccacatgtcccaaagaagcctcagtggcactgcaggagatacagagacagatccatggtgtccctgaagctgggactaagccagggctgtattacaccaaggaaaccagcctccctaatcccagagggagccttgaagcgtcttagagggagactaatggccaacattgagaacacatgtctattagcttgctgagcctaatgaagtaatacagcagagactgacctcattctagaaacagataacagtggctgtgcacaatgctatgcctagacccctacaccttgccagcctggtgttccttatgtattcaagatacataaagattagatgtgtagacgcaggttgtgaggacagtgtttggggataggaaaagcccccaattacagctaaaagagatgtctcttttgccagaaagtgtgttatatcaattaaatgggtaaataagcccttttcccactgtggggaagcaagggcctcttgtgaccctctattgattaagactgctgtggaatgttatttgcaatctcattgcataatggaaatcaggaggtagctgtcatggtttctgaagacaaattgctggtagctgagacaaatcatagcctctttcatcttttactgttctcaattcccaattaatgtatatcttacaatctaagtttcttaaatcagtctgctctactgtctcaggtagtaaaaatgtgtaaaatggtaatctgcctgaccctactttaagaaattgtgtttaagtgaccattgcactgatcattattcatgagctatgcattacttaataaggaacacaactcaaaaatgaacacaattaaaaataaatccacacaacagctgctgtgattatgaccaatatgaacagaaatccaaccaggtgtgtgtcaaaagaaaaaagctgctgccagacagaacactgttaaatctcatttttgttttgcacactttgacttgctaagtcagccagcaagcaatttgtatggagcagtgcttccaaagtgtgatgtgcaaaagagcagcatcagcatcacctgggaaccattagaaatggcagttctcagaccccaccccgggcctccccggacccactgaatcagaaactctgcaggtgggctcaggaacgcgtgtttcaacaagcactctgggtgatttctcgcatgctacagtgtgataaccattggactgagcacaggacagccttcagattttaagtcttcctaggaaggcattacctttggttgcaaacagctatgagaagagcccaggaagacacctgtgttaaaaccgctgcagtcttcaattgtgctgtgaacctaaaactgctctgaagtgaagtccataaaatttaaaaacctgcagtctctagggtgaatgggtagaaagagcacagtactttccttatgcagatttatttacatagaccctgacttattctagaaaggttttcagacaattttgtaaaccaaaatatataacatccagtcacaaaccattcttatggaaagacttctcactacttttcaaacaacctcattatttaaaacaccccaaacataggcatttatcactaaaagcacgctcttaagatgtcttcggtattcacttcaggatttcaggccatttaaggctaggggaaagaaaagaaatttaaattcaccaagtttaaaatgtgctccgcccaagagtcatggtgctccctgaactgtctgagcatatgaccaccatgctgattctaagttattgcatgtttcgaagagacatgacttggaatgttgtgtcctgtgaccctgtcttacagcaagatgctttcagcaattcactcatctggcccctttgttggtccaagaaagggccctacaccaccaaaattcattctagagctaatagtattcggatgaggctctagcattgtttcaactgtttttcaaaaaacaaatttgaagagcaaagggaagtaacttgtttatcagagatttgtaaaataaagtatggtccatccatatgattaaaaaccaagcaattattaaaaaaataaagtcctgcagttctcattcttgaccaaacatcagaatcacctggtgatcttttaaaacataccaatgcagggctctacaccaaccaatttaactggtcctggctagggtttgggcatccataatttttaaaagctatgctggcaatgctaacatgcagccaggatcaagaattactgcagtacatctgtattaaccaacatggaaaattttcccaaacatattaagtgaaaaagaaagtcataaatcacatatctgttaataaaatcatgtgtgcatgtgttattaacggatttatgcatttggaagtggactttcctttcatactatgtattgcttaaaccttccaaaatgagaatgtgttcatatattttgcttattttactttatttttgattgacaatttatatgtatttatggggcataatgtgatggtttatgtttacaatatggggtgattaaattggctaattaacaaatccatcatctcacattttttttggtgtatggtgaaaacatttaagatctactctttcaacaattttgaaatatacacgcaatttcttaatgttaaaaatacatttaaatggaaatttgtaggaaaaagagaaagcacatgaaaatagcaactctcaaaatataatcatgtttccttctttctccgcttctccctattagtctgctttcacactgctataaggaactgccagatactgggtaatttataaacgaaagaggtttaattgactcacagttcagcatggctggggaggcctcaggaaactcataattatggcagaaggcaaaggagaagcaagaaaccttcttcacaaggtggcaggaaggagcgtgccaaacaaagtgggaagagccccttataaaaccatcagatctcgtgagaactcactcactatcacgagaacagcatggagaaaaccacccccatgattcaattacctccacctggtctctcctttgacctttggggattatagggattacatttcaagatgagatttgggtggggacacaaagcctaaacatattgccctcctttttctaaaggagtatacaagaaaaataaacaaaattatacttctttcctatctattcaacacatatttccaacattgagattgggatgagggagagagtagagagatatgatttattcattcattcattatttctctgacaggcccatgctaggtgctaggaatacagcaacaaactagatagacatgcccctgcccacatggtgcttacagtctagtgggggatgcagacaagtaggtaaacaactacaacccagtgagagagacattaaggagaggaagcacaagctgcttgttacttgtaacaaagagacaatctagtcaaggaaagtgagaaaaggatccccaaagtggaagtggaccttcatcctgggtaaaaccctagccattaaagagttttaagaaggggaaagagattaccaagtctccattttgaaagatctctgtagctgggagtttaagtgctacttaccagtcctctctcacctaaggagagtgagctcttttcaaagttaaatgaaaccctgctacagtaccaaagagttgactgaagaagtccatctcccaatattccattatctattgccatcaaatgagattgaacatgaaatttacctcctactgagtttactgactgcactcatttatgagttcatctctagatgagcccggatatggcagatttaccttttcaaagttttgaagctaataaaacccattgtatgcaataaataactcaaaaaaatgcttggctttatagaagtggttgctacaattggtggagtctcttggaagaaaatatatcttcataaacatagcagggtaggcgaagactgccagggaaacaagctgcttctcagtatttcattgacttcacatgaagatcaattttagccatttataatcagcacacttccacatagggtgaaattatctagcccacccacaaatggatttctatttaaaagtctcatttgattgctttgggaaggatacactacagactatctaacccctatccttcaagggtagaaaattaacaatccaggtaaagttaactagaaaaacaaaagagagaggaattatatttgacagtgtcctcttacaacccagtgcatctttgtggacattaatgtgagttacctccagcatcaatgtgctatttttaacttagaatattcaatctttgctcaaagtaagacatatgattagtgtttggagtaatcaatttgctttaatttaaaggagagcagaggaaatgttctagaaaggagaaaaaatttgagctctttataaaacacaaatttatgggcttctcaaacatttccaaagaccctctcctttttaaattctttcaaaactacacaatctcttatggggagctggacccctcttttcactgggttgtctgcagtacaaaagcccctgaggtgtcgtttatacctctgtataggatggagctgttctgggtctgctattctaccgttacatgtcacattatcctaattgatacttctgttatctaaagccattagcatgttatatgagtgaagcaatcacctaggtctgctctgccccatgttagctgatatacgatgtgtgtgtgcatgtgtgtgtgtgtgtgtgtgtgtgtgtgtgtgttagggtacactagtgcatctaaaaagttcagatcattaaattcttgttctgtaactctcaaatttgtttccactcccaacacacctgagggatatgagacactcatctcaataaaaatagttcccagagaggggcttgggaggcacacatcattcactggatcctgccattcgaaaagcctcccaggtagttttaataatgcagcccacaccccttgtgggtgaggcaacagcagtatgaaccccaccgtacactcgaggttgagtatcactaatctagtaaagcattcagtatcctatggatctacgccacatggcatcttctgttcccaggttgtgtccagctccaggcccttattcaaccctcttctaaagttaaagaggcccatttttttcatttgcttctgagcttggataagaaaagaaacaaagataggatgacaccacttccctctaggtcagatgagcagggccacctgtattccagcagaggaggtggctatccactaagtgcagtctctgttggggctaaatgaacctccccaactgatgccagcatctcctttgcaaagacaaatcccatttaattccacaattagtgatcctgaaggaaataaaatgctcctctgacttaaacacagacatactaacatagagatagctgacaacacctagatcccttgcatcaggttttgattaggagaacacttaggaatacaaggactggagaggctgacacaggaggagcaagactgaagaaagtggtaaatggggctgcatggaagatgttgtctccttcacattttagttcaggaagatactgcaggtaaaatacatggccttcctaaagttgtccaaaaaaaggaaactgagacatttagggatcacttccaaatttggcccaaatattttccataaaattttaaacacatcgcaatcacattcttaaaaccccaatttatgtttattgttgagtaggacagtgagtaagttcatgaattaagaccctgtttgtattccttatgatcaaggttcattgcatatcttcagtggagatgctctaccttctttaactccattatctgggaataactagcaatacattaatttctgggcatatttttagattctgtgggtcttttgctaccctgaaagggcctaagcttgagaaaactgtcctaaaacttacttttactcaagtcataacctttggaaaattagtatttaagaaaagtattatttttcaaaaaggagctatatgccaatctccaatgcattaactgctaatcattcctctgataactattctaatatttcatgtccatcctagcatatatgtataaacagaagtcatccatacatagagtagacaattttctatcccaattgctttataattaatactacaaatggagtgcttcctgaaagtcacataaaaatcaaactaaagtagcataagttgctattatctaattcacattcttatggttccagaatcacctgtaagatggactaggcactgacatctcactgacggacttttgaattacagacgattttcaagtccaataacttggttaataactagatttgcttctgtaggttaaacgcgcactctggaccagtgaaccgatcatgttagtcatgacatctaccataacagcaccccctcctggcgataagtgacccacccactccctgcacttcagttaagggtagcaagagctgccctttcatgtgttggtgggtgtctcaagagatggcctggggcattggactctgcccagagagtcagtagtaaccctctcacccagtcagatggggtccctccagaattacccaagaaattaagagaactaaccagtcagtgagggaagaatagagaagagagaagccagatccccgctgcataaaaacaaaacaccctcttgccttcaggtggcctggagtttccttcaatagcccaaaaaaccaaaggacatgaccaggtcctgatggaagccttcctgcattttctcattaaatatacccaacaatctaacacaatcttattattcccattttgcagattggctgattctatggcaaaaaaaaaaaaaaaatgcaaacaagcttggaaaacctcatatgaataccttatctcctccaccacactcctcaaatctttgcccacttttggctgggcaccaggctacaggaaacagccaggattcacaggaattacaatggtattgacaggaacccgaattggtttataaggagagggaaaccaaaaggagaagattcttaggaaacttttcctctcctctaaaagtgatgtttttgaaccacagttgctaagttaaaaatagaaaagagatgccttggagcaggtgaggagggagttcaaatcagagagaagagttacagaaatgtctgagctggacaccaacccagagcagaaaatgccatatggcacagaaccggggtagctgggaggaatactagatcccaagatgtgggaggaagcctggagaattctggttccacatcttccctctaagcaaggagtccctcttactaagagaaatggttaacaactgcctagtttcccttgaaggtttccagaaatggagaactagagcaactctggctacatgttttaattgtgtccttctcactgtcaagaggcgcttcttaatgtcctgctcaaatgtctccagcacaccctgaagcctgtttgtgcctcttcagtactccttagacgcagagagcttctgcttagcatcctccttatttgagaaaatttcatctatctgaaaatagccattaagttgcctcataccattttctcttctaaactagggaaatccatacagaggctgcacagccactcaagggggtgttacaaagaggattccagtgccatgagtgggccagactagatgtgcctctgagatatctgccaagccagaaatcctttgattcaattcctttcatcttttgtgtgacatttcccatcactttgttcacatttgtcacaatacctgtcatctgtccaacttctccatattcttttaatatttctaaatctaatgtgcataggaccttttttttttcttttttttttttttgagacagagtcttgctctgttgcccaggctggagtgcagtggcatgatctcggctcatcgcaacctccacctcccaggttcaagcgattctcctccctcagcctcccaagtagctgggactacaagcgtgtgccactatgccgggctaattttttgtatctttttagtagagacggggtttcaccgtgttagccaggatggtctcaatctcctgacctcatgatccgcccgccttggcctcccaaagtgctgggattacaggcgtgagccactgcacccagccaggaaccatttttcacaatataaaacaaaggctcattaattcagattaagttgaaaaattcatgtccccctgagtaagaaaccagagtgaaagtattttcaattaaacaaattatgtctattacaaaagactacatattggttattaataaataaaatgagaaagttaatgaaaatggtgagttaacaataactttatttttactgcactttatacttttcaaagtatttttacatatattattccatatttccaattttattcaatatgtaaatgcaacatatgggtaatagatcaccaaacctaaatcaaaaagtctaatttatcctgctaaatttgaacttttaatgcaataagaattatatataattattccaagtctgtatcagagcagtctgaattaataaggttctgctctattgtagttataataagcctgacaattttatgaccatctcatctcccagagtgtcactcccatctacacattagtaataaatactgtttcttcatgaacaaacttttgtcataacagagcatcccaccttaaagaagtttcactcagtaaattaaatagctcaaataccatagaaatgttttccatgataaatgcgctgagttcattattctcttcaaaaatgcttgtttaatttaaaatgagcctaacaaagaggttatcccaagatgacaaggacccaatatatcacagaacttttcacctttctctttgttcaggaaaaaaaaaaaagagtcaaaattaatccagttaattgtaagtaatggaactaaaccaatacatgtagaatgccccatatagaatgtcccatttgaggaacctggtaacaccaaaagggtctatgagcaccttcaccatcttcactttcttcttaaacctgcagtaggagtcatagcatttcattgttctttcacaatggtcagaaagacaatgcctttacctaccttaaaaagtcttaaaatgttagcaaccatgatggacacggagcttgctgcagcacctatgacgccagaaatcttgtcgggcttggtgaaaatgggtggatctccattagcacacttcacatccgaagcatctttctctattaatgcctgcacgaatgttagagactgctccaaagcataggtgtccctagagcacgtgtcgaggatgcggacacccagagtgatgttggaaaggagatcagggtccttgttaatctggtcaattgcataaagcatggcctccagtctgtgaatccccttttccttcttcagctccccacaaggcacccctctctctccctttgcgtggacagggaagagaccccccaaaataatgtccccatccacccgtatggaatgggcatactcctggctgtgagttctttgcatcattgtgaggatccagtagaacttggcggtcaagaggaagaaacaagggcaagaggctgatcgctttccctcgcataccattttctccacaggtggtattgcaatccaagacccaaagtttattcttgccacagaagaaagggcaccacctgaggctgcaccttctggaggctaccatcagggcccatggggaaaaggctctgtgggcattagcaagttttcttgatttgaatgtcacagtgaatttccatcagacccctaaggttcaattttatttccttataagatcaacttgcctggaatggtgcaaaaattagaacatctgaggttctgatgttgggatgaggtcaacaattcatgtccttgaaatcagccttgtagcagaattattcctgggaagaggggaaaaaagggggttcagttcagtgggtctacatgtttcacattttgcagccctgtttacgccagcctcttaaaaaaaaaatcccctattcagtaagaaactaattctttttgtccccctgtgattctgaacacctggctgcactgcatctaaacagggagattgatcatatttttggagcaagagaaacagaacagtatcaggaagtaggttgattctcccaaaccagaaagcacttttatttatcatcttatttcaataaaccttatttccatgaaggtaaaaatcctgcaactgatggcaccatttcttttcaaatctgttttttttttttgcagctatctgaatttagcattctaattttgtcaacaaaatcataataaatattattttctgtgatgtattcaacaagccagtcatctgttaatgactttttttttagtgcctcaaattacccagtaggaaaaagtgattattcaattacaaagtgaaagagagaaagaaatccacccaaagagctaaaaaatgtgtaagttttgtagcttgtgaaaaaaaattaacatagaaagtcagctatttcatataaattgtcttattctctggtaagaaaacaaagacttgaaaatgaaacacacaggtaaggtgacatgtgaagatattcctattaccattgtcagggtttccaattaatttgtcggtgtgggagcaatgggtatattaacagttctgagggaaacatgccttgatcccagaatcactaggagcaaatcagagttgtcaatcaattgaagagctgcctaattttgcctgactcagtggggaaaagttcatcaagactagaaataacttgaagtgaaaaaggctacacgcaaatctacagacaaagcctttttcctacggccttcacccttaattccgtaagatttttttcaaacgacttttgaagagatgtgactgaaaatgagaactgacttaacacagggaatctgagatttgtaatgcacagctaattaagagaataaacagcaccaatttactttggcaggatggttaatctaatgctcatttctaacctatttatatatgggtttgaaacctgaaatttggacagttctcctgtaccctagccaaccaacatctgcttgtattttccattcacttgttcaagttccagttcataaaattttctttttatccttcttgccccgaaaggaaagatggtgcttccctgggggataactgaaaatatgcccaaacaccttcaaagaaagctgcattttttgcacttgcagattagaaaagagggctcatagcagcccactgccccatatttctgagcaaacacctggcagcctagccagccaatggcccactcggctgagatagttctgtgcagcctaagacaagtattccctgcctccgggcacacattaagccttagatttcctctgtgctgcccccaaaatactttctgatttttctcaccacttcactgtttagtccctcacactggattctcctagcagctgcttttccctcagaaaatctgtgattcaataacagcctgacctcaggcattccacaaaaggaaacactcagaaagtcaacctgattttctggatgaaaccatttaagtgataggccataaattacaccggccacccattaagagaagtaagattgtgtttaacagtttcacaaggaaaaccagtcacatgatagtaaaacctcattaactctgatcactagttgagaatttgagaccaattccacgtggctgagccgacccttgttctgacagagtacagactaaatgaataaataaggtgaaggagaaatgtctagggggagtggatgggtcttgggaccacctttcctctttacaccaagccatcccccaagtacttaaaacacttaagagaataaatggctttcaattatagacgaacatacaaacagcccatctgttcatcacaatgcatccttacctatccatgtggcattaacctagttccacttgctgtacagtccagaaagtaataaaattgagtcgcttttaaaattattggtaattgcagtattgtttactctctttggcatctcatagctttgtttggagctttaatttttaaaaaaagattggggaatgaatagcagtgaggcaggaatcagttttgtttagtggctgaatgcactgaaatggaaaactagaggttcagttttggtttcatttcagtttcatttattggacagctcacttgaatttttgctggagtttccgtctctggaacacagaattaattgcatgtaacctctctgaagcttgcttttcttgtctgtaaaggtgatagaacctgccacacagcacacatggaaagcatagtatctggctcattaaacaggagttattgttgctaacttagtctgtaattcattttctactggagcagagcaactctttctgtatttgcccagttggtgagcttttactgaatttcgtttgtcactttaaaaaataaaatcagagctacttataaaatatttaaatcttccatttatttcaaaatctgatacattgtcataaaaatcagactccactgccagaaggtttagtttccccttttaaaaaacctaaggaaaaatatatttgaaagtttgtgagaaactacatcagttaggtttcattgtataatcttaaattacttatcttgctcttgtacaattcttgtgagctttaatccaagctcatcctagtggagtctgtgagttttaaacaaatcacaatctttcagagctatagatccaaatacctctattgtatgttttgtgtttgatttaaagtataaacagctcctctctcaaactgacctgcctctgacatgtggcagaagcggggactgtgctggactgtttcaaggaggcgtgaggtctggactcctgaaaccaatctcagagggggacaaatcctctcagcactatgtctgggcccacagggagaggccgtggaaccctttggggaggcttaaccatgaaccctcatagcccttcctgtgcactcccccgccagcccacccttacttacagggcacatcatacatcattgggccctccatgggcagtcccctggcctaagactcctggaagcaggcaccctggctggaccccgagcctgtatccccctaaatgtgctctgtttcctaaaaggccagaaggatacctcctcactggccagagcccagaattctgctttattttctacacaccttctctgtaccagtgtcaagtatctaacacagtatctccataaattttcatacaccaggcattagctcttgtataaatgagaaaagaaggctcagagggattgaatatggccccaacccctgagagcgtgagctgataagtggcagtgccaccaaagtcatctgtcccagaaggtgggtcctgtccttggagaaagaccccagtgctgcagggactcactgtggcagcacaaggaaagggaatggccctgcccctccactgcaatctttcagaaaggtgcacatcttcaatgcttagctctggaagaacactaacatattaattaggaagggacaatctgggggcatttccagggaggtgatttctgaatctctcaaagggctgagaagatccaatgcggtttgtccaaacacttctgctccaaatgaggtctcctggccaggttgatgtcaaggtgatgtcaggtggaacacacccaccaacgcatgcagggtctctctgggtctgccatcacatcttccttgggcatttagcaggtatgattaaaatatgatagggtaaaatcctcactgaggaataccattatccaagaattgtaatttttttctcataaaaaggccaaagcagcattcctatgctgcattccattcagctctttaacaaaaaggttaagctgaatattctcatcaattcatatgactgctcacacttgcagctcttttggttgttttgaaaatgcatcgtatttctgtatcatctcccatgctgcaatatgtgtgcatgtctatggattcttggtggggcagagtgaggatggggcagacagagctctcccttggcaacagacgcttggaatcggatctttgtctgacagtcactggctggtaacactgaacatgtcccctcacccctatgtgcttccatttcctcatctgtgaaacgagtgagatggaccacgtgatctctaaggtgtcttccagcttcctattctgagattctattacttaataataagggaatatgagattatgctcaaacatcagagcaaggctttgccaactgaacacaataactgattttgtttgcaagttgagtgactttttttcatcagtgagaggattgtgaaagctcttctacacaagccagcctcatattttaaaaaatctgatacaggagaagctcgacttactaaacagataaattggaaagtaattatttgcattacagaagaattcaccacaggtttcctttaaatagctaaatcccaggcatttaaaaaaaaatctgatttaggagaattcaatttgtgcctttatttttccaataacacagctattgcacaaaaagaccatatttaaagtaatgagaagctactttttataatatgtatcagataagaagagagaaagtgggtgacatcaacacttactgattgcctgcagtgtgcctggagctgcagacacattatttcatttccctctaaaatacaactatgaggatggtatcacagcctccattcaggatctaaggaacctgaaaacagaaagattatatgactgtgtctaaagtctcaggcaagaattcaaatgcaggactgccattatgttccttcccttactccatgccccatgggggcaggaggccatgctggatctcaaactaaccctgatttgataatgaggactgggagtgagatgttctagagtcctaggagacactgattctagtcttacttcccccagtactcactgtatagcactgggcaagtcacttaaccagatctcagtttcttggtttctaaaatggggaatgattttcccccatctcccagtttgtgaaatccaacaatataatgtgtgtcaaagtactttataaactgccaagtgctataagaatgcacagggatactattagtctaacaatctgtcctagaactaaaatatgttactggtgtattgtacttagaagatctaagaaaaccactttctcatcacgcttgggtctagtcagaccttaacaacggtcacaggtccaaaaaaagtcaaccctggcaagcctatatggagagcacagagcttgaaggaaaactggaaaggacgcaagaagaagtcaatggaactaccatgcctgacctggaaaactaaaggtcatggacactgagcatctaaatcgctattctgaagaaagtggtgacaagataatctcctgttgtgaaaacaagacaaccggaaaccttcctaagttgtaggtacaatataatgcttctaccgctgggtcatgaccactggaaaagtcagccaataaatagccagcagctttctagctttaggcataaccctgcctggaaaagtatgaaattggcaacacatgtgtccaacaatctatactcctctgagggctctcctagatattcctacttctgttcacctcctgccctgccctgccctgcgctgacctccccagaactaggtctcttccttccctcagtgcctttgttctttcattaccttggccctccccagggagtgagtggattcattagcaggtatcaaagcctgaagatgcattactgtcatccccaaatggaacatctgcattctcaaaatgattcctaggagagccataatttatttaccaaagaaatatcaccattaataatggttaaggctagcaatgcaacaagccagagcagagagctaggagtcaggagcgtctcaacagtacctctcaaatcattccaacagcattgcccaccactgagaaagggtgtcctgggatgagacaatattatgctcagcgtccctcccagtgagtgggtgagtttgtcgcaatttgtcaaattaccaagtagaaatgaaaatcaaagaaaaaagagagaaagcccaaatctaaattccaattcctagcagaaagaaaaccctctcttgaaatggaaacaataagccagccaactctcagctcatagcctctcctgggaacaacatgaagtggccgtccctattgaatgaaccacatttgtgagtctggggatgcccagtcagagtctatcaagaaaacagcaagtttcctgaacctccgcaagccagccaacttgacagacatggagatgtggccaggtcttggctgtgggtccaggaagagagaaattcaagcagcatcttcttttaagacactgggacagagcaactccactccccccaactaaagcaaggtcatctttatgatgggcattctaactacctgagaaaggtggtaggaaggaaacttggaaggaaaaaaacatgtgtgtagtgtgctgtacatcgtgccctgaagacaatggaacattcatacacaaagattggcacgcaattgccaatgtgaatgtcagacgggttatttgctgcataaataccaattaaacaagccccgcagcagcttcaacctgctcagccaactttgaaaagagcacatctctccagacctctaactttctcctgcactcactggagctcagctcttccttttctctattccttttggatgtagatgtttttagaattattcaagcagccataactttcgaacggtgcataacagggcagaactagctagcacaatccaaacagaacaaattgagcctaaggaacagtatacagctgtgttctcagtatcttcttctttattccgggtcaattgtctcctacaaagcctcccgtcatctatttctccccacatcccttattcaaaagcaagaattctctatcttagacatggtacaacctgtagttgactctaaaatggaaaaattgcattttaaaaaaccttggttcattttccctgacggaggaagcttttcttttcaaaattatcaagccacacgttttcaagaaccagagaatgaattgcacacagctgattctgcctcctacagagatctttcacggtattattcacaagcaagtgaccaaggtaaactaaagtggtttctgtagccatttgcaattattgacaaacaatttcataacggaaagtggaaattacaggcaagtgcaataagctgtttatccacgatctacctgctggtggctctttttctctatttttctttcaagcaaaatacaagctaccataggaatgcttttctcccgttcatgatttttcttgtatctccaccaccaaccctgttttccagttctgtcagttggcaggatttgtattcaatcgcggtagtagcccagactctagtgtattcttgggtgttccagagactcccgcaccttcaggtttgtgggaaaggatcccccaaatggcaaataaggcactccctcccggggtgggacttgcttaggggacttaagggtttctgcaaccggcgagggggtctgttttcacccccgctatcttgggtgcgcagacactctctgacaccaggcttcacagtttgggccacgggggaagtaattccccagggaaccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttact

SEQ ID NO: 2636 - DNA, 16353 bp, Homo sapiens; identical to SEQ ID NO: 1897

SEQ ID NO: 2637 - DNA, 453234 bp, Homo sapiens
atcccaaactgcatttttattattttttaataaactttattctatattacaaataagttttttttgttctgaactgcaaaataggaatgccttatatttacatacacaggtatacaattaattataacaaaggtacagaagcttgcctttaccaagttacaactgggctccaatttaaatagcacaggtttcctttttaaaaactttttaatttttttttaatattttactaggatactcttctttaaaaatcaaaaccagaagaccctcttcttagagatctcatccacatacatttgaggctcattttaacactgttgtctaaagatatgctttgctttgttctaacaaagggtcaatgttcgaggtgggagctttagtttgaaacagaagtgggatggggctggaagggggtgactggaacagagataacctgccctacctccttcaacggcttctctatgtgactcaaagacccctgccggttccttaaaccacccttccatcctgtttctccccttctctagcatttgaagctcaactctgggtcctctggctgggccaaaacccctgcatcatccccacacgtcggctcgctgagccattgtctgttgtggtaccctggagttgctggttgctatggtaactcagcaggaccctgctggaagagatgggctggcccctacatgctaaagtggggaggagggcagtggcatccaatccttccttcccacctcagggcctggaggccttgttcctgctcaaagcagccaacacacgactaagcaaagaccgtatgtctcaaggacaccaggccaaggtagggagtggtgaggggagggctgtccattctaaaacacaaaatcgttggtttccgaatggaaacaagattctttgaggtaagctagcttttcattttaagaacagaaggtttaacaagtcaacaagctaactagaacgtcggggagggagaggaaaggaggacagacagatgagcacgtgtatcccatcttcgtcctgtgcctggattgcggctgacttctgtgcacgaaagtgttccttagtcctgtttggtgaagtggtctcggtttcttaagcgtcctttgggttgctctttaactgtatcctctgttttaaattctacttttgtaagggagcccttccaaaatgtgcttgagtcaaaagatcaaagatactaacaaaggaagttctaattccaaataaagaaattgctggaagaagagctgcatagaccaagtctacttgcttttgcaatcctggcggagggaaagcttgggtcttcccatgacccatccctcacagagcctccttaaagtttgaggaaagctgataagagatgtgtaggattcggcagtaccaggggcagcccagagagccaagcatagacatcaaagcgggtgggaatggaataaagtgaggctcccgcaacccaggattttcagcctacctgaatcacctcactacctctgccaatacaaacagaaagttctttttgtatatgaaggattttgtttcgttttgtttaactttgctttgctttctggtaggcaccagtctactcaaggaatttaatcgggatcctaatgagtatgtatttctcttacaaccaaaaaattctatatacttttaaaacttggatactccctctaataaaataattttatgggggagcaaaaatttgtagtaaaaaaaaaaaaactctctcttgcatgtctgaaacttttactgcagtggattactttccaaatgagaggagtggtcatttaggtttcctgtcaagagcatgccacccttagcaccatgaggagaggtttgcagagtgtcccagcctcattcgggagctgtgtcagtgttacctgaggctgtgtctcagctccccactctataaaataaggctcttgtttcctacatagagaatgcctgtagggtgaggtggcaggaggcggtaggagaaggactccatctgtcaaaagtgtggggaagcaccaggaatagcagcagccatgtgagatgccacccctagcattgtcctcatccagggaatgtcctgacccatttttttttttcaatgggggaggctcctcctgtcctctgaacctctcctcatccccttggaagtcataggttttgctcccactaaccgagtaatttggacttaacatccatagcagggctcccttcttactttcgaactattaagatatacaaacaaaaaccaaacaactccaaaatcccaaataaatggcccacagttttgttttgttttgttttttttaaaggaagaggctgagggttcaaggcctcccagtcacctgtcctgagagctggcaggaagaggggaagaggcccttgatgtagacgaggaccaggagggatggcggggggggatttggggcatggggagaagccagggcacggagctgcctggggtaggtcttctctgggggtcaggtgagctcctggaggtgactcagtcatggaaagaccccttgaaggccttgaagagctggctggggctgctcactgggctcactgttcctggaaggagcaggggaagttcccggagaggggcttctctgggccttgtgcctgcagagcaccttcctacctatgtctgtctgtctttccctcactgcttggctgtctgtgaggtgggaggtttgtccttgactgataacaatactggccctttgctcggttaagtatttgacttcacattactgtgtccccttggtcctgggaaagaagacagatggaaattgagcttttctttttaggtcacagagggtggtgctgagacctgggcccatcacagcatcgttcacggctctggaaacagtggtaaggattcttcttgcagtggaggtcatttgggaagtcattgcttgtggatcctcggatggggacccatagggccttggctagacgagggagctcctacagccaggaaggcagctttgggtggggtaggatggggctggggcagtcacagagggctgggctgagaggtctgagcagctcctgtactcaagtggataaatcgccctgggacagaggctatgtgtgcaggagagacacggtggaatgaggagggacagggaggatgctcgtggcaggaggagcacaggcagaagccagacatgcaacgggagacacggtaccagggacctggttgcatgggggaggtggagatgctgggccagtacatcaaccttcactgctggtgggcgcaggtagctgggcctgaggggaccaggtcagagacttttcctgtgggtaactcctgcttcttcctgggaacagtcctggacagtctgcctcaaactttgggatttatttaaaataacttctctttcacttgtagctcctcacaagcagccaagctcacttaccaggctgcgggtgcacaaggggtaggctttaggggctggctttgggtgcagggatcatgctgccattggaatgtaccttggcctgtgggacacttgggttatccactgttcccaaatttaaaaccatactgaaagaagaaggcaagaaaatattttcctgaggaagtaactggcatgatggccaccttcacttagtggcactatttgcagctaccaagaaatgtcagggtctctccttatggggaaggacaaagaatgggtaaaagctgcatctggggggacttgtggccaggagaaatgaccagcctaccactctgtttcttgtcttcctctacttattccttaaaatttaggaccccacaaagcccccttcttccctgctaccttaagcccttctctctccaacatgcaaaaaaaattcccacctaaactttgtcagtgattttgatggctcagtctggtaccattttccctgggagggtacgggataagttggaggggaaggtaaggaagatggccttttctctccttctgtctgctcatgactcaacataatggtgaccctacaaattaactttgcctcgagggaggccgtgaaggggcctccatcccacaggacaaagttggcccaattcctttctctgggagcccgcaagccacatggacagcccctggatgtttgctctgccagtggggtaaggaagatccctgggggagtttggaaaaaagatttgggtgggggatggggggcaaggacagctttttgacaatgttgcttgtctttgcttttaaataccatatcacacgtgcaccaagaatccaaacggaagaaatggaaaacaaacagcagaagataatttttataagcaagatgggctgtggctctggatacctggctcaaatttctcagtccccaagcaggccacggggactgcagcaaacagagcggcagaaacaacccacccaccaattaaagtcaaaccagccccaaacccctcccccaggagaaatggggacagccagaaaatttgtctgtccttgtctcctctttcttcctaacctttctatttctctgaggtgtttgaaatttttcttataacaaaaacatggaataaaataaagtcctgtaccgccaaagtaacaataacaataatcatcatccagtaaaaaataaaagcttcagcagaaccgtgataagtcttttttcttttttttttctgcttgtttgattttttctcttaactgtgcaaaaaaaaaaaaaaaaaatcaaaatgcactcactcatacacacgttcacacacgcagcttccatccagcaaatctgtgttaaatacgtttgtgtctctttcctccccaaccctttatatgtgcaaaaatattgtagtgaccgaggtacttcctcagaccgtctcccacatgtaccctttctggccttccaggtcctgtgactgacttcttgggagggaataaaatgatcaaggatagaaaagtcaagcttctccacctggtactgcacttgccaaaacctttggttatttattttttttcttcctcttccaatgcattgtttcccattttcctcttcccattaggttgctcatgtcttttccaccatctgtcctctgcgatgtcacatgatgccctgttccaaggtccaggcctcggcaggcgaccaccctgatttcctatggacaagcgccctctccttccacccaccagctctcagcatagaaagcaagtaagtgttgaaatgtcctgaagctgcaggatgaatggatgagcaaggggaaagagaaggggaacacttcaaaaatcctcctacaaaggacaagaaatccttttgagctttccgcctacacctggggcagacacacacacacacatacatgtgctcacacacatgtgcacatattcatatccaaaggggcaagtgttcttaaaagtaccggatgctccatggactttgctggaaatggtgtggtttcttccccaaggggggctcattctgagtgggtgacaaggaatgatgtctgatgtttggggagtgaaggcaagactgtgaatccttctcctcaacctcacctaagatgtttctccttgtctcccatagtggtgaacaactccagagcagaggtgccaacagagactcctgcttaggatgggagactgcaccagacagcacctaaggtctccttaggatgaaaggttcctagaaccctccattagaccatctctccccatagcctctgcttacctagtatcaatttctaggcacacatttgcctgcctggctaaaatcgtgcatctgtagatgtaagaacagatggggagatggatgccaaggccaaggtcatttgtatgtccctcttcttaattccagccaggcccatcagctcgactctttgtccctcccagatctgacaagctggaggctgaggttggctggcattttgggctgtctccgtgaggctttgcttaagtctgtttctttcaaggatgactgctgaagagatgaggaaggagaatgatgagagacagctgagatgttgatgaaatcattcccaaagaggtctggacagcccagtgacaaagtcatctgcatagcaatggcaccggattctgcagagggaacagggactaggctgttggccccagccgtctatggagttctcaggaaggatgatggggatggagccatggagatggctggaggtagaatctcctagatgcactctgcatttcacgttgacccttgatgaaggttgacaaaggagggtggagatagatgctttctcttgacagcactcagggctctggtagtggactagacctatgactatgattgtgactcatttgaatttgagggtaaatggaaaacaaattctgcttccagggtagatgcaactctctttccttttctccccctgtgttacatttctgctactaggattcagatgaaaaggtcaggagcatctccatggtggaatgtaattgctattctttctcctgcctggctttctactggcgggggagcaggcagggcaggcaggtccctctggagacctggaaaaggacaggaagcctctggacaccagcccagtgggggagaaggagcctcaaggagcacctcccagctgcccacacatgccctgctccagccacatgcaggaggtgtagcctttcttctcacagctgcaaagcgatcagaccactggctgaaccactggagatggaactgtgggaagggagagccaggtgatgtcttcccagtaaagataatactgaagtccttccttgcctcttccctaggccaaggctcagaccaaagcaggggctgccaaagtggaaggtgaagtagcagcacagaaatgtcccctgtccctggctcctcattcgttatttgcaccctgctgctgacatgcacagggtcaggagcacctgggagacagaggcctctctgacatcttctggtcagctcccttgccatgggcctggccattcttggactaactgagggtcagtggcttggtccaatcgtgttggcagagcaactggaagagaagagatccaggaaggagggagaaacggaaagaggcagagagaaagagagagaaacagcgctgctcaggggatgctgctgatgccagtcggaacttgcacttggtaaagatgataatctagactgaggcacggcttggtgtgtccccctccagggcggccctggaaggacggttctcagctgtctaagctcatgagggttatgacttgttctagtttgtaggccagtttctgcttcccacactggtcatcgtggtccagaggtccaaggatctgcggaagggccaagaacagggagattactcatttgtgtgtacaggtctgtgttctcaggaggcacaaagatggtgtggatgtggtcagaagcccgggaagccacaggcatgtgcaggggcacacaggacactgcggggtaggaggagacctggggagcatgggcaggaagttgtggcaggcatagcatgtgagcatcagcatggcagtgagcacaggatgccagcacacacagtcatgtctgaatgactgtgtgcattctactggctacaaaagatggtagacagagggcagaagctctgctgaaagtgcctgtgccgagatgctgcagttacctgcaggttagacagcagctagttccatatccgatggaaatgcgtagtgctcagcatggagccggaatgtgatttcatggatgttaagacatcccacccttcctcccgcagaaataaaaatccatcagctccttgaggccccaaattctacatttagaaagtcatttgttttcactttgcctgttaaaaaacaaatgtccctagaagagtaagactacaagctttcctggtcattaacacctaatggataatgtctaccaaagccttttctgaaggcaggcagttagcagaggacaatgacagccagcaaatgtggcccatgatgaaaaatatgctagaattttactcagactcaggagatgagggatggagtaaaggctctgccagtttctagcttggtgatctgaggccaaacaggtaacctgtctgaacactcaacgtcctcaactgttaatgtaggaatgactaatccacctccaggggagaggatgtcagataacatctgtgagcaccctcaacacaaggcctgccccccgagaggcactagacaattgggtggaacctactgatgttgtagtttgaggggcagggaaaagaagggagggcaaggagatgagaaggaggctcaagggaggcgcccagggctttggatttcatgacccagttaatgtttctttagttgtggaagcaggatagagctggccaagaactgtcatttgtacgcgccatcatttcatagatgggttatttaaacaccaaggtagacaggtgtacttgtagactaacagagaatcctttctgagaggagacggttggaatattacactggtgcacactatagcatccttattatcttgcattgccgcaggcaggggaaaactctgccccagaccaatactaacctgcagactggcatcagggtccctcccctaagggacccagcactggctctcccatgatgtaagggccacagaattaggctgttcatggcctgcaggactccaggccttgggcctgctgggtctgcttctttaactgggggttcctggactctccttaagtgatgaggatgggaggaaatagagaactcggggcacaagcttcagcttctcttactaccgtccactcagagaaggtggctatgctgctgctcagatgcagggaatttggattccaaggatggccagacccatggcaagagagctgactagaagcccaggaagacacaggcctcctcctacccagcagtgtcgtgtgtgcccctgcacatgcctgtgtcttcctgagcttcctgggctgatcagaagatgtctgaggggcctctctctcccagctgctcctgaccccatgcataggcaagaaaactcccaaagcaccatggcactggccagaaagaaggccttgtatatagtggcaatgaccccaggtgggattttccagtgagggaacaaaacagaaaacacattctatttgttctgttctgttctgttctgttctgttctgttctgttctgttctgttctgttctgttctgttctgttctgttctgttctgttctgctctgctctgctctgctctgctctattcttttctattctattctattctattctattctattctattctattctattctattctattctattctactccgttccattccattccattctattctattccattctgttttgactcacttctgtttcatttctagtctattctgtttctattctattctacaacataccatatcataccatacaatgccataccacatagccggcccataggagtgaggaggtgcctgtttaaagagagttagatcagagaaagatgtggaaaacataaaaaagaagaaatacaggagagaaaataagaattaaaaaagacaatataaaagaaacaggtacttatttacatatctaagaagcacagggatgaatgcagaatttatgggatggagggtttctagcatcccagcctttggatcacagccccaggtcctcagtggtggttcccccagcagaggtggatgtgtctgtggcgatgatctcttatacggaggcatgcagggttgtcttcattctcttcccccttccatcccaatgggcctggagcagggcaaagcttacctcctcgctgtatttgcccacataggagaagatctctgagagtgcactcatggtgttgaactcattcatgtgcatccgggactgctcagccaggtatgcgttcatgtcttggtcgctgatggctggcatcttccctatgtctgagtaatacctgtggagggatggaaatagggagaagctgaagtcgtgcatacggagtagaggagagatggatgctcccagcaccgtgtctggggccatgagctcagcttgcactgcaggtagtgggtacttgtgctgtggccacctggggaccactgtggtctctctctcatctgggttgctgggtccgaaccaggaagagccctctgcagctctggatgcaggaggcatagagggaagggatttggggagtggccaagacaggagaggaaccgagagccagagggtcccaactcgggcatcctctttgctctcagctaccacacagagaggtctagactgtcttgagtttctctaacgcccctcccacagacgcaagggatctcctccagcagggcccgaaggctcttccgagcggttgctcttctctgatgtcctccactctctgggggctaaatgggaggaggcagggctgaggctactcagggagagactggtagaaggcaatcagtcactgtcacttgcagctgtgcactgctgtcaactggttaagtagatgccagcatttacatttttaatttctgcaatttgacattttatgcaccaaacctcaactcccccaccagaggggggttgcgcagtttcttaatgaggaactgaaaggcctcagtgtccccaaagacagccacttctcaccctctcctatgtacttttgggcttgtggactgcataaaagagaagaggtaactgcaatgacaggagggcatcataaacctcaaggccttgtggtggcccagctcagcctagcccaatccagcccatgccaaatccctgtggctgccatgctggagaaagtaaacctgaaacctaggatcagaggggatgggggaggacagtctgcagggcagggactagggtgcatgaagcaaggcacctaggcaccaagtttaagaaaaggcactcactcttggggttgtgcaagtattggtgacaatgacagaccctgggagttctcagaacttgaatcttggtcagaggctccgggacagtctccttctgcaccccagccctgtgtctttcccagccctatccttcacttctccaaccaggaccctgtctgtcttgtgctgtttccctgacctctaactgttcccatcagtgcctaggaggtgggtgaagactggcagagatggttttcctgtgccatctcagtcatcagctcaagggcctgcaatggaatgacagttcaatttgcaccagagcatccctgggctagtgagggctgggatggcttccctgctttgagccacagtggtactgggattgcagatctgttgttctgcctggaaaatggggaggcagagggagggagatgacagctgtgctccctggcaagggaaggggctggtcagaggggactcccctggccacataccagacactttctcaactgttttgctgaactggtagcattttggctgggcaggagcctgagacaggcaacaaggccaagggcgtaataacatggcctttctcagagcagcctgggtgttcagacaggccgccctgcccccgtctcatttgtatttccatccttcacatcttcttccattccccgcccctcctccaccttcagaaccctcagggcccagtaccccttcctgtttcattttgctttctttgctccatccccagaagagcctgttctcttcgaggcctgtgacccgccccaaaacacatcctcaggtacctcaggacacagggctctgagtaatttaacgacattccaggtataaaattgcagcgagacttgattcattgtaaccatttctggaatgcaataaatgccattgttccattttatagtgggacaccagagatttcagtagtagctcccaaccttgccattcccaaggagatttgtgtcattgtccccttagggatcccatgtctaccaagcaagatatgtttgtcaagtaaagggctatcttcacaggctttatttgtaaaaagtgtgaacaaataacctcactcacttttggtaccatggccagcagccagccacgcaactctggtaactcagctgagttccaagcttccaccagacaggtatactctgtcacctgtacacaatcagagcctctgaccaggtgaaaaacccaggttcccatggaaaggacacaactgtcatcaaaagcaaagactcctgtaatttctctcaccagctgtggaacctttcacagtaggcaggtggctctgtcaggctttttgcaaacagtgccagggaccttcttgctgcctttatagtccccgaggtgtaaggaatcctcggttaggggccactgtgtctgcagtgaagagaccatcactagggaaaaaaacagaagcccagcattctgccttcacagtgtcttgcctcatggtagcacactaaaagccctgtccatttctccaaagagaatatctagaagtatatatgtgtgtgtgagaaagacagagagagctgctggggtggagggcagggagttgagagtagggtaggacagggctggggccctgaccatctcatctagaggtcctgggtgacgtgcctctcctgaacacatcatcctctctctcaggtcaggtccttgctgggtagctcctgtctctttcctgttccctttgcactggggaggctggatcaaatcagggcacgtctgtggccacatactattgacaggtgggccaactgcatgacctcatcttcagcaagttctaaatcagctgagctgaatggccaccgacagcccagtgtctgtgggtgtggggcttaagtcttgctgagagtctaccctgtttttgatcctaagcctgcctgctgctaagtggtcccatcttctctgcagggctttgttgatgctgtcttgacccctcctgctcccccactcccactccctagccagcaccttgtgcctgacgctgactcatgcggcactacctctgccgggtgaaccttgcttccttctcgctcctgttgtgccggccccagtgctgggctcctccactgggaagccttactgatcaggaagaacacaattaggctctgttaaggaactttaaacaagcattctcatctgctggctgtgcattgaggaagggaaaggggaacctgggcccctgtgcttgaacttgctcctgtgggcattctgccttcaggtgagcccatctccaggaagtccttcaggacccctccgagctgccccaggcctgacctgctaagaaggagctggtcccaccactggccttccctggttctttttgctgagttgctcacagcagggaggaggccagcacccctgaggtcctgacatcaggcctctgggagcagccataaagatcagcaccccacagagccgcatcctccactgttggccagtctgcagggtcctagtctgtggatttctatggggtagtgggatgccagcagaaatcctgggcccagagagtgacagtgcgtatctcacatctgcctttaggttagctctgtagtgattgggaagatggtctccaatgccctaaactctttggaaaggacacagcgttggcattcctccacacacctcgaggatgaagatgcaggagtgaaagatatttccagcctgatgctctgatattcccaatatgtacctttcaaggccctgaacaagtcttttcctctgtgaatcatgggagggtctctctgggcccagcagaacgaggccccacaccctgacttccccactatgatgcttgtggggcctgctgagcatctgtgtggcctccctgaccacaggagctgcaaagaaagggtcaagttcaatgcatttcaagtacccaactcactcatgatggataccattaatgtttgacccatgaattaatgaatatgttaatgaaatgtctatatctcacctctagactatatcttgctcccagggtaagctgtcaccattttatgtatttgactggatggtttccataggaggcatatttaaatatttaaaattcttaaccttttttcatgccgtgacacacatgatagatgacattcaaatgtgtggcacactctagtccaaacccctgtggcctgctgtgactccattctacttacttcttaaaagctgactgatggcaagtgagtgaggccaatgttgctgcaagaatgacctttcaactcttccaagttaaaatcagaggaaatcaatcactactaaagtatgcaaatgttttgctactggtaatgacacaaaaactacaactaatcacaacacgccacttcatggtgatgacactgttgtgttttgtctgtaaggtgaaggtagtagttaactgctaattggaaaccaagagactcttctccctttttccagattcggccataagcaaaagcttaaattcttggatgaggggaatgaatactgggaatccacagtggggctacaaaccaccattattacaaggtacttggaggcaggaatgggaggggaggatgggtggggagatggtgggagggaggacaggtaggaggatgggtgggaggagagatcggagaagagatggaaaaatagatggcaggacaggagtgagggcaggtgggaggatggatgggaggacaggcgggacgatgggttagaggatgggtaagagaatgagtgagaggagagaagggagggcaggtgggaggacggatgagaggatgagtatgaggatggtggaaggatgggcgcaaagatgggtgagaggacagataagaagactggtgggagactagatggaaggatgagtgggggatgggtgggaggacagatgaaaagatgagtgggagggtaaagaatttctagaagactcaacatactggcagaatcatctatgccattcaaccaagagttattgaggcttcctgaatttatatgcttccctttttcacctgctctgaagagaggaccagccagggtaagccctattttttagttgtgatggtgcagaaaaccttccccaaatacatgcagagcacactccacagcagtgagcctctaagtaaaaagtcctgggaggactgtctccatttgaccaacagcaggggagcaaattcagaagtgaccaagccgtggccaggtcactctaccatcatcctcaactgcaggctgcaaatttccttggaatggggaggcgggagatcaggtgtgctgtggtcccaggtgaggtctgccctgccggactttactttcccctccagggagccaggcaagctcggaggatacctcctctgggagtgggagtggacgtggacttgtccctccatcaccaagtgaagaagaactctgggcttgacctcagccctgtctgtgctgttttctcgatctatctgtctttgtaccccggtcccgaaaaggagaaaagatttggggcttcaagtaagtgaaagatgactttcttgaaagtgtcagtggttgctaagacacgagtgggataggaaatggaaaccatcaaatcactcctaaaaataacccaatggactgagtttacttgtgacctgcagcagctgcatggcacaaacctcattgagcaccaagcagaaaggagaccacttgctcagcccatgcatgagcctcagctctgactatgcagcctgttcctgggaagtgtcctttatgcagacactttataaatgttcccagcccttcacagccctggtttccccttccccgcctggggcactatcacaatgacactgtggcactcggatgaccaacagcccagctgctgcctcttccccctctccctgctgaagaattggctgtccacatgggaggggctggagggcctgctcctggcagctctattgttgggagagtgagccactgtctacatagcaggaggtgagagcctgtctaggtgactcagacataatcagacactaggacaaaagagttagtttccttttggacagctgaggtggcatgtccaccacctgcatcagtaggaaaggaggagagggtatcaaagagcagaggggagagggaaaaacaaaatcaaacccttttagtgacactaatgcactgaggtggccaggactctactccctcttagttatttcctttttataagggaaggcaattttcaagtataaagacagaggctgtctctatcataggcaaaatgataaagttcattttgtcaccaagtcaagaacaccttctggactcttttactcttcaaaaggcaccatatctgagcttccctctaggtttcctatatttaagctacttagaataaagagaaagtctaaatgcaggactgccatgtagagttgcgcaggttattcactgcacaaaggtacttggacaagaggatgagctgggggtgacaaagcccatcattcagcaaactacgcacttggtgtggggctacctcattctgtaggaaggggcatctttcttaaaccatacagaggcaccatatgggttggcagaggccctgtctgaaagtaacgcaaataagtaggaaggttatttgggagtcagctaagaggcttgggatctagtttcatcttggttctttaaatcatcttgggcagattacttagccattctgcatgtatatttcttcaccttcatggcataaaaggagcttatagttcctgtcctctccctagtacagggcttctgtgatgaataaataaagcttcagctggttgcttagttcaggtgcttggcgtatggagctgatgtggctcagacaaaccattaaccttctttaccatgagtcgcactgccctaggaagagcccagccctgcggctcatagggggaccttcagtcacgagagctctgcaggacactgggatttgatcacaacgctgcaagaaccagggcattaagagctcatgcaagagtcaagggatggggagagtgagaaactgttcagacagtgacaaaggcatccccactgaatgctgggaactgccagccagacggtagcagatgggtagaggcctccagccttttctgcagcaatgatgtagtttggccccttgaagtgttatgatgacagtttttatttattttttggggggtgggtggtgaagatcagagctgggagccgcatctcctttctgggcctagaagacatttcagccactaggctccagggcctgttatctagggaagctgagctaccatggcaacctctggccaagttttcctattctggtttcaggggacagcagcactgggacttgggggtgtgggtgttgcagtggcaggattaggctttgtgaatgactcatctggaaacacagctggtttttgatggggaggggaccttttgttgagggagctgctggctccagcaaggggccctgacttggctccgtggcccagcactcacctctccacccaattcttgtagctggggatgtccttggcatacagcagcttgttggagggcgagtccttgcccagccggtgctctgacgtggagcaagagtccatgaaggtctgagccaccacagagaggcaggcgtctgtgatgctgttcttatggatgtcaaacacaaactgcgggttcttgatcatgttgacccaaaacctcaggggcaggctgcgtggaaggaagaggcagatggtcaggaaagacggggcagtggggctgtggtgtgggtaggaggggtctctggagaaggagagaagcctggggaactaatagaacttaagagccttctctatgctgcggatgggatgtgccagggaagggaggtgaggcaggtctgcagggccccaatttaccttccaggaaactgaggactggcaaggctgaataattcatccagagatataatgttggtaggtacttgagaggacttgatacccagccttgatggcagggctcatcatcttccctttggtctaaaaggcagccatgatgtatgctataaagcggaatttctaactctctgtctgtctgctcctaagcctggtacaagagcatctagttggcaaactgtaaggaattgcttggaatctaggctttgtatctgactctctgccatctactgtatgacttggcagaagtcacacccttcctccctgcctgggcctctcagcctactcctactggggctgagaagtacagtgtagctgactgatttttcatttctaagctggcacgcttgaaaacccacattcacccacctcatgggccccatcgtattccctccttcccctccagttggcacctcctgcccaccaggaactgtgcttgcaactggggatacagtgatgaatgagacacatcctctgctctcaagaagcctgcattctggtgggttcatggaaaggcagacatgaaatcaactacatgccgggaggactgttggtgctaggaccagggatgtgtagggtccagcatgggaccaagggaagcatcaagcctacccagagggcagtgtccagaatgccttcacaaagggggcacttgatggtgggagttttaaaacttgtgtaagtctttcctttcctttctttctttttctttctttcaatggagttttgctctgtcacccaagcgggagtgcagtggggcgatctcagctcattgcaacctctgcctcctgggttcaagcgattcttctgcctcagcctcctgagtagctgggactacaagcagccatcaccacactcagctaatttttatatttttagtatagatggggtttcatcatgttggccaggctgatcttgaactcctgatctcagttgatctgcccacctctgcatcccaaagtgttgagaatacaaggcgtgagccactgtgcctggcctgtgtgtttcttagcagggtgaggcctggaggaaggtggtggaggatgggctgcagacaggaaatctgcattaacaaagacaaagagggaaaagtgtgccctgcagtctgctattgtaagcctgttgcttataatgtcccaatcctgggaccttctgccccttttggctgtagccatccctgcaggctataatcctacggcttccaaccagcctgcttggacgcaggtgggaaagagggctaggcaccatgcaagggattgcttacttctttcctctgctcccacctctgcctcctgccatttcccctgatgttttattgttttggtggttgttctcactgatggtaatagttagaatattcattatgtgtttggcttgctcgttagaacttaaattctttgaattacatcatttcaatagaaccagtacaatatttctatacttgctctatctcccagcagccagcatgtacaaataacaaatgctattaatacaggaaaacctaatgttcaagactgccaatcagtcgacaaggatctattaagttcctacaaagtgtgcagggcgggactcaggcaggcagcattgaggtctgaaaatgtttggcggtgtttgcttcatccctggaaatccctaataggaaataatgggatggcacccaggaaagctcagacagccacaacacccaggtgaaagtaggggtcattccagctgcccagccttcctgacagctgggctcagagccctgaatgcaggactcacgacttccagctaacgaaatctctgtttacatcttcctgttgttccacaagttacaccaaggatagggactctgggagtccacatttgctctgccggttgtttcttccctatgcttcccggtcctcaagccagttttgctgacaggcacagcaaacagggaagccacagcacccacctgaggttcccgcctaatgaaatattagcatattattaacattagtggtggcactaatctctggttgattgcagccactcaggctaaatgagcaggaggtttatttaaaagagaagaggtagggaactgtggaagaagggggtggggagagggtgggttacaccttgggccaggaataaaaaaataatcacttttccatcagagacaattaactccaagtcaatatgcagatcttaaaattcccagactgtgtcttcctcagcatagcaatagatcaagtcagggttgggggaaagtgtcctcagggttgggggaaactgtctactttctgggatttcctttgctcagacctgagtacttggaagagctggcatccaagaagatttggctccactccaaggacattatggcacccctggaggtggccttgccccagcaggagggatggggtgaaaacaaatggtttagataccattgtaggtgatattcttgcactgtgctactaaaagcaggtagaaatgtttagaaagacccaactttctccagctaggaccgagagaagttctgggcagagcatttttttttaaaaatttcctgaaggctgctaacattcaatggaggcagtaagtaggaagactcactaacagaagcagattggtaggctggggacatgccccactgaacagctcccagtagtcacgccacaaagtctagaagagttaaacgcatcttacctaaaggcaggtcctgggagatatcagacccagcacagctttaaaaggaggaaatcgcatcacaaagttttgctacactgagtgagcaatctagatttttgagtcttatttcagaaaggttggaagaaccccagaacgaaggtcttctctcactaggagttaatatgggagcaaaccccatgctttggttctgtggtctcaaccttggttcctacctggtttttcatattcagcagggatagtctcttctcccggtgaagaggatgaggagccagagtatactacattgaatacagttttggtaccaaagcctgacttctgccttcatctgtgcattgctttggggcccagggctaggtgccagggtgcttcgctgagccctaatgctttgcccatcctagcagttgttggtgcgggcaacaggcccacactgcctcagaagaatgatctggggaagaagatctggaaaagctacagggaggcagttctggaagcaatgggacaaaggataagccagctttgcctcaggtagagctctcaaccagagaccaccttggctctgcatctcatcaataattattgagacccagctttatgcaagcttccgtactaagtgctgaatactgatgtgcgatcttgaaatttcaacctgaaatacaaattactcacaagtgaaaggaaggatgatccatgttaaaaggagagaggggatcataggggagaacacctagagtgtcaattagtacttggagaatcctgttgtctcaaaggaagacatagtggttaagggcaggtctcttcaccacacagagcttggaaaagagaagagagcaattgcttgaatagaataggaatgccctttgttcacctggctggttcctaagtgtgtttcaaaactgcttgcaagtcactgttagacattgcccttctaagatctggttgcacacgacacatcctccatcttccatagcatttgtcccacaccagcagacttccttgcctctcaccctcatctgtcagttcattgagggcaggggccatgtctgattagccccgtgtctagcataatcacaggcacccaggaggtacttggatgggagagtgtcctggccgtgacatttggcatatttttcttgcttcttcagctggttcaataaatgtttgttaactgactaagtgataggaaagaaagatgcacagacagatttgactagagggaagtaagagagggagtgagcacaaaaatctaggaagagtggatggggaggaccagagaatgtgcctgctcagagtccctgctgatgaaaacaggctctggccagcccttctcctggaggcccagagtcccaccaccattaacttgaggctgggtgggctcagggctcccgatgtgccccctgccctcccttcactcaccaattgctcttccaggtatggcggacgtgcgggtcatgaatgccatgtttatcagcctgctcatccaggaagtcaaacatgtacttgatggccaggggcagggcagagccacggtgtgccgtgctgaagatggtctcaaagaggtcatccacaaacttctgcagtgtgccctggagaggcaggatacgtccagacacagctcgactcacgtagttctgaggatggcttttaaaacctgcctcacagacctaggcaggggaggatggtatacagcccaccctacttgggtaaaattgggtaagtccatgcattaaatcattttttcccatttcatctgtctctaacagctttaaatttcccctgcacatggaaaagagatataacactgatgactggacctacgtaaggcttcctctgccaacaacacggtttggttgaacaccctctggcggtgttattttagcacttttcacaaatgctaatgaacactcacttggtcagagcagacaaacacaatctgctggctttgtttgggcattactcacactggctaatgaacagtgactcacttggctctgcagagagcagagctgagcccagtctcaggagtgaaagactagcactgcaggcaagcaacgtccccagaaccaggattagaaatggtgccggaggccagacacggtggctcatgcctgtaatcccaacttctgggaggctgaggcggacggatcatttgaggccaggagtttaagaccagcctggccaacatggtgaaaccccacctctactaaaaatacaaaaaaaaaaaaaaaaaaaaattagccaggcgtggtggtgcatgcttgtagtttcagctacttgggaggcaggaggattgtttgaacctgggaggaggaggttgcagtgagcagagattgcaccactgcacttcagcctgggtgacagaacaagactctgtctcaaaaaaaaaaaaaaaaaaaaaaaagaaaagatatggtgcctgggaagtcgtgatggagccccgacttccccaacttgagattgtagatgataccacagagaagaaatcattcttttataaggcatggcagaagaatgtgaaaagaggcagttagagtctcagtatttcagaagggcatggagaaggggtagaaacaaatcttcagattgcatgccaacactgatgtattggcagggtttgcctggagttctggattgagaaggattctgaggttcggtacggggaatggtcagcagtgcctcctggggtgggtaatagagtgggcaccagcatgaatgctgggtactggctactctggcatttctgtgggctgatgaagtccctctccatagcctctgggctccctgcacccagttctcaagtctgataccttagtggccaggagtcgggtcaggtagatttcagacaccatcttgctcccccggtccccctccttctggtctccgtgctcgtggttcttcactaggtgccacatcttgactccactctccaggtcaggagtgatcataggtgtccgtgagcggaggctgtcggggctgcccgtgtaccggatcatgttttctgccaaggcaaggatcaccccccgacatatgtgaggccacacagccttagcccatcacttaccatgcatcccttgctccggcagaagccaacgactgtctgatcattcctgccattggtcggtgctgtcaccttgccttggtttggtgcattccctgaaactgggatgcctttctcaccacctccaggaaactatctgtggctaattctacccactcagatctcccccttcttcctgtactctgcatcgtgtcaacccttaattattcaatttgtaaaaatataagcctgtacttttttaatgcttttccttgtaagagttctcaagtcacgtctcaggatgtgttctgtgcagccaattaagtacatacttaagagcaggtagcctgtctccctcaataaccgctgatcggatgagtaatcactgggtaacctgctcaccttcgtctgtcctcccctctggcctgcgccaattattcctgtttatttgctgaaattcctgccagtgtttgtgaagtgttgtgaaatgagtactgagcaggaaaaagaaatggcggtcctactgtgtgcaggcactattctctgtattcatctattgattatctagaatgatcctgttcagtcggtagatttttcagtctcttcttctggtaaataaataaataaccaaggctcatagtggtcagatgactagccccaaagcacacagatagggcagaacagggcttcttctggcttctaccccacctccagcaccctctcctcaccactgcagagcctcgcacctggtctgtacctgcactccactgcaaaataacagtggctcttacaaatcatttagcctctgtgcacctgagttataatgtactaatctgcataatagggggaaataataattatttaattcactagattgttatgaacatgatgtgagataatagctatcacacagcctggaagacattcatgaaagttggctttacttcttttgctcgtggatgaaggtcttgcttatgcatcagagtgcccgactgaaaccagggtcctcttcccccacctggctctcttccccgatggtcagcctgtctgatgccccatctcccctctccaagagtctcctgccttctggctatgctgctgtcatgacaacagctgctcaggacacccaggcctccctaggacactcggtgggatcttaccatatttacttgctgaggtcctggagacggtggagttgttcactgcgttataggctgtcacctgcttggacactaatgccaccacggaaccatctggcacctacagggaaaaagcttctcagggcctaggcacagcagctctgccactccaggaaataaggacaaatcatgatgaacttggcactaaggggaaattggtgccttgctggagaactaggggactttggaggctgtcagctttccttggagcagaacaagacacagatctggatactgacaagtattctgttttgtggcttctcttggagtaacttctggcaagagctcctccctagcattctcaatcccagtgcttccctggaagatgacccagccttaaatgcccagaggaacttctcaggagagccttccctggggactctgcccatgccctgcagaaagtgtgcatgtcaggatgctatctccaaagaggtcagggtttcctggtttcttggctgggagacaccaatttcctctggatcactaagggaacatggagtgctggtgaggggcttggtgtctacccctgttattccagggcaatgatttccagggcaagggacttgtagttggctagctcctcccctttccacattcccctcacctggtagtgggccagtgtgttcagtcgcttccaatcattctcaatcttggtggtgatgtcttcatcctgcaagatcatccttgccccacttccttgtcgccactctgccaaaagagcggtggcgtttcagagaggccctatgacccctcttgtggggaagctgaggaccctgtgtaggtacctatgcagtgctagctcaagggtgtgtccattgcaagtgctagcacatgctcctgcgaaaatggagtgccaaagctctcaacgcagagaggccctgagttccagttctggttctaagcccaacaaactatgtgaccaaaatggggctaacatcacttatccacccttgcccatctgcttgctgtgaatggctacatctgtaaaaagtaggtgctcaaaaagtattggccaaacaaaagaggcacataataaaacactaagctttgacaaagcatgaggcaaatgcaaagtggcatagttgtggtagcgtgacttgtttggaagctcttagagctgatgaaatcaaggctgtaggctcagtcactgaacagccccagacctgttccaggggtgtatcctacagggtgaaactggcaggtgtgtcacccttgtcagggagattgggtcaaagagtgtggaaaaaatcagcaaaacccattctcacgcccatgaacatcccattccctgcaaagtttatgtaaatgatatcaacgttgtaatctatccaacacctaattgtttgatgttacaaggatatatttacatccccatattattctcacgggtccaaacacctacaatacatgggcttactgatggatcacacatggaaatgggaggctgtttctcatcaaccaaatccccaccaccatacttggtacaaatcacgtgtaggtggagaagtgcacattcttatctcgaaatgtacacacatgaaaatccatgtgcatgtcagacacacataaactcatgcagcacacacatgtatgagctcacgcatccacacataccattctcatggacatataccagaaaggaaaaacagcctcttaaattcaaatgcaacgtgtgttccagccaagaagccagacgtttggtttccaggcagcccagatcctgctcaatgcctctcagatgctgatacttctgaaatgtgcaaagaatgctgggctcgttcagagtgtcgttagttgctggattaagtggcctggcagtcactgcttgacccaccagggatttcttcctatgtctcacagagccacatgttcagattctcttcctcgtttccctcctgccaaggctggtccatgaccagccacatttgtggcagagagcaccaattcctccctgcattgtgtatttgttgtggtctgtgctgccaaccccatttcacagatggcatgccctttggaatagcagagatgctcctaaaatctaagccccttgcctccagtccctggggctccagtccctggggcttccctgctgcctgatttacagcttagcatcatgtcaggtggtcaaaggaatgaaagcatagggactacatgcttgttcactggagcaagaagtctctggggaccatccatcccttagtcctgtggatgtcacagctgggattgctcatggtgattatggtctggggtggttagactaataggcaaaggggaaaatgcctcactgaggtatctggtcactagcgtttttgcttgttattgtgttgtttttttcttcagtttttttgttttgttttttattttatggaggtatgcatgcatgcacttttgagtggttggagcaaaggaagaggaatctctccaagctggccagacagctgatgtgctgtgcagttggatgctggtggacaccagtctgggttggggagtatacggcagtgagcctcccccacttgcatggtgagtggcacctggttaagtcagaggctacataggggtggaggaacagctttggggcacaacaaaaaaaaggagccagcattctgctttcctcatatttagggtagggagagggatgcaatgaactcagctctggacactaagtcctctggctgggcccaagggagtctcctccactgaagtgaccatggggcttgctaggactagaaggagaaggtgccagtggagagacagccctctagcttagcaactgcaagggcactgcttgctgataaagaattgtagcacatctcaggagcatctgaatgaataaaccacatggcctggccaactaggcaatgacagttggtgactgattctgggctccagggcaggtcttccaccatgatgcacaattccccttagagctgtgcagtgcacagcctgggcggccatactcaacaaccctggctgagtcatgcccggaaattatgagaatgagagtccacctacctccatgcccctatccaaaaagactgggtagagcatggtcatgtctccttgggaattatctcaaaaagtcaggaatgttttcccaaaagccaatatggagagagggggctggaatcaaggagtacacttagcttgcttttagatctctcaagcctattattttgttatgtcctagacagaaaaaaattgctatgtgctttttttctgaaatatcagaaaggtgaaagaataagaagaaaggagaaagaagaagagaaggaagaagacgaagaggaaaaagaggagaagaggatgaagaggaagaagaaggaggaggaggaagaagaaggaggaggaggaggaagaagaaggaggaggaagaaggaggaggaggaggaagaagaaggaggaggaggaggaagaagaaggaggaggaggagaaaggaggaggaggaggagaaaggaggaggaggaggaggaaggaggaggaggaggaggaggaaggaggaggaggaggaagaagaaggaggaggaggaggagaaaggaggaggaggaggaagaagaaggaggaggaggaggagaaaggaggaggaggagaaaggaggaggaggagaaaggaggaggaggagaaaggaggaggaggagaaaggaggaggagaaaggaggagagggagagggagggggagaaggggaaggagaggaaggagaggaagaagaggaagaagaagaaagtagtagttgaaattgttgttttgtagcatctacaacttagtcctgatgaaagagagcccagactgacgggcagctggtgtgggcagctccatccctgaggctttcaggaaagaagcaaggatcacaagaagcctacccagctgaacccagaatggaggagagagggtggagtataactggcgggcagccccacattccctggcacagaataattcaagtaggctgacaaggaaagccactccttaatgtcactcttctctacccaaattccttacttttaccctgttggccagaacccactttcacttccatacttacctgccctccttcctttcctgaaaccccttcttcaggccagttatggtctctattttccctaggctcatcacggaatgtctcaagaagatcagatagtgggcatgggctcagctttctggagcgctcttgcacgacttcctgaccttctctcaatagaaatctgagccatagagctctactgagtaaagcaggggccaggaaaagccaaggtcaaagaccatcgcaggtggcttccctctagcccaggaacagtgccctctcctaagctgcatggctgggctcataaaatctcatccccaccccagaagtaaagatcccaaggtcaggttgagtcagctgaggatgagacagccctgccaccttagatatgaaggccagcaccctggtcccctcacggtgtgcacgactggctgaatcagcctcaggaggccctctgtgagggcggtatctaattttgtgctgtgttgcatattcagtgtgtgcttagttttaataacagtaatgaaaataaatagaacccaggtcccccagtgcttgatccagccctcttttcaccagatgggctccttctgtcttgcctataaaaaatgtcactaaaaatatctctcttttgagtctctaccttgctccgtaggaggtgaccacattaggacagccaagaggcaatgtcgtagctcagccaatggccagcatcctcccgtgaaggctgagcctcttgggcattttttgcctgcctgtggggcacagtgagaagctggaaaatacctcccaggcatcaaatgctatgagatgctgagctcagagagagctgtagcaaatcctggggcagagtgactcctcacaaacaccttctcctacaaaagaggacacctacagtcccatctcacaagatgcatctcctgcagtctctgtggtgagaatccaggtccaggaggtgttgcagctccacgctcactcattcatcaaagaacacttgccatgtgcccccagtgtgctgggcatggccaactgggcatgagaggtagttaaacagggaaacgggataaaacataagcccttgcccttgaagactccttgtgtggagaggctgtgcaagagcctgctggtcagggcaggggtgagacagggaagaggagctatggggagctggtgggaaagggctgcccaggttaaattgtgaaggatgagtaggcgttcactggctggccagggggacaagtgttctggtccaaaggtggcactcatgttgtagttctagggatcgatgagtctgagcaggagaaagttgagaggctggagaggtgtagggaggtcaggagctaagttaagaaagatccagcatgccatgccaaggtgtctggagctgagctgaggccagggagacagagcggggaggggataaggagaggagagcattattagaggggcaaagaggcatgagccctgtcgggatggccacctttgtccaaagcagaagtggcagcgaggacctaagtgaaggtagtggggcaggggtgtgggtttcagggatgctcagaagatggccaggtcatgcctgtagagtctctaggaaggggagaggtagggggaccctggcctgcctccaagtgtgtggagatccatgtaattggcagtgggaagctgaggcatagataggaaagagatcctccacaggccaacctggaaggagatgcttgcatggaggaccccactggcctggctcttgaagagtcccctacctaccagtaggtgccatgctgagaggcaaactctccccagggtgcacagcacctgatagttctggccctcacagtgtagacatgcaggtgggcccaagggcacccacacatgtacacacacatgtgcacatgcaccttttccaccaggctggggacccttcaggctttgcaataaccccacttccagtcttcctatcatcatctctcctcagacccatcccaggaagcttcaggaagggctgctgaagaaaggaaagggtggaaggagccactaaccaggctaggtagagccagcaaaatcgacctgcacagtccacgcaggaccaccttcatgaccacatgcctggacctccacccctgccaccttttcttaccttgggggcactgtgaacaggttctcactaggagcacacaccagcactgcacagggcccactccaccctccaaaccccgggctgagaaggaggctgtagggggagacaagattctatggctctgcacgcctgtcagcaggtgaaacccaaggaaacacctgacagggagccctgagaccttcaacacctggccacgctgaagtgctgggagcaggcaccggagaagagctgggagagccaagagaagatcagagtgtatctgctaaaaaggtcagaaaattcacctgggagcaggaggggtgacatctaaaaacgttctgttttttttttttttttaattattgtgacagcaagtgtgacacctggtgcttaaaagaagaagttcctgaatagaagtgcattatttgcactgaaggtactagatctttgtaaactgtaaagtgctgtgcactggtcagttgttgctatttggggatgcctagagagcgaaaggcaaacgcaggctgagccccgcttcctgatttaagagagacaagctagaacttagtagatattcttgaatgtggaacacagggctctggcatggctccagacagtgtggtgggtcaaagaagagtttagagggcaggtggtgtcagtgggaaggagggaaggtgaccctggcactcatatgcatggcaccaagagaaaattgctagctctgacctctctcgcagcagctctgcccggcagccggatgccctgctccaggcaccaagcacaaaggacagacacactcacaatccaatttgttacatttccaccttccagggagagagggaggtgaaataaaaaataaagaaaaatcccattatctttatctgtccttcccatcaggtgcagaggaaaatgcaaactggggagacagctgctgtgaactctttatatttcactcagaagatagtgtatctttttattgcctacaggaattacttatttgaaaaaatatatcctttcagcttgctcgacttgagccacaagacagagagagggtggtggagttctgggggctattgatagagcatttgcattaaactacaggaacctctggaggtcacggacagtggcagaggggagaggaaatgggtcgcagaggagactgcgtgtgaacggaatgggagttctctccacctccctgctgtgtaacctgggcccaggcactgtgagaactcagagaactgagctgcagattctccatctgtgcaggggaagagaatggcaccagtgatttcccttgaggagtgaagggaggaggaaaaaaagctccttagttcagatagaaaaatgtcctgtctctgctagtctgctaagaagtggggaacatctcctaggcaccttggcacccccaagcctggcacagagctggccacagggtaggatcttctcgtgtttgttgaagagtttagtgatgcaaacaggtacctaccctgcccagatacctgtgggtggaaagggacattttaaacctggttgtggggacagcctcacgtgtagcagggggagtgctacctgggcactgtgccttagagctctgcctcagtcccaactcctcccgctgtggtcgctgtccttccccagcttccaacacattgcagtgaaggtgggccctgcggtttctgggatagttaattctacgtgtcaacttggctgggccacagtacccagatatttggtcacacattattcgatatgtttctgtgagggtgtctttctatgaaattaacatttatatcaggatggattttgaataaagcagatttctctccataatgtaggtgggccccatccaatcagttgaagtcctgactggaacaaaagactgacctcccttgagaaagtgggaattctgccagcagacagccttcagacttgaactgcaatgttgcctcctccctgggtctccagcctgccagccaaccctgcagattttcgacttgccagcctccataatcgtatgaccacttctttaaaatgaatctctctctctctctgtttctggacatacacacacacacacacacacacacacacacacacacacacacacacagacgcacacacgcacacaacccttgtttctatttctttggagaatccttactaacgcggtttcccatcttggctccttaatgcctgcacaagtctggcgagggagtagagggagaggagtgggagagctcgtctgagctctgaggagcaatgaatagacatgtcaggagtgagcagttaggcaaagccaggggccacagtgatgatgacaggcaggagccaaaagccaagcaagagccgggagggttgggctggatttacttgggacaatgacggggtggtgcaaaatgtctttgcttcttgcggagctggcctgggatgggtgctcctgccgtgccaggggctgggcatcaggagagggaaggcagcctttgctggatgctctcagcagtgggagaagaaagcacagcgggtgcggggagaaagtcggggggcatgctgtgctgtcttggtcctgtccagcccatggggctgagtgagtgccaatgtgctatgcgtccctttggcataaatagtcacaccttacatttgtaaattgctcttaggctttcaaagcactttcacctacatgatgggaacaacttgccttgcttctctctccctgtgggggctgtgattgaatagtgtggaaaaagcatttgggtctctgaggaggccccatttttcttgcgatgcaatctagctttggtaagaagaagcctagagctttgtaagcagctctaaactctagatttaaaaggaaaaaagggaacttctcagaagagcacccatcatggttgagcagggagatgttgctgagcagctcagtgtgatgccccttcccagtgagaggggggccctgaggttcaaactgccccaggcctctctttgtttctctctgctatctgtccctggtgtggggatcttattcctccaagtgtggcccagcagcaaatgtgatggcagagggatcctctctgtttgtttgggtgcctggagcttgaacattcatggtgagcactggagacctgtttcctctgggaagcgggtagcctttctctggcttgtgcagcctctggctggggagaccagccaccctcaggcaggtccttgttgcagagctgctcttgggcttcctttcatcatggcgggtggcaggagcgactgtgcctgctttgtctgctgctgtttccactccagatagtctagaactctggcttcaggaggctttgcatcccataaaagacttgccttgctgggcttgcactcccaggctttttaagggagtgatttaagggactctcaggacaaagttcacggggctgccttctgtgagcccctccatgggaaatcacctattcttaagcacagaagcacacatctcttcatgcagctgcatgcaggtgctccttctgtgttctggcacaactttgcaatctcagcttccagcatgaaggagcctgctcctatcacagctccccctcttggccccactctgtctggactctcctcccacctgaattgcattaaggaccctgcaaagctgaaggtgccccctgctatatggcccacagatgaaacaaaggaacagtgggtgctagctggttccactaccaaactcaattctccctggaaaaacccattaaggagtattccactcaattgtttggacgtggggaacacaaaaatcctccttccaggaactgttctctctcccactgggccgtaacagtttcctcaccccatgagtctgtgggctcttcatggcagcaaatcaaatgcacacagacacacaggtctggtctggctctaagggcacacatgtgagcacacacccatacccctccccaccaccatcacacattggcttcctctgtgtcccagaaacagcatactcagagacacctccacagtggagggagacacatgctcaccgaatctccctccctcaatatccaagctcagagcacagggccaaacaccttcagccaagagccaagagagaggaaatggggttaaatgaagaagtgagaatttagaggagttactacaacttcctgatcctaagactctttagacatcagaattcagagggagtggggtgaggcagtgggaggcaatgaaaattccctctggattctagaaaatagcatagatgcccgtctgtcttggatggcttagccaaagccagcttagaggccagatggatggattagaggtgtctgaggggtcctcccaccactatgttaccaggaatctccagatacgagcacatacacacatcaatgcttctccctccatggccagcatcaacaaacaggcacagacagtatccttgtattatcctcataatcagtgacagcagccaatacttactgaatgtgtacaatggatcacacactgcattaaagacgcttttacatgcatgatctcactgaattcttactacaaggcaggcactatgattatctccatttatagctaggaaactaaggcatacacaggttacttgaccagggacacacagctaggacttgacggcaccaggactcaaatctagatgtgtttgatgctggccctcaaggctggaaccacctctcttccccactggcctcttcagatcctggggctccccatgaggatttccccaggatggcatcctatgaaatgcttatgcaaaccataactggctctaagtacaggtggccctaaccagcatgcccttgtttatagaggctgggagatatattcatgtaacagctaaaatgtcagacttctctccagcaggctttcaaatctcattttccctatactttctctccattctctatcactgacccagatccctcaagctgtaggtattcagcaaaaattataggcatggaactgagcagaagggaagagcctcaggcaacaacagaggcggtggcaggaccttgggccgcaggagctcagacaagcggactctgcccttaaatccccttctttccagatatgactccttcatttcccacccctctgctattcaaaggaccccagaggcatgtcctgccaggcagatcaccaacagactaccaagtggcccgtggacccctctctgcaaactgttcactgaccagctctggtcaattccaagcaggccaggaaggcaaccccatgggctcctgcgggggtccagccatgcctgactccctccagccagtgattattcccctcagatctctaccccagccctgcctctgctgacaggagaaggtgaggtgtgttcaggagcagccacaaggacagcccctgggtggacagcctactcacccagatccatatctgcagctttgggccggtgggagcaaggcacattcttgaagatggcatccagaatcttctccttgacctgagtgatggtgtcacagttgaggatctttactgggacctcggggctgttggcattgtctgggctgacacagctcaggacctgaaggaaaggtggggagaggaagcatatgaaatggggtagcaggaaaagctcctagatccccagcagcaccctgggattccgtcctgaatggctcatcctctccaggatgggctagggaggagtagggtggctccaggccatctgtgctcccaccaagcccactgccctttcctgtccaggcaagcaggacaatgccttggcttcaatgtccttgagggagtgcgagctgcacacttcactccctgtcagaacaaacttcattaaaatcctgatttttcaaagggacaatgcccaagcatgtggaagcagtgaggggaaatttgcaacagaacagacaccagtgcatgcatgcacacgtgctatctctctcacatgcatacaggaggcagtgtctcagcggcacacccagaccctcgcccacttctgaaaccccctgcccatccatgtttgtctgtctccttcttgtcactccttcttggacacacacacacagaactaataggaatctggcttctttctccaaatatttcacaagcttcaatttttatgaaggtttcattcacctgattagaggttggcaaatctataagacacttaatgtattctttaaaaataaaaagatgccctttaaagattgcaggttcaggacacctgagattctttcgtggccctgaatagggcccctgtgttgggggaagaggcgactgcatagttcagggcctccatttctccttttggaactagtaggaaaagttgaaactgcttcaccaaattatctttttattttttttcctttaaaaagttctgggcttttcctttaaaaagaacaaggcttttcttctcttgctgttctcacagtgggatctttctacatcgacggcaccgtgtgggctcctgggtggactggaggggaacggggtgggtgctgtgcgtactggagtaagtgagggcacaagatccaaggcagagaggctgggcatcctaggggtactgatgccaagtggccctccccttctgggctcccgaactctccctcgggccctgctgccagagagccctctgtgtgtctctctccttctcggaactttcactccctctgtgcccccataagcatttcccaattgtcccatctggtttgcagagccagacagcagtctctctcccactccacccccttcttgctgcatgtggtggcaatcagaaccctgggctctgggcacctgcctttcattagcaactagactgctatgagctcaaatgcgaacatgcttattccattaagaaggggaagaaaaaaaaacccctgaaatctataaaaccaaactttcacactcaaaatgccctaacctgaaaacaatggtggagagactgctgcctcaagcgctccatgtgtgcctcctcccagctctcccctccttctaagagtcttctggccccttccctctgctcagcagccaggcaaagcctgacccttgggctgttctggcagcccctgctgtcctgtcctctgggccctggtggggcagctcagccttcccaagacagcaacacagcttgccctgggcttcctcctctgagggacccatggggcagaggctgccacctaaacgtaatcccctggcatttctaattgccgcaggaattcagcgtggcctcatgagaacaactccatggtgcacttcagggcaggagttggcgttctaaagtggaagcagtggccccacagaaggacagagcccctggccactggccaagctagagctccacccacaggttcccttcctccatgctccttggctagtttgtggacaagctgcctcatgatttctctgccagggaagtgcctctcaaacgctaatgtgaatagaagcacttgggggctttgttgagatacaaaatctgatctaggaggtctgggatggggcctgagattctgcatttttccaggttcccaggcaactagctagtgctcccaggttccccggtgggcatctagcgctctagcaggcttccaggtgcgcatctagaactctagcaggctcccgggcgggcacctagcaccctggcaggctcccgggcgggcacctagcgctctggcaggctcccgggcgggcacctagcgctctggcaagctcccaggtgggcatttagtgctctgacaggctaccaggtaggcatctagcattgcctggttccaggctcccacgtgggtacccagtgctctagtgggcttctaggtaggcatcttgcactctgcacccagatgttgctgatgttggtactagggtgctcccactggcatggtccttggccacaccagtccaagctccagcatcaatccaataaatcactaaacccctagaggcacacctgactgcaaagtggtacactcgctttctccccaagcctcttagagcctctccgtggttctctctcctgcccaagacaaggctacttttagcaggtccatagcactctgggctcctccagccaccgccgagttccaggactcgtctgcacgccctgtgtgctgctgtcctgcacgatttcttgccatctgtccacaccctgagggggctgctcccctgcacatgtgcaaatactttccccaggcctgaaggtggctattaaagctccctgtggccgtttcttctccaggcaaaacaattgcagtttctttcctctttcctcactgctcctgtcctcaagtgttcccacctaaatggatactggtccctgaaccactccaatttcctcacattctctttaagttgcggcacctgaaatcagctcagtgcactaccagtactgtggcctctggaacaaaggatgttgcaatttggggacagaacattattacaactgattgtgttggattcaatattgggagggtgctgaggagacaggaaagaaagggagtggaacgggggagacagggtggaagacatttacgcagtacttctatctcattaagaaatccattcaggtctctatttttggaagggttttccccctcttttccattttaatcggagcctctctctctctccttccaagcagacggtaactgccagaaagcaggggcctcattcacaggctgctcctttgaatcttcataacggagccaatccccacaaatctgttcagacgtctactgggattcccggggcttttggaaaatgagagtgggataggtggatcatggtcacagccttcccagccagcagggatggctttgttcagaggtgggaactgtctccccagctagccacaggctctggaatttgccctcagctcagagcagttggaggggttgtctgagaatcacactccctcccagtactacaatgccccagcctgctgtggctccctctcccgaccgctgcgtttgaacttcagtctgttccccgtcctcctcgttcccttctgtctctcttgcctccattcttgggtgccacttgcatatcacccccaacactcagcttttatcttttcatactccctccttccaagtcctctctttctcagagaaaaagggctggttggagatcactgtgatctccaaaaaatcccgagagtgagctccctgggtttgaaaggacagtgagcagcgagtggacgcacggtgacagtggggagaggcaagcggggcctgcgtgaccaagcactagtgcatgagtatgacgcgggcttcactgcctgttcatcttgtcccatctgatcctctgcacaacttcactctgagcaactatgattatccccactttagtcggttctgttggtgttctcattttttcagataaagagacccaaattcagagagattaggaacctgccccaattcaccctgttggtcgaaggcagagccagggctcaaatccaggtctgtctgatcccaaaggccatgctcttgaatgctaagccttggtgcctcctagggtagctgtttttgtcaggtgagggagcctgaccttgatggaggggatccccacgttccttcaacaactgccttgcaccactaggccaccttggccttgcgttatacagcttgggtcacagttgtatttgaacttagagcagaaggcagtgggggcttcagagctatgagtaactctttctagcttcctttcctctctgtcccccactctctgcctgcacggacctcttctgtaaagcgttgactctaagctgggaggacagaagagttcacctgggtcaagggctttgaccctataactggtgtggtcagaaacccccagttcattggctgaagtgtcactcaaatgtgtctgagctactggtccccaaatccaaatgccctggtgaaacagaacagaggaagtctggggtgatggacacagcgggagcacctggctgggcccacacagcagacacacctggagaggcagctgttcagcctttcagccatctccactgctgagcagggctacccaggatggaagcccgcctgtcaaagccccaggggaaacagatgggtgggctcaccagggttttgtagtcaatctgctggcggatgagcttgtcctcgctcaaggagtagcgggcctcgcccgtgatggcgtcaatggggcccttctccatctgctgcttgatggcacagaacagggagaagaggggctccccagcacactcctggaggtgagaagaacgtcattaggaggagctcttggaacactggagtgtacccccagtccctgcttctccaaagggctgcttccatcccctgccaagtccctgcacctgcccccacctgcttttatactcagctcttcaatctccttctctccatctcctcatccttcaggctggcattcctcctggctctttggaccacagggtcttttcccattctacccatttctcctttcctactgccgcctctccagggctctttcttcctcccccgctcccctcccctcctgccctcctctctgctctccctccccacctcaccccgctctctcagaggccccatccaaaggcagaggtcagtcctgggtggcaagaactccttagaacataagttaataattggaagctgagcctcttccacctcccaggcgcatccttggcttatctgccgcaacatgcggcttctgcaccggccggggggccttatcagcctcagtaagtctggggctgggagagggaagaggaaaagcagagaaataatgggcaaattgtttttaacttcaaaggaggattcagctttagggaccatgcagggcctctcagggctcatctatcccttgcccggcagtaggaaactagccttgggaagactgtgtctttggagctatgatggactgcaggcctctgtcttcctagacagtccatgataaggatgaattccatttcttgtggggttataagagccaggcccagtaagggaggactcgggggtgtggagcgatccccagtcaggctgcagagaatgaacgaggcaaggccagaaatacgtccacatccaaccctaccttgaggaacttgtagaggaggaaagtaaaccaattggtcagcatcttctcagccactgactcagtcctgtcagcagtcaccgagggaaccaacggaacaagacaaagaaagaagcagctggtcagagcccgtgggctgggaagggcaagggaggaattgtgcattgatcttgctgcttctagcgtttaggccaaaccttgcgatcctaatgaatatgagagtttcatggactcctagacgcccccataatggtaagacaagcttttcctacaaagctggaagatgacattttgggcagcaggctgtgggtgggattttggctggaacgccttagagcaccgctgtccaattgcacgttctgtgatgatgaaaattttctctacctgtgccatctaatatggcaaccaccggccacacatagctactgagcacttaaaatgtggcagcatgtctgaggaactgacactgaacttgtatttatttttaactaatttagatttaaatagtcacatgtggctcatagctatcctattagatagtataaccttagagaactttataggctagttgtgttcttttgggtgaaaaaaaaaaatcccaaatcctggggaggtaccaatttggcagggaataggaataaaggtggcaggagaagggttccatgtcagaaggtcagatggccaaactgagtccacagcctcagctaaaggctcccagcattcgccgcagcataaagccatatacccagctcagcccaagccgtgttaaaactgtcctattgcggctgggcacggtggctcttgcctgtaatcccagcactttaggaggccaaggcaggcagatcatgaggtcaacagatcaagaccatcctggccaacatggtgaaaccccctctctactaaaaacacaaaaattagctgggcgtggtggcacgtgcctgtaaccccagctacttgggaggctgaggcaggagaatcgcttgaacccaggaggtggaggttgcagtgagccaagatcttgccactgcactccagcctggcgacagagtgagactccgtctcaaaaacaaacgaacaaagaaacaaacaagaaactgtcctatggcaaaagattccacatcctttggaacttcccttgggagcccttctagagtttcatttgcaatgacagaaagttcattcttgagtctaacttgcatctttcatgctacaacacaagcccatctactcttttactttggaagtgaagatgcagcagcagtgcagtcagcccaaggacattttcagttgcatccatttagagaaaacaaattacgttcaaacttgcactaagcatgcggccagctccagagagaaactagcccatccaggtatgtctggatagagtttaaagttgcagttgccagaaaatgctaataactaaaatcccaaggtagttgggaggctgccggcacaaaatgaagctggtaagagaaaagaagaaggaacattgaaaggaggtgggcagccgggggcaagaagaagaaaaggaaaggagggcagaaggaagcaagagcatccaggagaacaggaacggaaaacaaggggaggagacacagaggcagagcgagaccacgccagaaagttgtcggtgggagctctggcaggcagtggcaaccctagaattatgccagtgggtggctgcgtggtgaaagtaaaacaaaaatcaaaatgatctaccttgctgtttccaaagctgtctgctggctcttatatgcagcagacttttgcagctgtgcaggcaaatgcccactgctccaggaaaaaccctgaagtaaacacttctgaaagccaaatctatctgctggaccaagtgggagccactgaagctcagcctgagacccaaagaccaaagatggaagtctgggggacaggcagacagcaggcagacagcacatgagtggtctaggcagagggctggacataatgacatgacgtgggagttttctaacttcagatatgccaaggccaaaggtattggaataatggcctagaggagaaatggccttcgagtacacaaaaagttcaaacagaagcactggtagagtgagagagtttctaattcctataaggcgaaagtcataggataaggttatgtcttcacacaggacctttaaggtttcaacagtatcaagtttgaggcctccagggtgttgagtggtggactctgggcccatttacagcctacagcaggtgcgaggaaacacttgctgggctgtgctgggtgagacatcaccaaaggactttccttcagtgcttctcaaactttaatatggattgggataaactgggttcctcactaaaatgcaggttctgattcagcgggtctgggagggcctgaaattctgcatttatttatttattttttaatttttttttagcgacagggtcttgctctgttgcccaggctggagtgcagtggtgagatcatggctcactacagcctcaaactccagggcttaaaggatcctcctatcccagcctccagagtagctggaactttacaggtgtgcaccatcatgcatagctaatttttatattttattcttgtagagatgaggtctatgttgcctgctatgttgtccaggctggtcttgaactcctggcctcaagagatcctcctgccttggtctcccaaattgttgggatcacaggcatgagccactgcacctggcttgtgattctgcttttctaacaagctccagtgtgctcccgatgctgtcctctgccacctgatggcatgaggccacaggtcttctctcctagtccaactttggactcagataaggccagaggatggtctaagtgacctctgaagattccatgagaggagattgcagtagacagggtcaagattaagtagaagggcagagaaggaaaaatggagattcgacaaaggggcaagagaacaagagggtgagccaacaagtccatgcatccttgactcctgaggacagtggacaggttcttctaagggggcctgcaatgtagtcctggctctgggctagttagtgacttgaacttgggaacatggctgctctcctaggagctccacccgagtctccctgcaaggcacggtgagccaggtgcatggctaggctggagcagggtgccccagactgcaccctcacctcctgagcagcagcttagggtggttcttgctctccaggttcttgtcaatgaggtcggccagcagctgcttcagcacatcagtggcgtactccagcttgctctgcagcacggtcatgatgagtgaggccacgttgccacggtcgcgcatggagaagctacgctgggactcaagcgtgcggatgaaggacagcaggaacaccttgttgttgatgagctgggcgaagagcttcaggcctttctccacacgctcctgccggtagcccgggacctgcagagagacctaggagtcgtgatgccattggcaggttggggagctcagtgacctccccacgggatggctgtgcccatatccatgaccctctcatccaccaattaagccacagtccacctggctaatgctgtcaagcccttagcactgagttaagtatctgattaacctccatcgcagcctctagtttagagatgaatcaattgaagcacagagagagcatcacatggttagtaaatggcggggctaggatggcactcacttctgccggactccagagctcttccctgatggtgacgcagagttgatgagggcccctgtgtcatggcagagcacctcacagtccctgtggggaattccaggtgcccagggctgtcgtggtttacaccctgagaatccccatccctgagcctgggactaacctaatgcccacccctctccagccctaggggtgctgttgatacaccagtggcctcggagtcaggacatctgggttccacgtggattctgataccaccttgctgggtaactctgggtaagtctctttccttctctgggggcccaagtttatccacatgataaaaagggaagattgagcccaagagtctctaaagaacttcctaactctagcatttgctgttttcttagggactctctctaagaccctgctctatgcaggggaagaggaagaagatggtcttatctttctgcctccattgtctgttcattgggagatctctgcaagggtgtaccattcactcagcaaacacgagtcaatgactcaggtaggtgtggaaggcccacctctgagatgtccaggggtgtgcattgcaatcctgtcagtcacagctccaaactggaaacactcagatgtccagcaacaagagaacaggtggaggaattgtggtgtattccacccaatggataccacacagcaatgagaatgaatgacctattgctacacacaataacaggatgggtcctgcaaatgtactgaatgaaaaaagccagatgctaaagagggcatagtcttcatagaataccatttaaataaatattttaaaagcagataaaattaatcaatggttgtagagaaatgactgctctaggggatggctgtaactaaaagggggcaccccgggactcctgggggactggccatgttctgcttggtgctggcttgaggggtgctggcttgatgggcatgttcacttggggaaaagtcatcgagctgcacgctgacaatttgtgcgtgatttgtatgcatgcttctgttaaaccaaaagacgtacttaaaaagtcagctataggatctgcccccaagggggagcttctgagaacactgcagggtgtgtctcctgaagtggggcactggaggaggcagggagtgggagggacggcctggggaggtaacttcggagtcacgtcttgagggctctgtctccccaagggggtggataccacagttctttgagaaggagtgtcatgtatacagcagtaacgagcctggtttcagagtcggtcatgcttgggtttaattctgtcacagtcatttcctagggcccttagtgactcagtttcttcaccagcaaaatgaacataatgatagctaatactgatatagatctaagtccatactgccattctgtgtgctttagaaatactgacccacttaatgcacacagcaccaaaaaggtaggtttgttataatccccatgagggaccctgtgaggataaggagcttcacaaagccccaagacacagaagggtggaaggaggtcataaatcccggcacttggcacttctttctgccatctccagggaccatgatgtaaactgaaaggagagggggtatgaaaagctgatgcacatcccagctcctaaacagcagctacatcctcctgctctactcttgaggttttaaactgggaaaaatggagatggccagagaaagccttctttaaccaaagtcgcagagggtggcagaacattcatgatcctcattaccaataccctgtgttccaggctcagggcaaggcactggcaggaggccgggttcagtcagatccaggccctgtcctgagaagttcaaccaggaggccagccccagagagccctgagatcccttccatagcggagctctgtgagccagccctgcaccttgcacagaagggctgtcattgaaacctccaactagcccgtcatcagtagctcctatgggtctggaagctgtaggaaacgtgtgtgtttccaaatcaggtccattttcatttctctcactgtggtgctggtccttggagggccagttctcaggagacaaatgggaacagctagagataaacaggctacagcaggccacagcccctgctggcaaacccctcacctccggaggtgggactagcctctgctttcttcgtgcctgcctcccccagttctccccaccactgggggctgatgagggaaggacaactttaccttgccatcagcccgggcctcaatctgcccatttatctgtcttccaactctgtgaccacccccatcacatacatgccgctgtccttcaaattactcagaagagcagttctatgacttgttctaataatagtagataatgtcatttcttgggcatccaccatgtgcaatgcacagtgcctggcacattacacacattgtttcaatgaggccttctaatgatcttgcaaaactgagttaacaatctctcagagaagctattgcagctattccaaggcagcctatctcatgacaggcagtgctggattatgaaacccaaacttgtttggctcccaagtgcccgttcgtcctccccatctttcaccatatctagccctacccctgggcttgagagttgtctgaaagccaactcggatgtctctctaaagccttcccgtgcagggcctcccaccagctcagactggccggctaagggagggcagtcaccagaaggtttagcactatggcatttagagaggtggaagaggacatgggttggctagatagcacacttggtgtgaggatccactctgggattcttgcgaggctgccccttctctgtgtgcaaaatgcatatgcctcctgggaagcaggtctggggccctgggaaggaagattttagcaaagccacctacagtgaaatagcatcctattcagcagcatgggtcttagaagcagagagaccacagtgactcgtaggtggaggaaaactccatcacctctgggctctattgcctcgtctgtaaaatgagaatatgagtgtctatgtcataatgttttatgaacattaaataagataatgtatgtaaagtgcttggcatgcaccgtgcacacttaaacggcaacagttttattacctgcctttcagactccctggactgctttccagggatccctttcctccaagagtttcccagacatctagtgcatcagggtggtgttttggggtgtgggaggtaggaattttctccccactttatgaaggaaggagatggaagtgaagtgtcttggtcaggagtgtccaaaacagttcctcactgttgcctgccaccctccccagcccaagcaaatgctactctgaaacaagactttctttattcaccagatggttctctaatttagttgaagtctgtgagtataaaactggatagtaaattttaattgtaacccaataggttagagtttaggagccaatgatagactgaaattgggagattgactgctctgtgttttaaaaggttggtacatgaccagtgcctgggaagcacctttcttgaaggcctggacttaacccagagagccccacttgagggggctgggtgacctcccctccaggacagcctgaagcaagaggacacctccttcttcacacttccagaggtaagcaggaaccccagtggctgaaagggctgggaaacactggtttggattaatcaatggcttgtttccatacttagaacaccaagggggagaaactactccaggggcaagaaggggttggaaaaaaagcaaataagaaaaacagtgatccacacacaatccctcgatttcacatagaaggctggatctcacatagcccccggctaatgcgggccagtaaaagttctcagaaaatccaacttaaacatatgtaactaacctgcacattgtgcacatgtaccctaaaacttaaagtataataataataataataataataaagttacatctttaaaggaaacctacttagatttggaattttgaactcatgaagaaaggagaataactttatatactcatcctcattgcattcttatttaaattattctccatcccatccacagagtaatatgggaatgttcagacataatttcccgtcctacaacccccgtttccaccttaattcagccaaacacacagatattcatttattcaatcatttaccacttcccacatgcccattatgtgccaggcactctactctgctggaagttagaactacaaagataaataaggtacatgcacagtctacacatccaatcatacacacacacgtgcacacaatggtcttatcttcttgtccctcttgtgtctcactttaaacaggaatttgtatactctccagggccctaagagaatcctggtaatttgaagcaaacgaaggtgaggctggagaaaaataaaaggaagagaaaaatgagtaggactgggggaggagcaaagaccaggagcaagatcaaggaaatgggtagacaaaagtatcaggatacacgttatgtttttatttatgcacgggctacatctacacatgcatgcacacatacacgcacacaaacacacatatagacagagagaaaaggtgccttgtcgatgaggacatagagaccgtcacctccaacttatgaaagtgtctcttggtatctcttagctgaggagccaaagggagcctcctccagatagaaaagcccatgccctcaatatagaaacacacacaagcctatgcttcatgcaacaagcaagtatggagaaacgtgtgtgccacgaatgcccctctggacttctcacgtttgctacagaggtgcacagcctactacattcccttggacagcccacttagacattccctcaggtgtcggtacctgcaaacccacacagctcccgagtgatgggtctgtttttattttatggacaatgtaaatcttggaattaatcttagtttgcattgttgctttggctgtagatttttgatccatccaagctgtaaggcaggtcactgacatagctccccagaagtccagcacagaggcctgttgttggaagcaaagacactgaagtctaaatgcctgagctcaaatcttcctttggccgccaccagctgtgtggtcccaggcaaccactgaactctggccccttagttttgtcacctgtataatgggcttacttacttcagaggcttcttgggaggtgaaatgaatgaaagcatgcaaagggcttaaactgtgctaagatgttagtaatagtcaactcatagtgattattcctcaggattattattctgtcctggtcttttctcatttatatttttcacttttctctggtatttatctctgtaagccattccaaagccctttcaggacaaagtataatatgaatagacacctaagccagataccatgctagacagtaagtgggataaagtgttcaaaagatgaggtccctgctggtagaagagagggttatgatttctcattcacatttccaccccacttcccaacacatcgtttaccttttccaattaaacactaagtggtaaatcccatatatattgagtaccaactacgtgagtcaaatcccctacttcatggacccttaaccaaaggtccctgaggttccccaatgtatttgccgtgtttcttgtttctgtgcatatgtagttttttctggggagagggtcatcaactacttccattcaattctgaaagggctccatgatcctccaagacctgaagccctactcacatctctgctccaaggttccctggcttggccccacctcttccagagggatggactggtgctgacaatctgggggaccttgggcaagttgtgtcccctccctggccttagttttctcacctccgaaagaaggggctggacttgaagattgccaacacgctcccctgctctaatgccaggatggagcactgcttctcacctcaaggtcccggaggacagggtggtcttcaattcctgggaacagcacccgcatggtgtaagttctatagtccaggaacggaatcccggctccatccaggtcactggtcagctcatggatgtccgtctgcagctcggcaaaggctggcacgaagagaagcctgtgagatggctggatggggaggctccaggagtcacctccatctcagaatgctcagaacccttacccaagcccctaggagacatgagcaatggaccacgatgggcgggaataactggagaggctatgtttacatagctgggattgggatgaatgaatggcattagcatgggagaaagatgtagtgcaagaaaccttgtcttggggctaaaacctttccaaagtgtgatgatgtggggtggtggctgaggctgtccacagatctgtgctgctgcttggccaggagagactccccatctgaagatgaagggctttggtttgcaaaatatgctggggagggggatgtagagggatgggtaagagaagggagaggtgccatgaggaagagtccattcctgatgctgtgttttagaatagatttccttataagatgttaagaaaaactgataaaggaaaacaagtttaaagacacaagtctggaccatgcagctcatcagagccatcaaacttccaaatggggcagagatggaggctcagccacactaatatagtccttctgtataaataggcaaggtatttctttgtccttccttcctcaaggtgatgctacttgatggtgaattatgacctgcatgtgggcactgctgtgtgtggcggcagctcaggcctccagatgaacagagtggcaagaacccccaggaaagtgagcatgcagtagagcctcaggctgttacatagcaccaaagctgtcaccatattccgttctggaaacatcctcccccagggccaccctctgccacaggggtactcaggggtgaggcacccagcccttccctgctccgcctttctctttggtgtgtgcacacacacatatacgtgcatgcatgcacatggaccaccaggatggattaacacatgctggcaaagaagaacagccagtgggcattaactattaaaaaatatttctttctatttacataatctcaaaaatagggagaaaatattttgtgaactcagaagggatgaacaagcccaatgtggctctagagcctcaaaaagcaagcccagcgcccagtgagctgtgatgatcacagaaacacaatgcagccaccctaggaactgtctgcagggaccccagtcctgcccttgcccatgagttgggtggagctccacccagcagagcagacttcaggccctcaaattttggctttctgtgccaggagaatcccaagactgcttgtttgagagagccaaggggatgccacctggagagtcctctgcagcctctcctgctgctcctctctccctgcacccctgcacctctacactggccacacagacacaggggttcctgatatgtaggctgatttcaacagtagagaacccaaatgcatccaagtggagcctgcaccaatgtgtgtgtgcatgtgtttttggcatgtactgtcaccaaaagccctggggaacattcatgtgtgtcctgagtgaggaacatgggtgtgtatgcttataagagagtgtgggaacatgtgcatgagcataggtgtgggtgcatgggcacttgtctgagtgtgtatgtcagggagtgtatgtgagtgtgtgagtgtgacagtgtgtgagcatgtcagggagtgtgtgagtatgacagtgtgtgagcatgtcagggagtgtgtatgactgcatgtgtgtgtgtatgtcagtgagtgtgtaggcatgtgcaagtgtgaatgtcagtgtgtatgcatgtgtgaatgtgagtgcatggatgtgaatgaatgtatgtcaatgagtgtgtatgtgtgtgaatgtgagtgcctgcgtgggtgtgagtgcatgagtgtgtgtgtatgcttgtcagtgtgagtgtgcatatgtgtgttggtgtgtatgcaagtacgaatgtgagtgcatgtgtatgtctgtgtgtatgcatgtgtgagtgcatgcgtctatgtgtgcacgcatgtgtgaatgtgagtgcatgagtatgtgggcatgtgtgtgcacgcctgcaagttgagtgcgtgagtgtatgagtgtgcatgcatgtgtgcatgtgagtgcatgtgtatgcatgtgcaagtgtgagtgtgtaagtatatgtcagtgtgtgtgtacgaatgtgagtacatgagcgtgtgagcacatgagtgtatgtcagtgagtgtatgtatgtgaaagcatgagtgtgtgagcatgtcactatgtgtgggcatgtatgtgtgagtgcacgagtgagtgtatgtgagtgtgcatgcatgtgtgcatgtgagtgtatgtgtgagtccatgagtgtatgtcagtgagggtgtgtgggcctgtgtgggagtgtttgtaaatacacgggtatgtttatatatcagaagcttaggcccatgaagggcccagctgggtgtcttctgagtttgtgtagaggacgtcctggcttgctgtgaagtcttcaaggagaccccttggcttgggccagtgcagccctgtaaacgttcagtggctggctctgggcaagctgcaaagtgcctctgtggctagtctgacaagtcctttgctgtaagaccccttcttcctacgtgcacagcatagctcgcccctaaagtctgaagccaaggtttcctcctggggcctcagctgacaatcctgggtgggagctcccatcggctgctccctcccagttggggtgctcggcccacagggagcagaaggagggtgttggctttttatcagtctgcagctttcctttaagtcaccaagcgcctccaacattcaaagctgcgtgcctgccacacataaaagagattctaatcactacacctaattagaggaaagagtacattgcggagaaaaaaattaagcagcgtaaatataataaaaggcagtaattaacagtcccacaaggcggatgctgtgttgacagctgaaggatgtagagaggggatggaatggatccacttccccatcaaaaagagccgtggctgccctggtgggaatcggtgtgaagtgagagccccaggtatggggccggatttactccatgtacaaatctacagcaaagaaccagctcagatcctcccaggatgagtcacaaaatgatatcctgggggttacaagagtctgactcctaaatttccttcttggatttagtgcagctgatttcactttatggtggtgtttgtaatttttttaatacaagctttgaaacacccttccttctaaatcacagatcagccctacagccttaccttcctgctagaggaagaaagctggagattgctgaaatgcgtcatgttaagacacccccagacctcccctcgagtagagtgcaaaacccactcaaccaggattccaggtatggaggctgctctagtggggtgaaggtgctctagtggggtgaaggtgacaatcctgggtgggagctcccctcggctgccccctcccagttggggtgctcggcccacagggagcagaaggagggagttggctttttatcagtctgcagctttcctttaagtcaccaagcgcctccaacattcaaagctgtgtgcctgccacacataaaagagattctaatcactacaccttcaaggagagggcaaggagaccttggcctctctggtgttgccagggtggggcctgcttgggtatgggtgtggtctgggacacaggcatagggactatagagtgagaggctttgcaggtatgcaggtaggatgcacagcctccagcattgcccacagctgcctggcctgcttgcttgtaaatgaaacacatacacatacacatacacacacacacacacacttgtaaatgaaacacatacacacacacacacacacacacacacagcctccagcactgcccacagctgcctgggctgcttgcttgtaaatgaaacacatacacatacacatatatacacacacacacacacacacacacacacagcctccagcactgcccacagctgcctggcctgcttgcttgtaaatgaaacacatacgcatacacacacgtgcacacacacacagcctccagcactgcccacagctgcctggcctgcttgcttgtaaatgaaacacatacacatatacaggcgcgcgcgcacacacacacacacacacacacacggcctccagcactgctcacagctgcctggcctgcttgcttgtaaatgacacacatacacatacacgtgcgtgctcacacacgtgcgtgctcacacacacacacacacagcctccagcactgctcacagctgcctggcctgcttgcttgtaaatgaaacacatacacatacacacacacacgcgcacacagcctccagcactgctcacagttgcctggcctgcttgcttgtaaatggaacacatacacatacatacacacacatgcacacgcacacacagagcctccagcactgcccactgctgcccggcctgcttgcttgtacatgaaacatatacacatacacagatgcgcacgcacacagacacatatacagcctccagcactgctcactgctgcccggcctgcttgcttgtatatgaaacatatatacatacagatgtgcacacacacacatgcacacacacacattcgcacagacacacacaccgccagcctccagcactgcccactgctgcccagcctgcttgtttgtatatgaaacatatgcatacacatacacagatgtgcatgcacacacatatgcacacacgcacacacacatggcctccagcatggggccactcagtaccttccttgcactccagggccacacgggactccaggttgtccatctgcatctgcagccgcttcagcgtgaggtcactttcgcgggacttgcgtttataggcaatgagcacggccacgatgaaaatgatgaggaggccgccagccactgcgatgctgacgatggcgggcaggctgagcgggctgtccggggcaatgtacaccatccccggggagtactccatgccaccgacacgggcctgggggcacacagggcaagagggagctgggtgtggggacgcagcagctttggcaacagtcccaagttacccatgaactagtgaccagggcaggatgacggaaaggagaccaatcactggtgtcaaaatagacaagagggcatggggggctgggagcggggacaggcacagcttaacagagctcacccccaactggaaaaacctcacctcctcttattcaggagcgagttttgtcatcttcataagaaaacagcacacaactgggacctaaacacagtctgccacaaatgactggctcccctaagatttatgcccaatctaagggtggacaactgaagcacagaacatgatattaagatattacggaattccctgggccagcaacagccttctccttgaaggctttgtttgttgcaggtgatttagcaactatttaatgctgttttgcattttccttattgttgcaccagccagtgtggaaagaatgacaatacagaagagagaagctcaaaagtgaacatgaagaaagaacttggggtgtggggtagctacaggaaaagttctttgtgggacagaatcccctcttggaaagccttggtggcctgagctcacatctgcatccctactgcccgctccatccaggatggggttctgccagcctcaccatcactttgtgcctgccgatgaggttgggggactcgcagagcagctggacatctgacacggtcacggtgcacggcttctccccaaccagcacagtgtagttcagcttcacgttgcccccagccacaggcgggatcaggttcttgccctgtacaaatgggaaagcaccagttcccaccccagagtgaggaccacagctaccagctggctctcatgtcctcccacctggaggtcccatcccgctggtgagctggtgaagaagccacctttggtaataagtgcaaaaaatattcatggcatgactaccaccattgcctcttcctcccagtggctaatcagttatcaaagtactcctttcagcttatcccaaatgcagcctcagaatccttctcaatgcagagttggagtcagtcactaccaattgattcaaattgtcataagctttaattaacctgtaacccatgttccaaaggaagccctatgctgtggttcgcacaaggctgcctcagaggaagcagtgagcctgacctgccagtacttggactttcaggacaataaaagcttgagagtcaaatagccaaggtggatctgccttccctgggtagaaccggcccctaaagagagttttcttcccagtacagactcagagagaacatttatcacactctgggctacactgcaacctctgcaagagatgctggttgagaaatgtggcaggagtctgtgacttgaacacccccttccatgcagcagccccttcttttcccacccccgcctcccaccaccctcactccacctttaggatgatgggcgtgccaggcttgagctccaggattcctgagggaccaaaggcctcaaacaccgggttgggatagtaggtgaagttggtcttgttgaggatgagcagggactggacgttgtccaggatgaagccaaactcctcgggcctctcggtcaggtctgactggtggtcaggacccagagcgagggcgggcgcctgacaggtcatctcagtagcgttcagaacctcacagatctgtgggaggagccacagagtggagtctatgcagtatctccacatacccacagccccagtgcacatagtgggcctccctggatgtcatcgggatagcaaggggttgacaagaggattagagatgagtcagggccacacaattgggcactcaaggaataggctctatagcttgcacccagctccggttttgcccatagtgggtgtggcaatggctaggattggaagaatgcaagagtaaaggtataaaacccagggaaccccaaaagtaattactcctccatgtctataccccaagaagtaaaaatgcccttatgtcttcccccctattccactatcctagtattcaagggtgtcaggctgtgggttatcagtgtatgggcagggagttacctcagtacttgggaagacccacaccctttggggaagcaacgtgttgcatgggcagcctccatgaaccccatcagccctacactcacattgatgtgctccttccctccatgcttggcacggatctgggggttctgtatgaggtccaggtgggtcccccatacggcgatgggtgtgtttccactgagcaggaagaaagaaggagatgtgtaaatgataagttcaggaagagcaatggcactctacaatgatgactgagctatgacaataaggacagtgataactaggcagcagggtaatgttcatggggacaaggatgacaagctgactgcatagtaataaggatgagtatctcggcagccaaggggagggcagtaatgaccagatgtccgtggccatcctttgctgagtttgtttggagtatggacccccgtggaggcccagtcaacagcacagcccccttggctctccaaggcctcttgatttgtgccagctgcttctctgcaaccccttggtgtctcttcctccatccttcccctggtcctcaccaatcttgggactttttaaacattagctttggcctcatgaaagcctcgctccagattgtccccaccacatcctgcaggggctgagcacagtctgctcccccagggcaatcgttctataattttctatcttggaggcttcgatcaggctgagatctgggaaaggcagagggtccatgaatgcaaatgtgaatgcaagtgcgaaatgcttttggactcgggtctcctgtaccctggggtggcacaggaccactgacagggaggacacaggactgctgagagggagggcacaggactgctgacagggagggcctaggagcttcatcttgtgtaacctttcaaaagaaacctggatgccagtgcctatccttagggcagctgagaagtgggcataaaggggtgggcagtactgtagtggactgtgtcctccaggggggctactcaaagaaaaatgagaaatagcctgatccccaatcaaaggagcatcttcgagaagaatcctgctatctaaaacaggctttagcaagttagttagctagaagttgatgagtaaagaatccttgacacacacacccacattcatttccacccatctatccatctgcctgtctttatattgccagttgcttctccctctctccttgctcacatgcgcgcacacacgcatgtgcgtgcacacacagtgtaagattcctgtgaaactcggagaggctcttgcacatgtgacagacagtgctggagatgaccttctggtgtctagccatcttccctgtcctctcaatcaccaattcaacacacatttatcaaatgcccaccatcactgttcacaagtaacccaggtggcttataagagcagagcctcaccccatcctcagactttattaacttaaataaaagccctggagctggctggcagacccagaacatgtctgtctccaacctccctcctagtgggagcatgatgcaggaatggcagctgagtgccagttagggtgacacctctatttctatgaggatgacacaaagaagaactgaattataccaggctgtgaatttcgcagagagttgcaaagtttgttgactaagtcacaaagggctgcatcaacttcctggggccaaatcctggcatggctttctacagacgattttcccctctctgtgccttctggtcttcatctgccttaaggtcatggccaaagctcagaaggtttgggcctgatagagtaactgctgaggacggccaaatctcatctctgcaggcaaagcctgtctttcttttgggtttaagacagggggtggcaaactctttctgtaaagggccagatagtaaatattgtaggctttacaggccatatggtccctgtcgcagttactcaactctgctgttatagtgagaaagcagctatagacaatacatgtacgagtgagcatggctgtgcgccaataaaactttatttacaaaagcaggtggctagccagattcagcccacggactggagtttgccgatccctggattaaaaaaagattgttccctggactggacacatccctgctctctgcctcagcccggggagaccacttctgcatgtacttcctgctcactcccccagccccacacccctgagaactgaagctgacagtgagaagcctggtcccagcagggggcagcgggagggggctgagccaggcagggccctgtgcatgtgcatctcacttcagcctctcagctgcctatgagagtggacaaatgagggactctggccccaggcaggtgagaactgttaaggccactgggctggtaagcagtggagctgggctgagacccttcccacgctgcccctgttacagtgacttcccagtgacctctgtgagctttgctgtggggtgccctctgtagcatcttctcattcccatgtgctagccagggcctggaaaggcagactcatgccgtgtgcctactccatctcccttgatgggagacataccactccagggaccctagagatcctgggatttcaaaatccctgggtgaatcactgaataggcagaggcccaggaagagtaccaatttgcccaaggtaaatgaaggtccccaagtccctgccctagggcctttctataccaacattcaatgcctggtcccctccctctgagacaggtgttcagtgcatctggctgggcactgggaaagggcaggaacaagacctaaactctacccttgaggagtttacagcagaggggaggggaaatataagcaggcagccaggagcaaagaggataggtatttggatggggcctccaggctcagaacacagcttcccccaaggaacctgactacagggagtagtcaggcctgatctaactccttcttccacacccctcagcctgaaggtgggaccaggattagcacctatgtctaccagaagtgagaagagtagcctggcacccccagcagtcactgcagcatagggacatggcctccagcacagtgcctgtccttgaactgggaaaggtgggttcttgttgttaggagcttggcctccaggctgggtttggcacagaggtgctctcagtggaaggagggagccacagtaggaaggtctgatttgggggtgtttggaatcaattccagctcatccatcccccaagcaggactgggcccccagaactctccttggctttcaagagtcagggaagggaaacagaggtgcagaagcattaaggtccgcttgggccagctcctacctgacaatgctccattctggctcaatccgcacgatggtggggtcttccacatactgaaagaccaggtcctggtggatcttggccctgtccacctgcaccgacaccttcatctctagcacctcatctgaggatgtggtgttgcagacaatgtaggatggagatcgcctggagggcaggaagacagagcactgggcgcctggtgttgaggaggacagaggtcctgagtcaaggccctcccacaccgctccctgcatgtcaggatgctcagaggccatgggtgggtgctctcagacagaaaactggagagccagtgacaaagactctccttggccaaactttagacaggttcctctgagccttcttttcaaataggcctcatccctgggtctgtctttggcctgtctagccttgttttttagcaagaatctggctaagtctatttggggagaaccctcccatacttgacatctgatcaccctggcctgcctttgcaagaatcacgttaagttggtttagcaggagtccatctaccttgatgtatcctcttagtgatttttcattcactgagccccttattctgctcattggctataaaccccctgctgtctttgtagtatttggagttgagccccatctgttttccctgatgcagtagtcttgacatcagttgcaatcgtcctgagtcttccttgccattttaacaagtgtcagaataaataattgtttctttaacactactgatgccaggcctggccaggtctgacttgggaattgtcacagctctcagcgtagctccctcaaggaaaaatcctctctctagagaatctcaggccagctgagggagcttctccagccacattgcctagagtccttcactgaatgcacctcctgccttgctcctaccccctaggctccagttcatgacaggtgtgcccttctggggctgcacagtaggaccaggggaggcaaggtcacctggccttgtaggctcaacctcaaccactggattgctgtgcctatcatctctgagcaggtccagctggctctgcagctcccagagtggatctgaccctcgtgaatgggctttagttgtagattccaaattgcattctggggtaacctagggttctgcagagtgggtgctatgggggcaccagggctaactgatgggccatgaagcatatggagcccatccagggaagggagggctgacaggtctccagactgagcccaaatcctctcccaaagagcacgtccactttgttaggcaggaggagtacttccaagccataaggtgattgaaaccacctttgcaaaaattgttgcaaaaaagtgtggcacctgtgcaaaaatttctgacatagaaaaattatcacagtgcaagtctgacctaacggaccctatcttgcttttaacctccaagctacccttgttcattcctgggcacagaccaagctaactataggaggaatttagtttatagtttaattttgtaacaaagatgataacagccttttcctgaaacaaaccccctctttgcctggggaccagagagcctacctttgaaaaactaacaaattcgccacaagatcagaaattatgactcaggaggcacataagcaacaagaggccacaagattccaaatgttcccaattgctcctatggataacatcactattgtaaaacctaagatcactgtttgagatacttttcagatcctgaattctgattgaccagctggtaccacccagaccagtaacgtggctcaactagttctgcgatcccacccaggaactgaagacagcaagaaaaacctatttcaactttatacaatttcatctgcaacccaaccaatcagcattccccactccctaaccccccgcctgccaaattatccttaaaaaaaccctagtctccaaattttcagggagactgatttgaatcatacaactccgatctcccatttagccagctctgtattgattaaattctttctctattgcaataatgctgtctcaggaaattggctctatctgtgcagctggcaagaagaacctgtcaggtggttacaccctcccaactctctgcaataaaaacaaagctaccctgaagtcatttacctgtctaacctttccctctctggtgctgcagaaaggggccctctgagttacctgtggaagagacagggctgctttccaaacatcaccaccacgttgcttccggcattcaggttggtgcctgtgatggtcacttgggtccctccggacatgggcccccggctgggcttcagatctgagagagtcagtgtctgtgtagaaaggatgtggcctgagacacaaccaggaaggggtggaggaggcttctgggcaggcgtgaggcagcaccccactcccccaagctgccttctggaatctttggtaacagtggtctcccagagaaccagggcagttctcttaggcttgcgtggataggcagtgttccagaccctgagagtttgcatgcctatcttagtaatagtaatactaatagctgccatgtacttattttttaagtgtcagattgtacatcttcataattatacatgtatgtgtatatatccctatatacacatacatatatataatttaatcaccaatcaattctttaaagtaggcattattattttacagaagagattcagagatgttaagctagttttccaaggtcacacagctaaaaaaaaaaaatggcataactgagatcttaccccagagctccagttctcaacccctctctgacctacagctctgttcttgggtggtaaactgtctctcccacaggtctctacaaagagctgcccaaagcacccagtggcagagcaatgggaagtgagagccccagggaaactcagagagagaaacagaaaagagtcagttgctttcaagggctgcccccagccctctgccagaatgggaccagtgaggagtccaggttgggggcagggcagaaaaaagctcttgacagctggggatttggagttgcagtttgttctttcattagcattttaatggaaaaactttcctcagtcccaggtgagaagcctgtatctgcatttaaatgaagatttctctctcccttccccagctacctcctccttaaagaattcagcaccaaaagtcgaaccctctcagttccttggagcaggctgacaacctccccttggagatgctttgatagggaagccccagagcttccctatcacctggcacatgcgcctccaggtccaggatcagggcacatgggtgaggagacacgcagaccacagctcctgacctgcctcaccaggtctcagcaccctgtctctggatcccaggtctagtatccctgtaacatgggccaagccaaggaatagcttgtcattttggctcaaccagagaccaggaagagggtggggtgaggctgtggaaagagccctcctttctcagctctgcctggatctcgctgtgtgactctggacaagacatttcacctctctcatcaacaaaatcagggggctgagccaaaaagtggtgatcttcaaggctcctggcagttctcttgttctgtaacttgcagtacctcttcaaatggtacttgtgcccatcttaaagtatccccaccaaccttcccagagaggaaaggaaaggaaaggaaaggaaaggaaaggaaaggaaaggagagagagagagagagagagagagagagagagagaaagagagagagagagagagagagagagagagagagagaagattgtgcacacaggcttcgatgcagggatggtcctaaagagacagagttgaactcagggaagttaaaatagatgggggttggtgctccctggcagcctgtgggtgagggttcttagaaggggtagaagtgagtaatccctgcaggtgttgctggggcactatcaaggggctcactggtggggagaggatgttatggatacatgttttagagttgtgagaagctattaattattcaagccatgcttcataaatatttcacggtgggtttgcacaggaaatcaaattctgcattacttgccacctcttcacttggctccatgaatggaggtagagggaagggggaaagcattccctgcatggagacctttaggaacagctagtgacagcccagggtgttaatctggggcctcttggtcttggcatttggtttttgatgaataaacccacaaattggagtctggcctgattgtgggagaggacaaatcttccctctagccttggtactaaaaagggtctccccaacatgccccaagtcctggggaaagagcttcctggctgtctcagaactccaggggagctaggggcttctgtgtagggcccaaagagtgcacctgcaagctgcctggtagatgagaaggccatgagggctcggagactctggaaagtgtgatagatgggggttctgtcccttctcaaccccctgcggagactcatggggacctctgtccctcactcccacctggaatccctagaaactctgtgtgagggatgggggtgggcctcaatgacacaacccttaaatgcaaggggccagagaaagagactggtgtccctagcactatctccttcctaaagtcttcccaagtgaacatgtggcaccagagccattcctcaaagatgtcccttaagtagaaaaatgacaaatctttgagcttcagggacctaccagatcaatgcatatttgcctgtggcaacctctgtcatctgtcctgacctgcctctgcttcagtctctcctgctcaccacccaccttcttccttctccctcctgttcccatcttttggtgcactagaccttatgctgggaacagcctcccaccacttcagatccacatggaaaattatattctatttgtattatacaaattccatctttgcctccagcttcttctaggaagtctcccttaataccctaaattcaatcacacccctctccagggtaggaacaatcacacagccaagactggacccttcctgagggcagatgagactttccaatgtgtagcacacaggctcattataagaataaaagcagagagctgagtgcattggtacatgggagctactcaggaaacatcctttctcctaggtcagggggcctcagcccagcttgcatctcagaattacccaggatctgtagcattggatttaattagtcctggcaggaggcagggagaggtccagggcattttgtttaatggtcaccccaccccaggagactctcctgtgtccggaggtttagcgctgcctatgcactgtggggatcccaaagaaaagaaagtcctgggcttcagctgatctttgatggagcctcaggggtgggggcctggctgcaaatgcagagcagaggcagagaggcttaaaggaagcatcagcttaatgaggtggcggtgattctagccctgtccactgtgtgctccagggtccctgccaaggaccacaggatggaaaattgctctgggcaggtggcaggccaaggcaagtggctcccaagactgactggtttgacgaggagcagggcacaaagaggagccactgagcggtgtgatgcagtcagatgtctggagtcccagtaaatggggtggggtgcagggcctgtggatatccacagctcaggcctctgcattcgcagactgaggactgggtcccgagcacaactttgacgaataaggaggatatggctcgtgcaaccaagagaaggagatagagaagataaggtggcagatcatgcaaaggctggcaaaataggattgaatggggaagcagacagaggagcctgggcaatgttttacagggagggggagccttggctcttcttgaggtggcggctgacatgatggtagatggattacaacaggttcagagagaaaagcaagggaaagatttaaggaggccgttgtgatggcaaacagaatgggaaaaggaagactctgggacatggtgatggattgatgtcaggaatgaagggatgctgagccacagcccaacaggattgtaggcctaggggatggatcactgatgggaataggcaagagaggaggatgcactctttatgggagctgacagcctgggtgggccaagtggagatgaaagtgaacagccaggtgatggtggccttgattgagccgctggagtgaggggcctgactggggaagcagggcagaggcagctaaggttcaaaagaagcatcagcttagtaagttggaggtggctctagccctgtccactttatcattcaggatcactgccaagaacctcaggatggaaagctgctctgggcagtggctggccaaggaagtccagtgcttgctttggccatgcagcagtttcctcccgttttactttggctgccaggaaatttcaaagccagatttcttgcccaattttagcaaatacctggcgaatgtcatccctcctctctccatctctctctctctctctctctctgtctctatgtctatatcatatactatatatatatatatacacacacacacacacacatatatatgcatgctttatatacaaatatatatacatttctcattagttgtcttaatgtctattgggttcaccttggaaattccctcatgctttcaggagaaggtggtgggtacaaatcctaaacaaataaggaaaatgactcgtccatgaaccccattatatgtgcgtattcttctaattttatgaattcctatgtgcattctgtgacagccaactgcatccagagggggtttggccctcggagagcagaggtggagcagatgcaggcccagtcatggtgtggcacgacactcacgtttctctaaggtttggccctgaccatgttcaagtctgtgtcaagtacttgagctcagttgctttcacctccccttctagactgtaggcctcctgagggaggtgctgtgttgggtcttattcatcatccattaacccccacagccagaaccatcaagtcataaaatccaactcaattaaacaagcactcattaaataatctagtgagaggcattgtgcaaggtgatcaatggctgtcagttgaagaaggaagaaggaggaggaggaaggcagatgagataaaggagggagggaggaaggaaggaagcaaagaaagaggaagaaaggaagggagggagaaaggaagcaaggaaggaaggaagggagagaggaaaggaggagagagagatggaggcgaggggtgggggtgcagaaggaggaaagagggagacagagaggaaggagaatgaaagccaaactccccatgacatatttcagggcacatgatggccaggcataaaatccatcacttcaggcttccagcttccaaaagcagctcagaatcatgaggaaattataccattacagctgtcattaatctgagaggtttagtttttaaaatgatgggtgtgtgcggcagggaatgtgtttatgtctccaccatctccataatcacaaggctgagagattccaaaagcctctgtcccctagaactacttgtcaggcagcctttgaagggatgagaggttccaggcaggaaggaatttaaggactggggagagatcctcagaaaggccatgggatggggaaaggggtggtagggtgagaggtgggggcaattgtgtgggtagagggaaatggattgggtatgcaggtgagaggtgggcaggggttaatgaggtcatgaaatagggataatggtgagtgggtgctatggtttgagtgcatcttccaaagtcatgtcttgaaagcttaatccccaatttaacagtgttgagatgttggacttttaagaggtgattagtttataagggctctgccctcatgaatggattaatgttactatcataggaagatgtttattatcaaagagtgggtttgttatgaaaggcagttccaccctctcccgctcttgctctcttgcacacagtctcctgacttttcgctttctgccacgaggtgacgcagcaagaaggcacttgccagatgtagcccctagatcttggacttcccagcctccagaacaaggagtcaaataaatgactcttctttatcaattacccagtctcaggcattcttctacagcagcagtaaacagactaagacactggggtgaaggagtagtgtgagggagataggatggcataatgggccacaagtgtgcagggacaggccagaaaatggaagcaatggtggcaaccacagaaataataaaacaaatgatactagaagtcataaatacattgatgtaattttccacaagatcatggggttgatactattattatcctcattttataaatgaagaaactgaggcaaaaacaaaatgttgagcaacttgcccacatttacccagttagcaagtggaagagccaggtatcaaatcccaggagttgccttgtgaagtccaagctcttgcctacctaccatgccacactgccatgcacccacctggggactctgggccctgagagctaaagcaacttacctgaaaccacacagccaggcacagaaaagtctggatttgaatccaggtcttccagacttcaaaggctgtgctctcactcactataagacaggagtctcatgaactgagggaggttgcagggcaggcccttgccctgggtttgctcacagagctctagaggggcccagcaatcatggtaatgagctctgtggcctgcacccagccagatcactgctggccaagactcaccatgaagtaatagagctgtgaggaccgggccatgaattcaggccgacacacagccacgcagatctccacgaagcctgcatgctggctgggcttggcctcccccatctcacacacgatcctgcagggaggataggagaaatcccatgggtcacaggacttccagccaagaccctgcaccccacagcacctacccaggtccctttctccacagtaggatctcagggatggccaggtaggggaggaaggggaagatatcctaattcctcctagcaggggcttctccttaattgtcaggcaatgacgaaaactgacctatgggatctcctttgagggagcctagaagagggtccctgtgttctgaccctagatgttcagtccctaattcattattatctactcagttgtcaactagactggagggcatgttctagccaaaacccttagggaatagggctggcagagtccagagaggcaaagccacttacccaagggctgcagcaagtcaaaccagaacttggaacagacctaaggttttctggtccccacctgggagctttctgctcccgatgattgggttgcctcagtgaagtgcttttgcttcccagccagcctccaggctgggtgaggggataattgagtgtgtgtgtgtatgtgtgtgtatgcgtgtgtgaactttttcctttctaaaaatttttattgctttgattacaaaatttgtttataccctttgaaaataatcaaacagtcaaacagtacagagtatggcagtaaaaagtgagtgccccattcttcttaaaacttaaaactatatatacacttaaaagttaagtgtgtgtatatgtatgtatctttgcagacataatatataaatatatatgtgtatatatatctatgtatatatgtatatgtattcttcattttacaaatgaagaaactggggcaaagaaaagttaggcaacttgcccaatacatatatttgcatacatatacacatatatacgtacacacatatgtatatttatatttgtatttcatatgcaggcacacatgaacataaatgtgtttttacatatatacaattacacttataaacatgcatacgtaaggaaagatatatgtgtttttttaaaataaaagcaaaacataacatatccactgctataaacacttctgttttttgctcagcacaatagcatggaccttccttcctgtctctgtagacacggctcgacttttttcttttcagcagcctcacagtatttcatctgatgattgcactatcatttacacaaccatcttcctattgatgaacgtttagttgtcctgatttttctgctactccaaataattctgcaaaatgaaccaactgacacacacatccttaggcattgtatagtaggatagatttctaaggaaggaacctgttgggtcggtttgtgtatttaatatttggtaggtagagccaaataatgttccaagaagtctggaccatgcacttctattgatggcccactcttttgccaacaccagatatgaacaatccttttaaggtttttccaatataatgggggaaaaaatctcatttttatttttattttgcaaattacaggtgaggtttcataaattttcacatgggtgtgtttttaagatctcatatagcctttcctttgacttttctgttgaagccctctttcttgctgatagattgtctgaattaggagtattaattttgtctgttataaatattgcaatgattttctccacgcttgtcatctttcaactgtggttccaatgtcttttgccacactaaagtttaaaagtatctgtgtgtttaagttggttgttctttaactttacggcttctatgttttatgtttctcttagaaacaacttttgagtaaggttcctgaacaaataataactttctatccagatcacataattaatgcatgtttggtgtttgaaacaaaatagaaagtacataaaagcacttgtcatactgaaacccccactagttgcaccattcagaatgtaattttccataagaccatggggtagatgccattattatcctcattttataaatgaagaaactgagacaaataaaatgttgagcaacttgcttacattcacccagtaagtaagtggcagagccagggctctagtcccaggaatctccttgtgaagtccaagctcttgcctacctaccatgccacgctgccttgcacccatgtgtaatatccagtgtcaacattttggtgtttctgtggccagtcttgcttttcttttacaaaactgattcaaaactctatattatgctttgtaacctgtgttccaagaacctgtgttctcacttaatataccttgagtatatgtctggtcatgattcttctataatatcagatttaatggctgtgtagttttctttccagtgcttatacaataatttattgaactgaggaattccctatttttacacatgtaaatcacttctgagtttttactattataaataaggctgaaataaacattcttgaaaataaatatttgtgaattctggttatttagggaaagttctagatgtgtgatggccaggctaaaggcttctaacccacatttccaaatttccttctagaaagtttgtcccaatttccccttacaccatgagtgaaggagtcagctacttctcatgactctctcctgcaccaggcattaactttcacaaaccactccctattgttttaatttgcatttaattgattactactgctgttaaacatttatttttcgtatgactttcggttcttttttatctcataaattgtacgttcatgctctttgatcattttgtgatctttgccttttatttataaaagctctttatatattaagaaaaagtatttattaactgtaatagggtataaccatactcccagtttatcattcacatttttattttgcttgcaatgatttttgatgcacaagttttaaggttttatgtactcaaatcccctaatctttttctttataatttcctctgttgctgttatacttcgcacaagttccccttcttgaaattgaataaatttccacctgcattttcttctaatcctttcacagtttcattttttttaaacttaactctttaatccatctggaatttattttggtgtgtaatgtggaataaggatctgctattgtactttttccagggagttaaccagcatcaattattgaatggtatttccttgggtgatttgaaatatcacctctattacatactaaatttgtatgcattagcattctttttctgggtcctctatcttactttactgatctaactggtatcacaatattttaatcatgtggctttataataatacttttgatatctggctatgtaaatccaaagtaggatattttaaaattctccaaatcacaatatattagcagtggcctagtttggtttcgttctagaaaggtgtcagaaagttgaaagagccatagaaagatcttttggtaactaagtggtgatggaccagagaggtgagtcctaccaagactggatccttaaaccatctgatctgctgtgagcatcttggggagatctcatggaaatcaggaggaattgaggatggctgtactgatggttcagaattagtaaatctaggcaagacccagcaagcagaaatggaaactgcactcacatacctaggggaagacttgcgaagagtcaataacttatgcatacagcacaagtgacaagatttcactccaggaagtgcaacaaagatggtatggaatatagattctatgatgctggtaaacatttcatagttgtgtttgctgggctggaaaatggtgcttacttatttacaaggccatgcatgattcacaaacctcctctactaggtgggttacaggtcaaggtcttttgctgaatgacccattcagtgggccagcagactttcaaagagaaaaataatctaaggcacccacaagcctcagagtgggtgtgaatttcattgtcagtctccacagagagtagcacaggatcagtgctgggggggatgtgagcgggaagttgaggacagcagaaggaattggatttacacttctcttgcagattttcattttgttttgtctcccctccatgcggccttatgccccaagtaggtaacagtcacctttctctctcagctatttctcctttccctctctacactttccccaatatggcagctagctaactgagcaggcggggagttgtgggagtccaccctccaactctaaaatattggggtggttctcctttttcccccacaacaagctctgagagcacctagttgctgaccaggacatccctaatactaacccgtcttccctcccctgttcctcctgtgttgcatgcagcttcacttactgttctgcagggatgtaaccatccactaaagggctgcactccacgccagcaaccttgacatgggaggcgatgtcgcgaaattccaggcccaggttctcccctcggatagtgaccttggtgcccccttcccgggggcctgtcaccgggattatctggagggaggaagagaaataattagacaaacaccaagatactgccactcacttgctgatgaggcaaggagaggctgctggctcttgtctcatctgccccagagtccctgagtggcttgaagtcaccaagggcacccaaagcctgcggtaatcaatgggtagtagcttctaggaaagcagtccatgtttgtgtgtgtcactaggagcagtatgcaaagcccatggtacatctttccatttcatagaagagatgagaggatggaacatgaccagcaatgctaccgggtgattcgtagaaaattgggattcatgccttctagcatttgcttgtgttggttctactctcaaggaaaataaaaacccctcctatccattcagagccccctacacctatgtgaccctacccacctctcaagatccttctcaaatgacactgccccataaccctgtgttcttcttctctctccatttaaattccaaggtaccttctttgtgccacttacatggcaacaattctttgtgcctgttcttcatccttcccactcccagccccctcctcctccgatcctgagtctctgagagcaggtctgtctccctccttgtgggcttttcagtaaccatctttatgtcttgcgttgtcatgtgataaaacctacaactgtccaaacatctttccggaattactatgagcatttgtcacaactcctttgccgttgttgtttggcctggtaccacatagatttaggtttaatttaaattttaccctcgtacacaggtcaaagtgtactggctttccctcctaaatcagtgtcaaaaacccatgattaaaatgtgaggactcagcatccaagtgcctgctttgaggtgagggctgtacagttaacacaatctcatcctggcgtttcatggaccagagaagggcatgcttccattcctggtgcctatgagcaccagcacctggaccttagccaatgtcagcaggattagaatggaaggagcccagagagtccatctctaccccttttcagcatatccaactctcctcaaccctgcagggccacaagtgggaattccatcctggggtaagggtgaaagatgggggaagcagaaggaactaggctgtgctgccctccccaccaagtggcagcttctccaggtgagactgcttacctgccacagtcaagctacctcccacctcctacacatccccgtgagggttggtgtgattgtgagtgagcgtgtgcaggggtgtgagcctgtgcataagtatattcccattgcagtggaaaaacagcttccctggagacacaggcccatttctatgagagggaggtggacagatgtggggaaggtcagagggagagtctgtgttcttcccaaatgcctgcctagccagtccccaaagtgccactggcatctggcagcagtgtctccatgatattctagccctggcttgtcatactgaaaaaggagttttatctctggcccactccttcgtttcccaggttcccctagggccaacaccagtatggaggcagtaaatagcctttgtcacagggagatatgtttaatttgccgtctcctccctgtgattttcttggacataggccaagaagaaagcaagtcccactgatggcaccagacacactgccatgcgcagcagccccctgggttggtttcttgttgagggctctgggaggagccgttccacagagcaggtgtgaaggtgagcggtggggactgggaagggaggacatgggcccaggtatggggtcaggggcagtgaggagagaagaggtccacctgtcctcctattccagatcattctgtaggttaattctgcaaatatttcctccaagtctgagaatcactgtttagattcctaccatgcaaaagactgaagtggggactgagagaaactctcagagcctgtatagccaggaatgtggaagataaagggtctgaagcatggggcacatgttgagggccaccccaaggggctgctttgctgggtgaggcccacaaaagcccacacacaaatgtgtaggaggcccacaaaagccaagaatcttcttgctttcacacatccctggtgcacgtgcacaatttgtgagtgggggtatgaagtctcaccattgtagtggaggagaacaataacctaggagaacattactcaggagatctgggattcaggaccatgttactgacactttggttagagtatgtgtgcctctctgagcattagcctctgtctggaagagaataataacctgatgataaccctggccttgggagacattatgggtttgaattgtgtttccatcaaagtcacagggtgaagttctaaccccagtgtctcagaatgtgtccttatttgaagacagggtctttggagaggcaatcaaatttgaaggagaccattaggatgggctttggtacaatatgatctaatgaaaaagaaatttggccacagaggaatgcacaaagagaagatgatgggaagctacacagggagaagatggccatctccgagtcaaggagagggatggggaacagatgcttccctcacagccctcaggaggaaccgaccctgccaacaccttgatcttgaccgtctacctcctgaacggcaggacgatccatttctgtcgtgcaagctgcctagtctgcagtaccttgtgacggcagccctgggaccctaatagaacaggtagttgtttggactgacaaggtaaggggtgtaaaggtgtggtgcaactattaggcatcacacaaatatatggcctatgactgtgcctgccactgttaagtgatcatatactgtgtgcatttgtgaaactgtgcacaaagcccggtaccagttcgtcctcactgttcactgaggcagagactgagtctctgtcttctctccttctccctcttcctgctgcttcataatcctgaccagcatccgcagtggtaaagaggtattgagcacctactgtgtgctcagccctgagctggaggcacagatgccatggtgccacagatgacatggtgccatgggggaggagcatgtggagagagagatgcagccctcttttttattttaagagggagcaagggactccagccttgctggaagagtgcaggagtgggaggagaagagacaggactacttaaatgaactccaggggcagtgatttccttggcttagacatccctgggaatgattttaccaatgatgatgagtgaggaggctggtgagatccccatgagctgggcccagagcaaggtaccttgcctgtaggtgcgtgtgaaatccttccagctcccatgtgagagggacgctcaggcccaccgcacatgtgaggaaggtgaggtgtggagatactggtgatttagccccaaggtactcagcaaacagctggtggagcctggattcaaaccctattctctgggacccagtgtctgcgtgtttggctcttcaccgtgttcctcccccaggtctttgctccatggcctgtgtccctttggtccccctaaactgtgctccatcttacagctcagggcttgctttgggggagttcaaagacctctctgttgtgaccttcttcacctccccagagccaggctgtgccccaacacccatgccacctccaatcacgggttgacacttggtgaggatgccaaaggtggaacttcaggccttgccaccgaggctcttagagacaaaggaaggggctggcgaggactgagtcctttttgacacagctcctcagagactccaacaggacagttgggcccctcattgaggatagtcgagccccaaaaagagtctctgatccaagcctaagcttctggggaagccgtgaagaaaaactagggtgccatccagccaggcagagcaaccaagtccacccagtgactactgggtgaccgacaccacggctgggcagagtttccacagggtgtggcacagcagcctggagcctgcccatttggagcaggaggcccgaccccggcttacctctgtgatgcgggggtttgtgcacttgcttttggcaccagacagctccagccactggctctcctgggcagggcagtgctggcgcagggtgcactggcctgggccctggcaccagccacatgcgaagtctgggtcagccttgaggcacagcccgcagctctcacgcatggctccacacttgtagaggtgaactgcagaggggaagggcaaggacaaggggtgcttgggaatggcagtggggacagaaggggcccagagagagacaaagagtgcagtgccagcctggggtgatggggcacaaaggcagttttgcccccttagccattctgatgcaaaaaagaacctgaaagaaagtccaggcctgagcagagggactgaaatgggaagctctggggttctccgttcactcagcactcagcagcccttcccaggaagtcctctgcacaccacctcctaccagaagccctcagcccaggtcaagctctacagagcccatgctcaagaagtaacctagaagcacagatggtggagaggctgtgaaggaggggctcagagggagagggacagccactaggaggcgggggcagaatgactcccgcgagaatgcaggacggctccttccctctctaccccatcccttcccctccctcccctgctaggccccagcccttccacacctttattctgagctgggttgtcaatgttgaagtgcccattccacacgactgtcaactccacgggcaggttgttgatctccatcccttcataggaatactgcagccaggtcggggaggaggaaagaagaaagtggggtcacagagagttctagagagggcccaaatgatcagcctacggccgttaagagctcacaggctaaagactggccaagactgtgcttgtgtgcatgtgtctacctgtgtgcatacaagtatgcacatgcacatgtgtgtacaggcagggaagtgcatatcagagggggtggaagataacacaggggtgggccaggcctccaagcatgcccctgtggatgccagctcaaggagcagatgggagcaagccactaggtcatctcctgtgggtctcaggcaggaggcctgctcccatcccctggaatttcctgagaggtaaaaccgagggaggagtccacttcctctctggctgcccagggaaaccctggtccctaggccctcccaagtctgcaattagattggggaactctaatttccaggaaatgtccagggtaggtggatgctttaccaaagacctggggaggggtgatcacttcccaggcagggcggtggttgcagagactaagaaatgaaggagctacaccctagggggatgagaggctgggggttaagagagaagaggactagatgggagcttgttggtgacgggggaaatcctgaggaccttggaggacaaatctggaaatctgggcctggatgctgcagacagtcaccagctcaaagccaggctcacgcccagattcctgttgtgctcctgtcctcggagggctcctcagggtcctgctcccctacctggctgagagataggaggtggagggtggagagaagagggaggtgctggcttgaagatgatggtggagggggcagtccccaggcatgatggcccctagtctgccttcccatagcagacccctctcagtctccagagaaagagggttagcagagggaacttagagcccaccctgggcagcaatttccaacccctacctggtgattttctcattattccagccgactctgctcgccacaaggggcaggatggaagaatggaattgagacagattttctgcatgggaggggctgaggcctggcaatttgttgaacgaagttagtccagaggaccaggtttgaagctgtgtttgcaggacctacaggctgttttaattcaaatttaatttgaattaaaaatttggagggctgggctagggggatgttgatggatatcacaggaggccactgaggctccgtcctccaagttggccatggcaccttcatggacagggagggtggccacaggacatgggaaaacacatctgggaagaatctcagagggctactgcctctgggcagggacaggtctgcaccctatttgtaggagcttctaaaggagatgttctaatcttcgatgcagaaaattgccctaaattcctgagttacggaatgtgctcccatgagaacagactgtgacttgacattgccctcatacagcaaccacggggggatgtacctccagccactcctggctctgccctagcatccagagttctaacttcctccctggcaacgcgtgccagggccagagagctaggttcggtgtttgtcccacaacggaggagtttgcaacgtacccccgtcgttgaatctctcgtttgaccaatggcacccgggccaaggccagggtccgagctcacagagtaaagcaaagtttcctagccctgcagaaaccacagtggaaactttgatcatcatagaactcaatcatcacctccccagaggttgtctctgcagctgggtcaggctgggtggtcctaagttgtcctgaaaacctcttccactttagactggtggctcttagagtggtctatggattccttcagcagaatcacccggggggcctactaaaatgcagattccagggcccatcccagatctgccggactggaatctctaaagatgaggagcattttgagagctactctgtgattccggtgctggttaaagttagagaatccctgcagtctattagaagtagggaggcagatgactgccccagtggagggagaagggtataagagagggatgccctccttccttgtgtgtgtttgtgtgtttgtgtgtgtgtgagagagagagagagagagaacttccaggcttccagttccctcctccagccacattcaatttcttcccatccttcccatctctctccttgaaagtcccagtggggaaaggtgatctcaccaggcttcaagctgctgcctggatggctctgagcagggctggctgtttcaccccaagctgagcaccatctgatcacctagaggcagtgctggggcaggctgagctctgacctgtaggagggatgctgacagtggctatgtcaagatgggagcctggcttctgctctcaggcctaggtctggccaagacacaaagtagaagcagcaggtggtgaccaggagtgttagtcaaaaatcaataaatcctcatgccccctctcaggaaggacctgacatcccacagaaaggaaggcaaagaatcctacatacatatgcatgtgagcatctgtgtactcaaacgtgtttatgtgcatgctgacttgaggagacgttagcacacatctccatgttatctgtatgtccataagtgcacacacacgcatagacacacagacacacacagttccacaaagtggttctgccagtgaccagctgtgtgaaatgagcagataatccaagtcttagtttccccattggtaaagtgggaattcaaagcagtacacatctccttggattggcataaggattcaagatcatgcacagcatgctccgagcatagtatctgtcatatagtctaagcgctcaaatgtgattgcgtattttagtctatgtgcatgcagttggggatgctatgcaaaactatattcgtgttgcctatgtttatgtttgtgcagaaaaataatagcagccatgcattgagtgtttctgtgccagacccttaatatgtatggggatgtatacatatgagaacgcttatgttttctggtgtgtgtgtgtgtgtgtgtgtgtgtgtgtgtgtgcgcatgtgtgcaagcataaattttctctttgaagaaattgaaaataaaaaagacattaggatcacatgtgctgggcatttctttctctttctctcccccaatcctgggatctaatgactattagagaaatcgttaaccccatgtgctccccctcagccccgctctgtctctagggaagtttccattgttcctggaggctctctctcctgtggatgacctgcaacgtgcctggggcagggtaggggaaaggggtgggcatggcagatggagcctctctgcctctgcagacagctgggagcctggaccacgggctcccgtcccccaggatcgccctatctccactccacttagcatttatatagctctctgtaatcagcaggcagttaatctgcacaaagctcagagcccagggaggacaggctccaggctcctggaggccgggaggttaagtgtctcaatcaaggtctggcacaccatgcggggctaatggatgactttccccattaccttgggaaagtgtgaacctcagcttctacttctaaagcaaaaatgagacctcgatataactgagacattctttcctccagccagtcccttgtcccaagatctgagatattttgccggaaagttctgccatttgggcaaacaaatctcaacaacctaatgccacacaagaagctggtatgtacactgtgtccatctctagtccagagggctctgctgaccccttttcagccatgtcccagtaaagtagaaaggggacaagttctcttcctattgcttccctatccctgttttgcacgtggtaaatgacggtgccaagagaaaaccagaggccagcatgagtccgcggaagctgggcctggccccggccctcacgaccagcacttcagccagccagatgccctttgcagccccctcactggcatgattggcagcctccgagagctggtggccacgcactattattagcagcacttgacattttcctagagcattggtctaaagtaggccatgaatacccacagttgcttcccctccactgctgcctgtgagtctgccctgtcctcctcccaccagctcctgggggctgcagccattggctcaaggcctgtccccgcataatggggttggaaatggctccaccaccccaacccagtgtcactcccacactgaattttcttcttttttctctgctctcctttgagaccaatttatcacccacctccttctgccatcacaaactcatggatttctttgttagatcccttgtccaaggctgtttccaattgttcatggatttaggaaatgaaaaaatttgtccttccacacaatcctctttgaggctgatcagactgtactcccaggaataacaccaaagctggggtagaaagtgcccttcgctgctgttctttgctcaacctttgattaggggatgtgttatgaaactggattcaagttctgaatttgtgccttacttgctgtgtgatctggagatggtcacttgccctctctgggccttggagacctcatctgtaacaggattaagtagataccctctcaggtctattcttgtctgatggtaccctgttttctgtaactatggtgggggtgggttgccccgatcatgaccccaaagatatttgatggaaattgcttgatggtaagaagcaacctgacccagaccagcatttaaactgggattccactgccccccatgaaaagagaggctcccaggaaatgtcagagctgagccctcctgaaccatgtgattccagtgtgtcctagtaagcaaagggctgcattctactgtctgaggggcacaccttctgttgcctcagtttctttcttagactttaaaatggtagagaaatcacctctcctacaactaatggtgtcaaaattaaaaagtcatggaggcaaagtcagctgagctgctttggaagcagtgacctggggggcacccagacctggcccatggtggatggagaggctgcagctctgaactccagagggccagagcgcagcaggagccctcctcaggtcctgagttgggggcagggcatgagccaggagcttcaacatcaggttctcttcttggtgaagggagccgcagcttccaggcctccagctccaatgccaacaggggctggaagtagaaatgaccactgtgtcctgggacatcaggcttccagatgtgaaattcccaggggaggagctatgtcacttgctgatttcttgaggtccaaggattcaacacccgacagacagactgtgcgcacactggagcccagccgttcccttccttttcccatgggtgccgaccatggtgccagctccaggtaccccatggggacaccatgaaggaggagacagcacccacctgcctggtgctgcggagaccctgtttgtgctcttgttcccaggaggctctgatttcacacccacgttcggggagttccctgtgatggctaaggactcatttggtcaggcagctctcggcctgggaaatgctgaggacatttcaacacaatctacttccaattctggcagtcaatagaatggcagagggtcccagcgagcttcttggaagctaaagttagtccccagggcacaagggatcttctgaccaagaggtttagaagactaactcatgctgttgtctggagtatctttgtctattaacggagtcaaccaaaggccaggccatggggcccagttttatgacactagtgtccctctcttgggcacagccatctgaggcccacaggctctatccaccctcctgacatccccagatccttgggtcagcttctctcaagaaacaaggctgttttccccacagcttcagatcctcaccagccttctgcagagtcaaatgtgagacccagatgcaggtctctttctatagggagggtcttgttttggagagaatgacttgagccaaacccttggggctgatctgcttgaactcagaatttatggggaaacaggaggtgtttcatatctcctttgcttgcaggtttaatctggagtgctgcagaaatctgagaaatagcctggcagccaggggaggagggggatgggcacacaggatgccatggggacaacttctggggtttcagaggttgtgagagcagtgaccagttctatccctgtaatgctgagtgacctagggcaagtgtgtgggcctctctgagctccatttccccctggactacttcctgcaggaagagtagagtgtcccacgaaatcctttgtctgggactctcctggtcgcacatcacatctccaaatacagacattgcacataagtgcccaggtgcaactagaagaatacataggaagcagtgtgacataggaggggtcctcaaatccagaccacctctgccactcactagttgtgtgaccttgagcaagtcacttaccttctggcacattttggggtgcattacaccaaagtgaatagagctcagcttctgggcctacacttgcacactcagccccttctaaggcctatgtatctaagttgtacttattatattttggtcttaaagaaggtctccaaatggtatgtctcaccccacaaatctagatctgcccctgcttccaggcctctactttctcttttgtgcagtgaagaaaaactttaaagttcctatgacttgaaaatgttctgaatctatgtgtctagtgtttgtctctgagcatctgggcacaaagaagggagcccagaaagaaagagagagaccagagcagtagctggaaaggcaacatggcaggtgcgaagggaagtcaggaaaggtgatacacaggtggggttcactgtggggtacctaggaattaggtagacagctgtcggcagcctgggggctgctgactactcattgatagggcttgggcttaatgtggatttgccacacattgggcagggtttgcgctgatctaagcagcgctctcctagccagctccttcccatttgttatttcctcctgccaatgcttggtctgtctcagaagccttctctgctgagaaacagcctctatgtaggtgtgaaggtggtgggatgtctttggggcttgttgagaaggcagggcgcagggctttcagagcttctcaggaaagaggatggacatgaaggtacctggagcccagcgtctgcccataaacagggctcacagctccacggctggtccaatatcccttctaatcctgtcttacacggacaaccttcatcacaaaacatttacaactagggccaggccctgggtgacctcagaacccagcacgctgctggggcaggtgttgtggggctgggatgtgccagcaggcatgggggaagcaggtaggcagttttgtgcgtgttgaggaaacgactgcagggctgagctgatttggctcctagaagacaacagtgatgtgggtgggactggggcctggtttggcagtgggcagggttgggcgactcacagaggtgttctggcactgtacgctggagctgttgaagcgcagggcgggcactcgctgctcgctgccctgaatgttgaggatgcattcgtagccacgctgcccagactggggctgggggaggttcttggccttcagcgtgataggcttgatcacctccacgggcaccaggatcttgtccactcgcagcagctgggggcagtcctggggacagagggcatggctcaggctgggcagccaggaaaccaaatgagcaaggacctctgcagacataacccggatgttccctgtctccacccttccatggacacacccacaggcgacccctgaggtgctcgtgcccacccagtgggcaatgcactgaggacagaaatgaaactgaggaatccgaagtcctagtgtcatatcttgaggtggtccccaccctctttgggttccatgaaaaccttccctatgcaatctggattctctgacactcctgtagcctcctcctggcacccttctaccctagtagagactgcctctgcgggctaggcctcccctcccactggggactgatgatttctttgcctgctaagttccaggctgtcaagaattgggatgcacagaccatgtgagaagctccgcagagaggcaaagccctgggccctgttctgcccctggaatgtgagtcttgactgccgcagggaggctgggagggccttccctaaatgggctgaatctgatgtttgagaatgttctggaatgggccccagaggcctcataaatccagaaagcttctgaccaagctctaggatgtcctggccccaaagaaatgcctctcagagtagaaacactctgagctctttctggatgctagcaatgggcacacttagccctggagccacaggagcccagatggcctttgggatggagacagtgaatcactgggcccctttttcctggggctatcagctttgtccagggagggctggggacataaggaggtcagaagaaggagggtgggtgctctgcccagttgagtggtaggagctggtgtgttgctgtattctcaggagctgtgtggaggagagtcagtattctagctcttgctgatggatgtgggcaggcgtgaagccttccataacacaagcatggcctgggcatcccctgtgccaggcaggtcccaccatcccccagattcctccatctgtggcactgtctggggcatgccaagacagatggctcctgggcaggttgatcatcaaaagcatgacgcacgtgttctttctgatggtgctttgtcatgggctcaccaccaactctcagcagaggcttctcaccccgcaccttaacacttgtcctcagcagagtaaggcagaaaggaagccactgggaaatggtggaagggaggggttctaggcagttaggcaactggcagctgtccctcccaggtcccagagcaaacatgagccaaatatctccctgtgccattgcgagttacaccataacaagacttaggctcagagggagaaggcttgaactaactctagtacccgtgagctgctgatgagctctggaactctgagcacatcacagcccatttgaaactcaatttccttatctatcagttgagtgggactccaaggccctaaccatcttaactcatcatgattccatgatttggagtggttgttctctccatcctttctgatcatccaaccagaaaagaggagggaaagagaggcaggggaaatggaagcaagaaagggagagagaaagctataagggaagctaggagacagagaggaagctggaggagcaagaccatggtccacagatggaccagcagtggagccttgtttcatgggagtgccccaggcccattaaactaatccctcctcccacacccctacaggctgctcacacctttatcctgaagggcagctgaaagaggagccgcagatccagaaattccactcctgggtttacgtgcccagaggaactgaaaacaaggactcagaaatctgcacacccatgttcacaacagcatcattcacaacagccaaaaggtagaagcaacccaggtgttcactgaggaatgaatgggtaaacaaaatgtggcctattcatacaatggaatattactcagccttaaaaagggaggaaactctgctataacatggatgaaccttggggacattatgctcagtgaaataagccagccacaaaatggcaaatactgcagggttccacttgtgggaggtcccttgagcagtcaaattcatagagacagaaagtagaatggtgatgtctaaggggaggcaggatgggtagttgtttgatgggaacagagcctcagttggggatggtggtgacagctgtacaacaatgtgaaatgtacttaacgccactgaactatatccttaaaaccggttcagatggtaaatgttatgatatgtgtattttgccacaattataaaacaatgaagaggagcagcaggcaggcgggccagcaggaagagaacaggggccttggtcttggccttcaccttgcatgtggtctgaggctctacagtgtgtgggtctctggagacgccagtagccacttggggagagtcttagcagctccatcctgtgccccccaccacagccgctactctagcaaggtgggaatgtggcacacagaggaaagaagcgatttgtgaaaatgatggagctcagaactggggcgggaggagagtgatgttggcagctcgaggagagcagatccttgagaatggggttgctgtgagtccaggctccactagactccaccctccctctgcctgagccctgggcagctttccctcccctgaagcagcaaggagcctgactgtctctcctgccacagtccctggagggaatcagatctggtcgcactgggagtgagagccaggaggccctggaatctcttcccaccacctcccgccatccacatgttgccactgagaaatgaggccctgagggtatgggaatctcagaatcctctgactaccctcatggaccccatctattttgcaaaggagaaactgaggcaaggagagcagaaagaagggctcagtatcagcagatgagctggtagctgaagaactcagatgccaactgcctgagtcaccaagtttctgcccttcatgaaacaggagagttcccaccagtgggcaggaccacctcaggatgggctggtcagtcagcaggggtccccctgaagtccaggggactcggagctgtgaaaccctccggagctgggctggaaccctgcctgggggctggactgttcttgtccaagacatggggagcagcaaaacctgtctcccacgtcccctgtaagattcttagtgaggcttgtgatgagttctctaatgagtcctgattatcggtagccccataaaggcctagtttgcatataaaaaggttggcagctctgagagtaagttcattaataataactggagaggcccagggctgggctgggcacattttcctctagtggcgctgctgattgaccccagtgtccctcctaattgaaatgtaaaacggcaatttctccctaggcaccaaggcatgaagggaccacttccaccaccctgccccttcctcccaccccagcatcccagatcctgacctgccccgcgctgagattccagatgcaaaatcacctacagatctgacactccagggcaacttcggataaactttcatgttcctccaggatgtgagcccgaggccctgtttcatggcccagggactcagggcacccagacctttatcttcaccttgaaggcttctcacccagcaggagtctggctgggaatcctgtaactgtgagaacaagtctgtctccccactcctcggctagtttcagagtcttgaacaagtgctctcaccattgcttggcttaaccatgactagggactgaaaattcctctcccaaatgaccattttggggattccataaactaacacatataaagcgtctggtccggggtgagtggacattcagcaaatgtttgttctttcctcctctttcctcccaacccaggttgcgtcttgtccctcatctgctccctttttccacctcatttccaaaagacccatctcccttgctcctgcctccatgtaattttctgcaaataccccagcagttcccacccagcttattccactcctctgggcttcacatcttaggataactctgcctaacttaaatagctctaagtgtcccaaacacaagggggactggcagggaggtcccagttctggccactgctccctgaacagcagcctccacttctgggaagtgacattgtaaagttgcatgctccatgtgctatgagacaggagatctgccagccatttggccttgggcaagcccctcaaaccctctgagtctctttattcataaaatgaagggattggtttggattcgatgaattgtgtagtccctggaatattgtgacatcagaaatatatattgggtcttttcctctggctgctggcacggtgcttctaaaacctttggagttttctgaatgattggtggaaaaggagcatcttttgttattcacagcaagcccttttccactatacctgagtttatgttcatgaggtgactcctggaggatgggggtatgttgccagaggatccacacatgtaattagaggatggcacttcagccctctcctctggggaagggagaggggctggtgattgagttcaaccatcagtgggcaatggtttaatcaatcatgcctatgtaaatcagcctccatcaacaccctaagtgaaggggttgggagagcttccctggtggtgaacaggtggcgatgctgacagggtggtgtccagagaggacaaggaagttctatgccccttcccataccttgctgtaggcactgctgcatctggctgtttatctgtatcctttgcaacacccttttaaagaaactagtaaacgtaagtaaatgtttccccgagttttgtgagctgttataacaaattatccaatctgaggaggggattgtgggagcccctgacttataactggtgggtcagaactgcaggtgacaacctcagatttgcaattggcatctgaagtggagacagtcttttgggactcagccctttaacttgtgagatccaatgctcactctgggcaggtagtgtcagaaatgaattgagttctaggctacccaagtggtttctgcagaggattggagaattgcttggtgtagaaaaaagccccacgcatttgctattgtgttaagcatagagaagaacggtttgttttccttttagtcccagttctatccactattaatagctgataatctggaatatataattgtatgatctttttgaagctcagttttcccacctctaaaatggggataataatacctgcaaaactagctcaaaatgtggcattcagcaaaccagtgaatgaatactgaaggcatgggggaggtgggcctccaaggggcggctcttcacctatcagcagggacatgttttaatattttaataattggtacgttgcaacctggtatggttgtccagttgagcaactggctctgataggcagcatgggatactgctgtgattctaattaacatggttaacttggtacaagcattcaattcagtgtccattccactacctccatccccttccacatattttccatgtgctatattgtttcagacacacacacagacacacatgcacaaacacatataagatcactcctatgttctagataaagacactaaggacaccgtttacgtcactctgcccatggcaatgatgagcacagtattttcacccaatcaccgtactgacctttatccacagatgatgatccagcttccacccaaaactcctcaaaaacatactgcccttctcttttgaggcaagccgtatctctgaactatgatttgaaagggccagcttttggaggatggaaaacacctgtatttaataagattctttggagacacatgcatgccaaaagaacccaactccctcggaggctgttttgcctgtggctacattctgcagttctaagaatgcaggggggtgagaagtggcagcagctcgaggcacaagcacacctttaaaggcctggcattcaggaggtgactccagcgagctccaggtcaactgtccagccccatgcacattttggtctccactgaaatgcacacaaaatacaaatcgcactgctaattgcagagggcaggaacacgaagccaaagtataaaagcgagaatgatgactttctatccaccatgtccagcacgttagtgactgctttatacagaggcttcattgcatatttaaataattgaacaaggacataaagaatgcagcctagctgggagagaaaaggctgccttcagggctggtgctgcctacagactggggggataggcccttgaatttatagcccctagtgtgtttacaaaatgagggctttaattctcctattgttacagcaagattggggaaaacagagctctagggaagaacagggacctggggaagctaaggaagaaatgatttgcaggtcacctctcctctgtccaagtcacctcagccttcatcagtcccaaagacaagccagccctaaccccaaccaaccctccaaatttatactcaccttctcagaaccacagtgcccaatacaaaaatgtaacgcatcatatattttcttgctgttccccaagtttataatgtcattagtgtgatctatgacaggctggttcatagagagagcaaagtaataatataaaaaggaaatacccataacctgaagtggggaggggcaggcaagattgatggaaagtgcagttgtctggaggaatggcaacccagtaattgaatacctggagtgggggtggtgcatgggtggggagcgtgttctgtagctggatttgcttttttttttttttttttttttttttttttcacagcagggtgaaaggcatggcaggggtggtttggttcccttgggttggatcccaggaatgccttccctgcaagaagggaagcagaattgctgacaaagtaggttggtgatttccctccagagtccagtcggtgggtcaatgcccttggtctgctcctgtctcagggcatggggcttatttcagcaccaggggcaagcggcagcccatgagctaggactttctcggccttgccggctcttcagtcctggagaggacttgatccttttgataacggatttcatcctggctctgaatttcttttcaggggtgttggggtattaggggatgttgggagaagctttcaaacacagctttgcaaatcaaatagaattcattttgcctcctctgatcttacaactattctctggagtaggcaggctggttgaacttcaagagaagaggcgttcctgagagcctccttggtgagcttgcacacctgggggccagatgtgctttgccctccttgcaaagcctctctagtctggtgcccagagaatacagcttcagcagcagctcactttgcttttcagtttagatgagaaaaaacagcaaaatagtccatcaaggacaaattcttgccaatggatttgcttttgcaaggaagttcacctttgttcctcaagcatcatctttaagtgtgaatgcctgatgggaggtccaggttggcctgtggaggagctggggatggattccaaaaccacctggggaccagtggctgctcctgctcagtagaggggtgggcatggctttgttaatggctacccaaggctctggcagctgatctgaaggcccagggctgttatcataatgccatcattagttgaaacaaaatcattctttgtaactggaatatagttactataaacaacatatgttattgggcattctatttctaataattgtaattatggtagaatacttgccattaatataataacaacaatgattgaccagttctctgttccagtccaataacttcacctgaacgcattctttgttcaggaaaaaaaaaaggtaattcaatatccctgatagtcaacaaagctactgttgaaatggaagacgcacagatgaaagcattcctgagatgcaagatggtgccgggtagatgaaaagccacctgtcagcctcactgttagctaacaaaaggacactgtctgcatcccctcactcaaagggtaaaaggaaatgaaaaccccagagatttgcagaagagtcaccagggcctgggtataccttcattccaagagagtgggccttgggctggacgttcagtggaactgcaggccctgagggtatgggtcaccctgttaggtaaaggtggtcgacctaagccttgacttgacactcactctataatcgccagcccccctgaccactttttgggcatggatttatcttgggggctttccagctgctttctacttacaatgacagaactttagagatgatgtagaccaaaggcctcattttacagatctctaaacacagatctccatagatcttcttcacctttaaacctctcacaatgccttgagtatggttgaaatgcttagggtaatgaagaatgaagagttaaatcataacaaaacttcagattatcgtgctgtgagtaagctcttcccctagagtggtgacaggacataggtgtctgggggcttccacaaaatcaccttttaattgggtagtttttttttaccccctactcctgctactatatcttcccagaaaaatatacagtaatgttccacagagggatgtttcagtcaatgacaaactatatatatagagcagaagtctcataagattataatattgtgtttttaccatgctttttctatgttcagatgtgtttagatacccaaatacttcccatcgtgttataattggctgcagtattcagtacagttacctgctgtacaggtgtgtagcctaggggcaataggctatgccatatagcctaggtgtgcagtaagctacagcacataggtctgcataagtacaccctatgatgttcgcacaatgacaaaattgcctaatgacacatttctcagagggcatccccaacaataagcagcccatgactgtatattgctaaaataagtacatatagaatgtaaaaatatagcaagcaaaacaaaacaacaacataaaaaaatcctcatatttacactagcagccaggaactgtcttttgagttctgaggacaatgacctcctttcactgaccccaaatggctggagtcagtcagtagtccacacatacttctttacttgtttcctctttgccacattcactaggaagatgctacaacaaccatcgccaggtggccaactctggttcacctctatgctcacattcaaaatggccctgggattgagctgggtagaatgcagcctccaaacctagaccagaagctccccattagagcttccttttcttagaataaataaacatccaaggtaaagaggagccaaaatgtattccatgtgataagggaggcatgggcgattccaaactaccccagagcccctccctgccatggcctgccaggctcaccatactatggctcatgggaaatggagaggatttcagtatggcagcaagagcttagtacatacagctccatatccttctctcggccatttcctccagactaattcctttctccggggccctggcatcccatcctctgagatgctgtgaatccccagcagtctttgcttgtgtcaggtatagaggggtttcccacctggcttggagtctgggtgcttgaagccatcattcttctaaagggatctctgcattgccctgggacacatggtgggctcttattttattcttttttttttttttttttttgagacaggatcttgctctgttgcccaggctagagtgtagtggcttgctcatggctcactgcagcctcaatctcccaggctcaagcaatcctcccatctcagcctctcaagtagctgggactacagacaggcatcgccatgcccagcttacttacttacttacttacttttattttttgtagaaaaataaaaatatttttctattggggagagtttactatgttgtcctgactggtcttgaactcctggactcaagtgatcctcccaccttggcctgccaaagtgctggtactaccacgcctggccttattttattcccttctggttctttttccctctttctgagcaacagaaggaggctcctcttctatacttaaaagaaagaaatttggtacaagaagagcaaacaagaaagaaaaagcagaaatgcaaaagcttcttgcaaggtaattaaatgattagaggccttcaaaatccaccagctagctcaattgtttttgctttcagtttactcttgggcctctccgcacatagaacctctgccagatatggcagtctggaaagctggagagaagctgaggaccactttgtctcaactcccatcaagttatttgcaggtttcagaccagaacaagaaaaggattcttctcacatccctgtccccagccttggtaggtcaaccagtccttctgctcctgaaaccacaccctgagacaggcctggccaggctgatgagactgtgcagccttttatcaaggacatgcccttgctgtctgactcacctcattcttattacctttatatccatgttgtctttgttaaagtagagaactgacacataagtatgagattcacactcttacataaaatccaagatgcaaccactctcctccctttccctataaagggacaatctcagccagggtctcttttcctgactgtgaatccatagtagctatttccaggcatgaacagattcccacagagagggagttggttttgtgtctgaggcttccataatctcttcttttttctgtctgaaacttgcaaggaacttcatgggagctgagacaaaggttttcagcctctctccagctttccagactagtgtatctagcaaaggttttatctagcaaggaggtccaagaataaaatgcaatcaaaacatttgagctatgtggaggcttccaaaggccccaagtcatttcattatcttaatgaaggttttcaaatttctactctttctttcttgtttgctccccttgtctgttactcaatcaggatcatcctctctccagacaacatctccactccttgcttttacttctaaaatcaatcaccctgcttactgtccacctgtagaactcctgctcagccatcaggattcgggcaaaacgggatttgggccgggattttctgatggctaagcacagtgcagtcactacccaccgtgctatgggagcccccatgcagcaggtgttagtgtggggtgtacattgaccttccctttcagcctcatataataaacagcttctctcctcccatgagggtttggccaaaggtaggattcttagtggggtatgagtctgggatggggagggcacttgatgggcctgtgtgttctctcaatgcccctcctgcccccctccccccaccaaatcccctatgcttcctgcacctggacaggtcccttctctcacagctgtggggctggccacatggtcatgacacctgtgtggtgtgttaaaggggtctgaaagatacacgcaagactaggggttgcaggtgaaggtgctggagcctgctgagtccaatattggctgagagagtgcaagaaacactgtcatgtttgaacaacagaattttccagaggtatacctgttatcccagaagtccttgcccacactctgacattccaagacaggtaacagcataggcagaaagtatttttggtacagtgaggatgagtgttcaagaagaataaaaattcagagggaatagaaaagtcacattttagccttagagccaaacagtatctcagcgattcttcaacctggaccgagcatcagagccactgggagggcctgtttaagcccaagttgctgcaccctgcccccggagcttctcattcagttggcctagggtggaacagaagacttcgtgtttctagcaagttctcagctgatgcagattctgctagtcttggaaccacgctttgaaaaccaccgctctagctcacaagctgaccattctttcattctcatctctctcccttttactcagcttgccctctttgggggtctcacttctcctctgtgaacagtgccctgaggaacagctgaggagtctggacacagtcctgctgtgtacttacaattatttctaggacacaccaacacacccatctctttggaatctttctaggacccacctggtgtgtggaggatccttctggttggagtgacctggaatacacctttgtctgtaacagaacctccagggctgatccagaacccacagtcccagcacagagcttggcatatttcctgtttttataaagtggacccttaagagccaggaagaagggggtggtcctgcacagttttcctttggtttctcctcttaagggaatgcctctcttctgtgtcccatgctcacaacaagagacactcaccactctggctgccagggacctacctcgggcagcttcactcggccttcctggaaggagcaggtcttggggtcatgggtgcagacatgccggtatttacaccagtggcagcggtatggactctccacgcaggacaggcacctgggcacaggggaagggaggcacaaatctaagaacctggatgagcccaaagcagagggcttgagtctctatggtctagcaaaacatttttagtattaagagaaaccaccgttgaatgtgcaggaagggcagatcttatgcacatctatccctttactccccaagacctcaggaagctaatggtctctggtttcctccctttcccatatgtagctgacaaccccgttcccccaaggccaaattagccctcctccatctccatgggataacatcctccttttcaaaagagggaatgataaggtctggagcagagggcttgtgtagacagacctaagagttggggcaaacaaaagattaggtttgtatgcaaattgactccgggtctctgctgctgagaagccacctgcaccttgcctcaggaggaagtgactgaggctgctgtctcactacgatggctcctccatggttggcaaccccacctttcccctttaccccaggaaaccaagacaattttataagagctcctgactccttaaaagcccaacatggttcccttttccaaaaactcaaatgcctctccatacaggctatgcccttcacggtatagatgaccactgcccccaacgcaggtttgttgctttggccacgaataggccacactctccccacaagccattcctccctccagagcaccatttcttctgtcctccacctgactacctgcttgaccaaggaagagctggtcaccctgggcccttctcccgtgaatctcttggctgacatctctcggacagtcctggccatcttgtgtcatatctcaccattacctgtccagctcctctactagtctgtaggccatcaactcctggagggtaaggattgagtctttgtgttgcattgatttttgactccactgtgtctaatgagcaacacattcccttgcacatgggagatgcttaaaatcattttatgggcttaatgaaagcttcacacatgatttcacctatttactctgcttccccagaggggaaagtggagggagggattaggccaccgagtggtaaagacagggacagctttgccgcaagaggcaagaggagagtcccagggctagagtaactcatttttggctgggagggccggatgccttcttacttggggccccaaagagagctaagctctagactcacagctgccataagcagatcaatagaccctaaaattccaccagcctagatctctggtcatgtcagctacctatcatgcatggagggcaaaacaggagtatgttaaaacaagcagggttttttgaggtcaggtcccacggtttgctctgtggaactctggggatcccatggagttcctttggagaatgtgtagttttgtggggcttctgtggagaggggttccaggccccccaacctttaatcagaggagctcctgcttccatctattctgtatattgggcatccacacctactttcagtttaagatttctatggtgagaagaaaaaaaaggctggcccattcacaacctggtccaaccccattatttgataaagaaaagataatataataatggcaagaacacatgtggtgcctaaacactgggccagacatggctgtaaatgcttctccttagcatggcccttttaccccttgtggctgtcctgcagggtaggcagagccgatattcagagctagcagccagcacagggtgccagccagtgactgctcagatgggacagtgctcctgccacgtcagttggtaaatatttgtgtgacgcccttggaaggagcactgtgatttccctgttgatagaggacactggggcacagaagggttgagcttctcagctggtccggctacagagccagagcctcggccctccccacctgccactggaagttggatacttaagtcaaacaaagctcgagttggagtcaggcttcctgacccctaagccagagtccgcccccccccacagctttctgcctccctctggcccttaccagcctgtctgcactcagcctgggcagcctgtggggagctgagcatgcaattgagtggttagaccacttgccccaatcctggacacacactggggcttctctccctcctcagttcccttctctgcccatggagcttgctctctgttcttcatgtgggatgcaccaccccacaacagatggtggagatggaattgagttagaaggattgatgtcagggaagatgtatgcgctagggatgtggagagccccactccataagttctcattttctgctcttctagtctctttccattaaccctgtgggtaccagaggagagggagtgagggaggcctcctctggggcttctaaatggtgactccctgtgggtaccagaggagagggagtgaaggaggcctcctctggggcttctaaatggtgactccctgggaatagtgatggggttttctgatctttggatgaaacttgaccccaggaacgggaagtgggtaaggctggggccacttacgaattgtggacgctgcaattgtagaagacaaagctggtgctggcgaaggtcatgccggtctcctttgatttgagctgaagctgtacgacatggtggtcccctacaaggagagatggctgaggggtcagggaatgctgaggccccaagccagggattccctgaccagtgacacctgctggaaaagggagcctgctccccaggcggctgttggcttaacagggctctgactcagcagacccagtcccaggacaaccctgagagcagctgcagagggcagttcttgtctattctccctgcccaccgtatcacttccactcttccatgtgtacacacacagatgcacactgccagggattcaaatgtgcatttgcatgcatgatgtcctgcccagactcacaaaattgattcataaccaggagaaacacatatgtagacttctaggaatctaggaatgctgccacaaactgcgcaagaagttttgcatgtatgtgtgtgtatgcatgagctcattccctgtctctgtaaagagagcccctgttctgacaccacttcctctggggggctcagggctccaccggggcgggagaccctggaatcctcatctggtgccagggaggagctgcagcccatgtttaattcacagccctgaccctaggcccccacttcaagccttgttctttgccttccctgagagcctcattaatcaatcagctctgaacaaatgtgacaagcacaaatgggagggacaacatggaatcaatctgcccaggctgggcctgtccctcaccagcatggagcctctgcccactcctgtctttcccagggcagcttgcccccaacaacaggcagctctggggagacccggtagggcagagttggggaggcagtggtccagggtcagagatcggccatgtgagcatccctgctccagctcagtggcctcctccactgacccgccaagccagtggtgcaggctgaacttaaccacatgttctgctgctgtcctggcctgcccctccccaccctctctgcagctgttccttgcccaggatgagggtgactcttgggggctaacctggggctgagacagaagggctgtaacagtcaatgccaagggcaatggagggagatcccatccccctcttcccataacacacccaccatcccatgccccttcctctgactctctcctgcctgcaggttgctttgatccccccacatctgtcctgagttctccttatctagccaggaggaagaagtgccactcagctgtgcctccgggatgctcaccattctctgtgatgatccggggcacctccttggctgcaggggagtagcactggatctgattgcccacgaccagcccatccatctctgacaggtcctcaaaggtgcagttgacgccagctgacagctccgggacattgtacgtctccaggaccagctgtgaacagccaggcggggggagagaaggaggagggtgaaatgggaaaaggacaggtatggaataaaaaaagaaagtgggagagtgagagagatcacagggaaagcaaagacaagcaagaggcaatattaacatggagaagagactcaggttattaggagagtggcacagaggccgtggtgagatgcaaagagacagagacaaaagaaacctcattaggatggaaatggatttggccccaggaaacaagaatgcttaagggatttgcgtggtgccattttgatcaggactgaggcatggctgatggagcacctcttccattaggcccaattttggaaaaatagaaacaccaaccaccaagtgctcagtgctggaacttggaagtcacctgtgcccctttctctctctgtacatgcatctttcccattttatagttgaagatatcattcccaacaccctttgtcattctttgtcaccctttggtcatttttggtgatggtgctccctgtctttctactctttatgaatagagcctcttccccaatagtcctgtccctgtctccttcttgcatccccccgtagacacttaattctttgatatcctgcacccttctcttgagctgcttctgctggccgggcttggcccagtcctccagaggggccttgggctaaggcactttttagtgaggggagagttttccttgcatccctggaccccaccccaacccccacgacccttaccagcacgttgtactgagagacggagatattgttgggatggaccgtcagccggacacactgcttcatctccgaggcaaacctgcggggctccttggaccgctcacaccgctccttccgggtgcaactgggaaggacataccctcgagttactcaggagatggccgcttggtccagggaggggcggatgctgaggtcaggtgtttccagcagctcccaggatgtgtccaaactcaatgcgcccagagctaacctttttgtgtccttcctcaagcctggtcctcctccatcattcccaaatttagaaaagatggcaatttcaatcacctcttgccaaaggcagaaacttgagagtcatcctaactcccctcatcctctccaaactcacataaggtgttgcacagttctgtctattcaccctctctgcacatccttagcccttgccattctcttctcctccttaggcaaccagagatttgttttcttcatatagaaaatatacctccttggctttgaacatgccagttcttctgctggacttccttttcctcacttctccacctgtccagttcctactttttcttccagccatggctcaagatgcacctgcaatctctcctgcccaccctaggcaaagtgaagagcttcctcctatgatctcatagcacctcggagtctcctactttaataagtctggaatttcttagattgtatgacaattattgggctaagtgcagtcctctcctgccaagtaggagcttttcaaaaaaagcagctatgttccatttattttagaatcccctcatgtaggcaggtgggagagagggaaggaaggatcaaaggagctaagaactgtagttaaaagcttgctctggatcagaatcctggctctaaggtttgctgttactcttcagtgctctgtgctgtgtaaagtgtatggtgtcacaagtggaccatgtccagtgtgacctgggatcttgcagtcctagctgatgaaggtttgtgaaagatgcatgtaaaaaacatggaactctcctgaaatgcaggcatcacttgaggtcactgcatggaggcatctgaatttcagggagcagtatttaatccaagtcaggtgaactttgtggacatggggcttcaccaagtggtcatgatttggaaactctggactacagattctgttgtggggtgggggcaagcagggtcctcaggagggacaagacaagaggagatgagacagcagggaaatcactccagagttgctgatctcttttgattaaagagaaaagattttgcagaggaaggaagatgtcaggagctgttgcagggcaggagagagccccaggcaaggagtttattaggacacagaacagccagggatagggaatctacatggggagggagccttggggagggagccttggagagggaacgactgtctcaggaagcagacaggtgtggtgtggggcaaggagatgagggaagggggtacctggacaccctgagctgctattggggtaactcaggcttagggaaagctatgggggtttctcctcctaacctttggccacagcaagaggggcagcctgggtggagagcctgagaggagaatctagcaaatgaaggagaaatcattgaaggccatggactgaagctgtccctctaaggatgggataaatggaggaacacagggacagaacaaaggacttcagagtagattggatgtgcaatgcgaaagtaaaaaacacccctgaacagtacattcatggctgcgaggtacaagtgcttattaataggcacatgatatggagtttacattgtctagcgtttaagtctcataacaatgctgcaacaaaccccaccttgtcaggatgtgttgggacaaagacgcaccctgcggcctgtagagcctacggagctctacctcctgaagcttccagactgaggagtaaggggcagaccccttgctgcagactaagctggttcttctcgccatcctgatgcccccttcatatccttagggcaattcaaacattttcccctcaatctttctgtctaggctaatcgctatttttgcctggcactgggaagcactttgagtgttattgcaacttgttggacgaagataaattctccagggtgcttctagaaaaccccctcccaggagtgaaggatcaggcatgagtgtggtcacccccgtggcacttccttgctgctccagctgaccgatggcaacaagagcgtctgcctaaaagacttggaagttaatttaccaggccagctcctctgcgaggactccattaccttcagccattaagctaatgttatggacttttccagagtgtctgcactgacatcgctattaatagtgttattactcccattaacagcagacccagagagctggtacgggcttaaattattcactgactccccaactttgaagttcctatttctaagagcaatcagtaggtctgaaaaatgtctttgattaaattatgaagagagcgaaaagcagagctgtttccaggccaaacatcacctggagttaccaaatagagattcagatagaaaagacaggactctatctctcttccaggggtagggaggaagaggtggcacacaggtgtttgctcgggggatctcaggacaaattctacctgcattgcttgctgcttccaaagttcatggggttgcatcttgccactgctcctgaaagccccaaagaaactactcatcatcttcccccaattttaggttttatagggaagccacctgtaatttacaattttaaacatcactgtataatcttgggcaaattacttaacttcttggtgcctcagctttctcatctatacattggggacaaaacagtacctacctaatacggttattatgaggattaaatgagattatgtgagtaaagcattaaggacaggacatagctcatagtaagccctcataaatgttagctagtattatcatcttatcctttctctgacatcctcatttgacctctccaaactgtagctgatgcagaaccacagatttattttattttttatcttatttttagaatgagtgttttttatttttattttttgagacagagtctggctctgtagcccaggctggaatgcagtggcgtaatctcagctctctgcaacctccacctcctgggctcaagccatcctcccacctcagcctcccaagtagctgggactacaggcacacaccgccatgcccaactaacttgtatttttttggtagagatggggtttcaccatgttgcccaggctagtctcaaactcctaagctaaagcaatccactcatctcggcctcctagagtgctgggattacaggcgtgagccaccatgcccagcccagaaccacacatcttctccatgactggcccttggggcaaatcaaagacaaaagaaaggcacggctgcagcagttttcctcctaataaaggagaaggacaacccagaggccaggagggagaaaagagcgaaagaatggtctggatcatagctctgttttcttactagttgtcaaagggtattgagaactcagctatcttagtggaaagtcaagtgtaaggtcagagccagggatgttttgacatttctactatcctccaggattcatgagggtggaggctacaaatgtccaaaagcacagacaattgaccttaaatgtgataggataatggaaggcgaggcacgaattcctgctggtttcttgtggggtctgtcaagggaatggtcttctgcttttctaggactgcaattcccaacagcccagactagatctgggaaccagagcaaaatgttaattcacgacctgagaggcaggggtagtggcttagatgtttcattccaagaggcctcaggtactcctaaagcatgtccctcagctccactgtacaggccccttgacatgaaggaatcccctgcttcatccatttcccaggtaggaaaactagagctgaaaacggattcagacagtgcatatactgtgtgacttggagttttctgacattcttctctgcatgccagtgtcacccccgccccaaatgcaaaccttcagatggccagcaggaagccgaccccaagaggacacaccagacccctagagctggagtccctccctgctaacctcttctgacctctcttcctcattccacttctctgcatttcatcttctccagcctcagatcaaaggtgcaaaaagcccttggggagaaaggctctagggcccctggaaggggttattattcaagccagtggttccaatgagattatcctctctaatgaagcagctacctccgccctcccctaagcctgaactttcactgctggagaattcccagccaagtggaaaattagaagggagaggaatgaaggaaggaagggggtgagggagagggagagaggtggtgattaagtcctctagaaattaattcccaaatacagcgatagaaatattaactcccggtgccgctggccaggcaaacaaatttcaatttggaaacagggctatctgtgagtccagcctgagtgaaccgccaagcttggaggggctgttgctgatccatctccctgggctctctagcatgtgtttaccaggcttaggcatcagaacttgctccctacttctccctgcagatgatccccaatccttaacatttcacatttgccatgacctatgcttaaggtgcaccatctgtgcttagaattgagaagattgaaaaagaaagggggtaaggatgagggccttccccagcagacctaatagaaaagttaagataatttagaatgcctactcacctaggagattattggaagctttggtcattgtcatcacatctggggaccctgacaagggaagagactagaattcctaattcattatccttgtcctccttaagaatgaccacagtaatggatagatgcatatgtgtggcttggaggaagtggagtagctagtataggatccttcctaggcaggtgggtgtgtaagaggtttcttatatgtaggggtagatcagatgagtcctttcaatgttacaattctaggatccaatgactgataccatggtctcaaggaagttgaagtatttgggttgtgccatgtaatacttaggatgaatcccaagataggaagcccaaggttctactgtaattttccctctgccatcagttgctggcaactgggcccatggtcctttgccatctctaaagatccaaaattaacctaagaagcagctgaatcagatttacccatgcatcccctacagaaggagggcataggacttagcagaaaccagcaggttcaggggttgagtggagacccaagaacctttctgggcttatatagcaaccaaggcaacctgtcccaccataatcagctcagatgctgggcttgcagccttcattgagaagccatgttctgccctgggtccctgactggattctgaccttggtagccatgctttgaatgaacaatctattgaacaaaaccttaggtgagaggtaaaaaggacctgtaaatgttcgtttttttccagatgatcccaaaccaaaccaaattacatgtagcagctgccaaaagagaaagtgaagtgggcttgtctttctcttttcttcatcagtggctagctctattagggcctattaattttctactaaggttgaggagaggttaggaaagaacaggtgtggagcagagcaggagtggagggagggagagggagggaacggcaggagaagggaaaaaggaggaggagacagcaaaggcatcgccacaggtgaatccattctctttctaatccagtcggtaacaaggagaatgctgcctattacctgagacacattccaacaatgactccagttgattctcatcaactttacactatactttatccaacagcctggtgtcttcatgtccattaacgtcaccaagtccagtaggcttggtgcaggggagcactttgctctgtgcaggctgggctgctccatcctatgtggcccagtgcagcatgattgaatgaagtgtgtgaatgctggaatatgggtgtgtatgtctggagtgaagcctcagaggtaggccagctcctctggttgtccacaggtatccaagtcaatagactgggagggacattgagagcttgagcagaccacagggcttttctaatttatatgggaagatggcatttttgacttaccattctctggtcatgaagcatgtgttttgtgtgtgtgtgtgtgtgtgtgtgtgtgtgtgtatgtgtattgggggcttggcggggggcagggttaaaaaagaaaaggcccatttccttaagtcatactatgtctctgctaagccattggagaggaaaattccaatgtactagtatctgatctagtctgggactcatttctttggaacagaggctgatagctttttggcaaagagtcaaggaaaatctccttgcacagactgcaaagagtttgctgggtggaagtggacaccaaccattcctcatgactgtgtaggccttgtgcaagcagccctaggagagatcagtgaccagcagattagtgttaagtagcccttgaatataggtttaaaaaatgagatagcaaggctgtgggatgtgcctcagtgaagcaaggcagggcttgcattttgcaatcagcttgtgtgtcattaagtggacattggcatggctggttgaagccttccaaggggaggaagacttcccaacagtgggctggctccagcaccagccacagccctccagtcctggggaggagaggaatggaaggggagggggaccaggaggaggcactgggatccaactccagcctctgctcccacagtcgaggccctttgggccacttcaggcatgaggacctgctgcattgtaggcccagcgaggggcttcatgcaggtcccctcccttaattttcatagcatggctatgaaattagagctgaagaaactaaacccagactgggtctgttcttagacaggtcctcagttgtaactaagttgtaactcatctcttctgctctgaaaagcagtgtctttcttgtctttccacttgccatcttggaagaaaccatatagaaaagaataggagtgactcttgaaaagtaacccctgccaacctatccagaggagggcattcttccaacagaagaaatctgggaagaggcagggtcgtgagggggtgaaagggagactttatgaaagctgatcttatccttcccctgtgatgtcttgggttacatgagcctcccaggagtgatgctgatgacttttcttaagaaaggtaacgcctgggccaatcgatgcggctgggtctgctgggcaggatcccattacctgctgagactgagacaggcttctttgcctgggcacgaagccatgggaggggaagatggagagggggctggggacctgccaagcctggtcactggagaaaatgtttctggcccaggacaggagatagctgtgatagggcgaaggcagggtgggcttgtacgctttcctttaccttcacccaagtcagaatgagtcagctcaggaacaaggaataaaggctcaaaactcagggccacctcaatacttagcattgctgaagctgtcattgccatcagagatgggcaagcctgtgggccagggtcaggggctgcaaaagagagcaactgagtgaccctgtgtgctaccaggttggcaggcgagtgcttcatgacaattgagagtagcaggagagaggatttaaattacacgagcctttcttaagcatgttttgtgcaacccacctgggactttgctgctacaaacagcccattcagccacatgagccacctgtttacagaggccctgaccttgcactgctcaatcacatgtgctgactctcaacccctctctctgccttttccttcttcctctcttgctgtctctgtctgtctctgtctctcatacacccatctgctgcccttctcttccacaatgctaccaccacctcactccctccaaccatggggaaagttggcaaaagtgactgagaaaatggacttctcttgacacctcaaggaactcttttcctgccgtcctggtcttcctgagtgaagatcaggcttgttgaggccacttagcaagcaaccgagtcacttggcacagggtcttgcccatggtgggggcctaacaaatgcattgattctagtaaactcccactgtgaatccaaggcctggttccccaaaatctttagggcagagatgacctaacagagtcgccttcatatcactgagcctggcacactgctgggcacgaagggagaagggcaggtctgagagatctacggacaaatttgtgagtgtggacacagcactccttggaagcaattaaacctcccactcttgccacctgtctcccttcctagaaaatggatgcccttcagagcaagcatccataggctctctctggctgccgtcaacctcctgtactgaactgccagcccccagccttctcctttctctcctgctgagcccacttcctcatgtgtctctccaagccatggatgtccagtttactcttaagaaaagtgaaagggagggcagatcaggaggagcaatatctggctttgacctgaacctgaggaactagggaagaaaggcccactgggaagaaggagagagctctctggataaagaaagtgttctatatcttgatagacatgtggattacaagcgtgtttgtctttgtcaaagctttcaagctgtacacttaagatctgtgcatctcattccatctacatttaaaattgtacctttattaaaaatatcttagaaatccagggacctactctacttatccaggaccggattttagaacctggatttcaggacctcagaaatccatacctgagggatttcagactttcccttaaggaactcaaggactcattatgcctcagactgccactcagagatggggagggtgcctgctcttgtatcaaggatgtattcgagtttaagagggtatttttagcttttagaggcactcttcgcaagggagtgggggaagacaagattttacccccaccttcttatagttgccagggggctctccttggtcataactctgagagggagggaggatggatttactgagtgcctcagcgggcaggcagccttggcctatgggggctcttgagctttgtcctggaagagttgggctttaccagacacattggcacaaatttatacctgtgtctgccttcctcaggtcacggacataaccaggaggctcaaggttacgaatgacagcaccttgccctgacagagcatcttggaattctgtaacatcctatatcaatcacctctttttatcctcgtgccatcactgtgagaaggtaccgttctccctctttgaaacaaggatgccaagtttctgacatacggagttatcgtggaatctatttgcaaattcaagtaactgctaacgtttatttgtgacaaaaatcggtacccgtggacacgtacagggcagtgaaaaatttgagtgatctggcacgcacactcccagctgaggtgggataaggcagcctcagcttcttgttttagctctcgctctatgaacaagtgtcctcttcaagccctatttcatgccacatttttctcattttgcaggtgattttgccgcttaaaatagtccccgaatgtagtgctgaaggtctgtctagtgatcctgagtgcaagaaggccatggtgtgccttatggagaaaatagctgtgttggataagccttgttcaggtatgtgttatagtgctgttggcagtgaggtcaagcttaatgaatctattatatatattaagtaaaatgtctttaaacagaaacacacacaaaacaaggttatagatggatttgttgatgaaaatgtgaccagaggctcccaggaacctaaccctgtatttctcctaggagcaatggcttggtattcactaactccgtgttccagcgactttatggaacatatctaccatgtgcaatgagaactgactgcacttgtttaaagccccacaacaagtttccaaggcatgtgaacttgagtccactgatttccactccagtaatcttcccagtgtcccccagtgcttcaatgcgctggctccactgtggctccttgagcaacgaggtgccagcagcagcagcagacaatgatgaccacaaagacaacaacacttgcacagcccctgccttctgagagcctgtgcttaacaagggctggtgctacatggaaacacgaataagatatacaagtgtcagaataaaacatggtgccagactaaaggggtgaggaggatctagcaggagtacctgccacttagacaaaggctgggaaccccccaggaagagaagcatgcagttacagtagagccatctggaaaatcaccagggatcaacagagtcacaagaggggggggggcacccatgagctcacagtccttccccagccttgtcaacattcctgccccaccctacactacatttcccagtgatccacagctcaccagtcattggtcctcataccatctcatttgattccccagtgactcagtgaggcaggggagacaggcatcaccatgtccaattcacagaggaagagctgggatgaggagtctgcacttgggggcaggcgcccaaaattcatgtccatggctgtttttatgccatgctgagactggagcagctggcttccccgtgcaggctgagggcccccttcatgaactgcccagacttcaccttggcctccatccacccctgttttcttccacttgacaggaggcaggtatgatgttacagaagggtaaactgaggccataaaggaagtactgtcttgtgcctcctcctctcatgtctgcttaccttgcagccctgggggtgggaggtgggggttctcacagtctctctggtgccttctccaagccttggagcccctctgttcacagggctccgtgctctgtggggctgggacagcattgtgggcagagaccaaagctgacatggaaattgccactgggcatggagtgtcagggagggaccagattttccgattgcctttgaattatgccaggtaggaaagccccatgccaggatcgcagagctatcctcagccaagcagaaaacagggtagtcaaggcccccaagtaaggcaatgagtttagagtacagtcccttcctcagaggcctcactgggtgacacaaagaaaactgccccctgtctgcctggcaaggtatcattcagggaacaattctggcctgatctgagccaatctgcattctgaatgcaacctctgccatcctcttctatgctggccactcctaggctcccctgctctgttagcatgcaacctttctatacacttgagtgcacagtttctgatctgtctgtgagttatgtatgtttcagacaagactgggcacgttcagggtggcacggccatagactgagttatgtatacttcagtgtagctcagtggttcttgacttttttccactgtaacctacctgaggaatttcagaccttcccctaaggaactcaaggactcactatgcctgagactgccacccagagatgtattcgagtttaagagggtgtttccgaattttaagggcactctttgcaaaggggaggggagaagacaagatcctgccccaccttcttatacttgaaaattattggtaaatgtcattggtcacatgtagttcaggttcttagtaggaagactaaggtttttcttcttaatttataatgtctggatccagctcacaaagtggcacatttcaattgttggccagaaacaacaatagctggactggaatcaaatttcatcagagtgaggtccaaccattcgttggcttctccaggtattgatggcaagggtcttcggatccccaaagaaaagccttcagctttctggttgtctgagccctattcctgccctttggtttatttactgtttacctccactataatgccattgccttcttccctcttctgaataataaaatggagccacacaaaaggaggcacattggcaagaggccagcactcaggccgggctttattggcccagtgactccagcccaagtgcactcacagccagctaatgggtgtttggcagcagtgggagggtcctcaggtgctacacacttcaactgcagacccaaaccagaaaatcctttggagctgttgaagtagatgttaaggagatgtggaatcactaaagggacagcatatatcttgtttatgatttcggggccagtaagaagctacagaaaaaaagatccaatgcctttttcctggtgttcagtcctggaaagtcagtctctagcccagtaagccacagtcaggaaagtccaggaatcctgcttcctccagccctccaatgtatgattgcccagcatgacaactatatcctgacctgtcatgattcccatgccaccgttgccatatatttcttaagggaatttggcaaatttaaagggaagtcagaaagaacaaaggaagggagataacatttggaaaggatgcaaggaaggaagagcaagaatagctgaggagaaaagacagatcaaagggaagggcagtgatgacagagaagcagaggaagggaattaccaggaggaagtgggaggcacgaggcagcctccccatggtactcacgtgttgtgcagcacacaccagccacagtgggggtcgcctgagccaaggcactcgccgcagctctgatactgaccacaggactccacagggactctggtgagctaggacagcaggatagggagaaggtggtcaagattttgcagaacacccagcagtgtaccagaagagatgttgctctaaatatcaagtgtatcacctgaaatgttgcaggagcatgaaggtgcttggagcccagtgtgggaagggaacttgagtgattatgtttgagtaggtggccacatatgcatccagggagacaagcagccatattattttcttagcagtctccatgaatacagactccatacagtccatactaagttgtcagaaaagatatttacacagtgttcatttcaagttttctacctctgaaaccaccaaatatctctacaaatggccaattcatcatgtatttgtttcctatcaatgtaacaagtgcaaatggtcattctcactctctcatggtttctctttttctgtagtgtttccccttctttccagtcctccttcaagtttcgtcatttttgctgctccagagagcatttagtctgagaccaagacccttctctttctcttcctccttgccatttaccaagatatcataagctcactctgtagctgttacttgcccgctctttctttctcataatgttggccaactggctctaaaagctttcactatggtgctttcaaagagcatctgctgctatttctcctcctacccacactcttttcatgactagaggcttcctctccaacccaaaactttatattagctttcaccagccgcctgctaatgtaaaatgttccacatgacatttttgcttagcccaaatgcttccatttcctacatgctcttaaatatcttttgaatttctttgttctccaatgtagctttgccttgatgtctctttacataacttgccagcacttgctacatagtaggtatttaataatgatacactggatcaaacggagtttttattttctttttataaccttggtctttattctccgttttgccggtttttttctttacaaaaagtatttttttttttttaattttacatcatcctcttccagttgggatacctttttatctcaatggagaatcctgcctgatgtttcagcttgagctaagagaatttgatgtggccatccttttaaatttcttgccatcatacaacaggcacagaaaactataaactgtgctgacctggctgaaccctctctgttacatgagcaaatgcagaggcagtgtttcccctgctgttttatggggcatgtgcctctgtaaaatgatgtctgcttggcaggggctacttgtaactcacgcacaggcaaactggcaccagagcttctcaattagtctccaactctcttttggaattaattaataattaattccaaatcccacatgatctcttttcccttaactttcttattccctttatgcatctttttgttctccaaagtacacactgagcgttcttaatgaccacactgcgctttcacttctttcaagcaaccttttagcttacctctcccattctgacggcagtgaccttgaccttggtggcccttcctccaccttctcagatgtcttttttgcacatttggaattttatcttttcttttattactgctcatgtaatctgcatgagccgtgcctggagtctgcctacatatgaccttcctatcctactaattaaccttaacaattagttccttacaaattacccacactggctccacaccagccaagaatttgccctctttctgttgcgtctttaatttctcttcctactccttaagtgagcatagacatgctagtcatgtaagcatataaatagtggctcctaacccaaagtacctggactcctagtaattcatgagtggtaatgaggtccacacgctattttcaatatttcccaaagcctaatggcaattgaactgttgctgttttatgttttttattcatactcagtgatgtatgtctcatattaaaaataggaaatatgttattacttaataaatgcagtttgtttagtagacagaatctttcaaaacataatgcacagagggaaaaaataataaaaggggccataaatggtgaaagttgggaaacataagtacacaataatgttttcatatgttccagctgcttgtctagcactccatattttgcataggcttaaacagaaaatcatgccttgctcaatcaaaagcattttctcgctctaaacttaattaccatcctcctcagtttctcctattgacaagttctataatccaccttggatggaatgtggctgcatgttctggaatgttccacatcaagtcaagagccagctgcttggtgaatctgaaattctcaaaaacctttgcattcagattcttaaaatattttgaaactggtgtttaataatgtccataccctggaattgtcaagtccctcctcctgattttaaacatgagtcattttttgttgggttggaaagaatgcaagagccctcagagctaggttcaaattctggcttaacatggagataaaaatccctcctccccacccccaccccaattcacagtttcccaaagcacagatgatgcaatggttttgtaaatggtctggcactttataagtgacggctatgatggatcgctgctatccttttcattaatatcccaatcctccttgtactgtcacttacctctccccgacatcccagaaaactcctctgacagtcttccaaggcttcaggaactctgtcaggagttcaacagacctgggagaactttttttttttagtaccttgatagtgtcatttcctccttgagctatgatatttgcccctaagccattcattgctccacactttggatgaaacctggagttatctcatttccaggacttattcactatctttattagcttctggaacagctatctgcttttcttagcttttcatttaggtgggtccatgtgagacagggacacaagtcctgcacaggtattatgagtcctgggttccagccacagctctgccccccagtttcctgggtaaacttggacaagtctctcctgggcttctttgtgatgatctgaaaaatgaggaactgggcgcgttaggtctgaattccctctcagtcctaacatcctaagctccttgttaatgctctgacaaagtctctcaggtcagcctcatctcacttgtttggttttcatggacatgtataacaatggcaccaggtctaccttcaagaaaactttctcttgaagacaatcatctgggcagctagagctttctcatcttaaaggtaaacaacccaactgcctgtagtctttccttacggaatatttctatttatgatttaaccattttttatgactctcttctgaacttgatctaggttctctccactctttttaaagtgtggacattcaaattggggagccaacaggattctgacagtccaagtagaaaggttaccattatttgagagctaggtgccacctccttcaccttgccaggaccttcccaaggaaggacagaaccagggaaatctcccaggccccaccatcaggcaatagtctccagcatggccaaggcctcccagactggctgcacagctctccatctctatcattgctttgcctcactctgtaccccatggttaattctgcaaagcatcagaagtttttctaatactttaaatcacttttgaaaactggatttagtccaaccatttagcttagtataaatgtattcccttatgtccccagttactatccacaccttgctagtatgttgcacaggtggccagatggcctctgagccaccttgtctctatgattctctttccccaaatacctagacttgccactcacagccttacaccatacaaagctgcctctcccatcccccaactccagctcctctcctgaccctggaacacaaaccactccagatgcagagccacacgattaattaaaaccaccccacgctgattaaagtcttaagctgcagtgccaggcatgctaattaactgagtgagggaattcagaccacaggaagaggtgaaaaaagaaagtaagaggggcgggggagggacttctgtttggagaacaaatcagatggtgacgtgacctaagctgccataatgatagattgtctcagagaccacaaaatattgaggtctgtcccctggccaccagactctagcaaaggtgttgattgatgtggctgcaacttcaccttcgctgcttctagagatgggagccccatcacctctggggacctccatgtgtgcataaactgtgcttggggagaaggattgtgtgcagggttagggtagggtctgcacaacattgtcttgggacatcgtcctggctttgtgcaaaaacctattaggcagtttagcagttcctcaaaaaattaaacagaattactatacgatctggcagttttgcttctgggtacacctgcaaaacaaccaaaagcaggatctcaaagagacatttgcacactcaggttcatagtggaactactcacaatagccaaaagatggaagcaacccaaatatccatcaacagatgaatggacaaacaatatgtggtatatccatacaatggaatattattcagccttaaaaaggaaggaaattctgacacatgctacaacatggatgaacctcgaggacatgatgctaagtgaaataagccagacataaaaggacaaatactgcatgattctgcttatgtgaggtgcctagagtagtcagattcatagtgacagaaagtagtacggtggttgccagggactagggaagggaggaataaggagttactctttaatgggcaaagactttctgtttgagcaaatgaaaatgttcagaagatggagggtggtgatgcttgcaccacaatgtgagtgtacttacaaatgcacacttagaaataattaacactgtgaatttttttatgtgtattttaccacaataaaagagttgaaataatccttttgagtggacttgacaaattatttcatcttcggcatggcagcatggatatgaaaacacctgttctctgcttagctccttgggtcaaaggggaacggcttttgctggtagactaatacaatcatctttatgaaatattctgatatctttcagtcaaaagataggtatcactattcttttcaacgtaatctcaaatgggttttggataaatgtctcctatcatgtatcattacataactggctctgttgttctcaaggtctggatacctgtttcctgatttggaaaaataatgccatagccttgttcttcctggaaattttccttacctctcacccattccaaaaggcctagacgaggagctctcaattcaaataactcacaagaggtcaaatggcccctgattttagaaaatcctcctgctgttgctcaagctctcctttggtatttttcattcacagttatggccagaaatcactcatgtgcccttccccatttacacttcctttccccctagatcacctttctgggaatctgggtggttttatccttttgccaccaaggtaagcttccttaaataatataatgtagtttggtctggttttaaatgattgtaaatagaattatcatttgctgttgtacatgcaatcatcatcatcatcatcatcatcatcatcatcatcatcctcatcatcatcctcatcaccatcttcctaacctgtccagttccaaaggccacaaatttacaaaacaatggcctagcacagcaaggcaatgaatgactgaaaagagagcaaagggtcccaaatcagattttaagtcatggccttggtcttcataagtttctccatctgatgagctgagcccattgcttggggacctgggagcctgggggtcctccatggcagctggaggaatttttacagcttctgagtcctggcccccattgcccaactcccacctggtttctctgatatttcgaaagatgctttcctctggcaatagggtctcactctgcctgttgctgctcacattctgaagggtgcctgctgttctgctgattacattcagaaatgttccacagatatagcatgcagtctctgtgtgtatctctaatttgtttaagcatttgacattatggtcaaaatgtgagttattactccatttctactcttataattggatgctaatgcaacgatggctacactgagcctgatggttggaattaatttaaatgtccaaaaggtttcttaagtacccaatttccttcaaaattgtcaaaaaagaaagaaaaaaagaggcaagatgacccattaagaaactccaagaggctgctggaggaactgtcaagctgtgcagacgctgcacttggtgctgtacctcatgctgtccttccttgtcactgtccccgagcagaggaagtagagttgagaaaagtaagtccttttctggcaaattcttagctcagtaatacacatgggtcttagtggcatggtcttggggagctcctcaaagcatctccacccgccttcatctcctttggtcaccactggctgcctttccaagctttatttctgctggccagggaccacataaaggttttgtggagtctccctgtgatggctccaaggccctcactgccagggctgcaatttgtggttgagcagtggctcaagaagctgtgcttatttcaagtcactccacatgcctggaaccctgtcactcctattctctttgctcaaagggggcaggtatttctgaacctggctaacaggtaagaaaggcagatgccagaaggctggtcccaggctgtggcagattgtattatgagtcccaattcttcactccctaaaaagaagacttttatgtctccacccctatggcctcatggtgaatagacaagtggtgtgtacttccccacttcttggctttgggcatggcctcagaactcgattggccaatgaatggtaggaaacacgaggcaaatgaatgcttccgaagtgcttatgtgctcatctttgccttctgtgcttctgtcattgccatgagaagagcttcccgaaatagctgtttcctcttcagcctgggccccaaatgaacccacatggagagagacctgagcccaaaccacagccaggagacaaccctggctgatgcagcagcttgaagcagaactgcccagctgagttgagcttagggagctgacatgcaattgctttgcagagccatgggtgtgaggattcatgtctattgtatgcaagtgagttttgggctggtttgttacaaagctttattgtggcaatagctagctgatacacaggtgctggacagaaagttacaccaggatgcaaaggtcccgtgaaaggtagaggggagaggtcagtcaaatggaggagggggaaggttgcagtgtggtagcttcttaccaccctgtgcttcaaataggtcatgcaaacattgatggcgtatgtaacttgtacaagttcagaaattattgaaagccagatctaacgtgataaatggcccttctcagtacctcccacgctggccatgctcttttaattctatggtcatagatctacagatctcaggaaggtctagcccctcagcaaagtactaaagaagactctggaaagagaatgcagccctccagatgtggtcagctgtccagaagcaaagatgtgcttcagaccccttgtactgaccatctggccaccccagtgtcagaaaatgatttttttttttctacttggcagcagtaaaaactccttgggaatgatttgccttgagctttgcaattcctcctgctggtgcttgggccatggggctaatccagctgggcctcacttgacggcagacagaggcacagggtcaagggcagcagccttggctaccaccactgtccctacctgcctctaggcaggacctctggggtcaaggttgatgatatttagaatagcaaaggcaaccgccccagggcatgaggcttggggagctgaggttccaagctgtaatctaatctgtgtgtctgggtgaccttgaacaaaatattcccatttttcatgcctcactggattcattttcagattagggggatccagtcctgctctgccttaaagaattggtcacaaaatactaccaatacaaatgatttgggaagcttcttgtaaatgaaaagtagcagatgttgtggagggctgcaatttgttgctattaataagaataaatgcctaataggaagccagtttgctctgggaactcggacagccaaggagcgagtgccgacgccggaatcatcaacatatgttggtcctcattagcaaacggcagtagctgggaagctgggcaaggagctctcagcgtgctttctgcagagcgtcgagaaatcaccccatcctcaggcttcccagtgtgggctgcgctaaaatggcacgtgatcgttattagccagaccccttgccaagcgggagagcgatccccttccctgatgcacagatggaaaagccatagcccagaggggctgagcagcttgcccaaggtcacgcagcagggcggtggcaaaggtggaaattgaaatgaagttgggggctggagcctgccctcgggcctgccagacaccactggctcccggaacatagtacaggggattgagaaacctctggtccctctgctgaacacaggtcctgtgttgaaaacttcacagcattgcaggctacttactatactgccaggaaggtgtggctgagttcaggggctgaggagccccacctacgggcagatcaccaagtagcagccctgaagagagaatgacaattggtctcagcacagcctcctcctccaggaggttttcttactccttcaaatgtggttagggagaaaaatagagtttgaaatagttttatctcagggacaagtgagaagcagagatctgagagaaaaacagacctgggtttggatcctggatctgccaccactgtgtgacttggacaacttatttaacttcatcaagcctctttttcctcatctaagtaccctgatgggttgttttgaagaataattgggatgacacatatgaatgtattagtgttatgctaatggcaactctgttgttccagcctctgcctccgataaaatgcccctgtgatgggtggtgcgaagtcatctctcttcactccactatacctagtactcagctcatgcgcagtaaatgagaaaagtgaatgaatgcttgcatgcacgcataaataaataagtgaatgaatgaatgtggttcctattacacttgtacgtgttccaagaatcccctggagatcatttatttggcaaccttggctctactctaaaacctatcatttctggattattgccacagattaatctcttagtgtaaaggttaaatcctctcctttctctgagctctcatgctcacattcacacacaggctcaggaggcccgacttcctgacttccagggctgcggggttgcaatgtgtgagattctctagctaggcagatcctatgcatttgacagaggagactgcagccagagcaacccctccaacatggaggcccaaaggaatgggggatgagaggagtgttctggcattcacacagttaacaagctgagagggaccttggaaacattctagctgccaatcctcttatttttcagatgaagctcagttgctgcagggatttgtccaaggctacatggctaccaacactcctcatttgatacccagtccctagatactgactcctggccaaaatgctcattcttgaccccatcttaaggtcagggctgaagcaggggcagagcctcagggccccacatcctggagaaaaatgaaagtttccctccccatccccaagcccagcaggtgggaaggggctgttgtcctggggatcaaagtgctgctcctgttccagcctttttttttttttttttgactctgtgtacattgggtattttattagaaactttcatgttactgctacgtaaacactgcttcaaaataatacataagttaaaaacttgtcaagcaagttcttcatcagctgtactcctagaattaaacacacatcacacacatacaagtcaccaacccccacaaaatgtttaatttaactgaccttaaaatttggagaaaagtatcggttggcttatcttttagcaaatgacacagacaaagactatggccccttctgaactgggaccgggaacctactgttgtgtgtttcccaagcacagcctgctcaatgggagcctttgtttctgcagccaagaagaaggcggggaggggctggcacggtgacacctaactcctggcccaggcagcggagccaagctagtccccaggcatatgctgaggctccctagctggctggcactggctccttgtgggaagtggcagggcaggctgggcaggcactcccttctccatctagcacctgacccttctctctgacttccttctagcaagggctctgctgaccagcgttcccagcaatgctctggctgttcaaaccacaaaaaaacagtgtgtgtaaatgatacattttgtgaatgagtgcacagcagcccaagggggtgtgcccagatgtgcatgtctcagcacaggagtagcatttgcacacacctatggggggcagaagtgttctggaccacaggagactgtgtgcaaataaacacatctttcctcgcaggcaaccaaggctgggtatgaggcttctctggctaggaaacaaacatcttttttcaaaaagggatttgactctgggaaaagttatggtgctcaaatgattggaaactgatattcctgaaggagaaccttctaggtttatcaacatagggccccactctcagaagaccaggtgctgctggcttagaaaggaggcagagacgacagatgacccaaggaattctaaatcatcttcgtttcaccctatctcctgtctcaaggtacccacctaactctactgaacttatatgagcttccattgcaggatcagggccaagcctgctgctggggaaagacaaagagggccctctggtgtctgggtcatcctggacacaggcaaaatgtatcttcttcagtaagagatacagctttgagggcatcttccagtaattcttcaaatatgaaaggacaattgttaaaatgacagcattctaaaagttttttttttttttttttttttttttttttgagatggagtctcactctgttgcccaggctggagtgcagtggtgtgattgtggctcactgcagcctctgcctcctgggttcaagcgattctcctgcctcagcctactgagtagctgggactacaggtgcacgccaccacacccagctaatttttgtatttttaatagagacagggtttcaccaggatggtctcaatcttctgacctcgtgatccacctgcctcagcctcccaaagtgctgggattataggcgtgagtcaccatgcctggcctctaaaagggttttatgccttatgcactgtcggtgagtgtttagattagcacaaccattttgaggagtaatttggcagttattactaaaacctaaaatgacccagaaagtcttcctcttggaatctttcctgcagaaataccagcacctagacaccggtggttggctgtggatattcactgtggctttgtatgtagtaatgtctgtttggaaacaacctaaatatccatccacagggggctggctaaaaaaatcgtggcacatctacactctaagataatagtctgtatgtactaagatggatgaatgtctatgattcatatttgagttaaaaaaacaaattttataaaaagggtatattaagactcaatgtttgttttcaaaagacaactgtgcagctgtgtatacatatatatgcaaacctcgtgcaaagaataacttctagagagagagttacatatttgctaacagtggttaactttggagagtttgaatttttcacagacagggtattattgacttgggaaattaaaataatattttaaagatgctttaacctttagtcttttaaactaaattaactgtgcagctcaaaatttattttagggtgacagcttgaatttttcttttttctttttttttttttttttttttgagatagagtctcactctgtcacccaggctggagtgcagtggcgcgatctcagctcactgcaacttctgcctcctaagttcaagcaattatcccacctcagcctcctgagtagctgagactacagacacacaccaccatgccaagctaatttcttttttgtacttcttttttgtagagataggagttcaccatgttggccaagctgatcttgaactcctgacctcaagggatctgactgtcttgaccttccacagtgctgggattacagtcatgagccaccatgcccagcccaacttttctttatacccacaagatttctaatattctggaactatggaaagggctcttgtctgcttggtctctccctcttggttcaccttctgaccagtagcaccctagaagtgagccctgggccatgggggagttttctccttataaaattaactatcccatattgggtgggaaagtcattgtttggcaatgccttattcagtgatgtcacctgtccgcccagaagcttcctgcagaaaacccacaccaattccacccaacatggagaagactccatctctccacagaaattactgggcaaggaccagggcacctctgcctacagcccccatatgtgcagacgctatcacgcactatgtgtgcatcagtttagtttccatgtggaggagtcatggtgtgctgggacatcactgggctgggggtcctaggacctgggctgtaatcctagacccgttccttacttctgcaagcccttagcaattgtcttcatctgtctagctttcagtgttcaacataaattgatctctattgtcctttcaagccagaagattccatcataactaactatcttaaggctggaaaaatctccaggagtgtcactccaggatctccctcaattttattctcatcttggttacttcatctatctgtatgatagggaccctcagctctgccctttccctagctcttgtgatctcaaaaaagtacagtgatatcaatctgaaatatactttgaattctaagaaaggaaattgtcgcaacttctaatgatgaattatgaaaccactagagtttactgtggccatttctatctatcattaacataaacaattgtgagggtgagtaaagggttgtgtgcacatcctttctgagagaatggagagagcacaggcttctgaagtcctagattcaactcctggctcagccacttatcaaaaatgtgtctttgagcctcggtttcctcctatgcataaagggagcagtattaggtgacgattaaatcctgttgtcagtgctcagcaacgtcccttcttgcctttctctgtgtgggactgggaggacagtcaggggacccagcggcgctgtgccagccttcatgctttctaggctgcagacgtaatgcagagcttcccgcttccatctgccaggagctgaccccaccggactgtagtagtaggccagttgctttccattaggaagttcgttttcaaggggtgagtggtggtggtggtacggataatgcatccatttcacattttgcgcatctggggagtctgatctatatccgactaaggctcagaatagattccccattccaaaatgagaaatggctattagagctatatttagactaggggttcagtgagctcagaaataattgctggccctggggtggagatggggtaggaggaggctaattccaggctaatttgggcccattctcagggggggtggcctgggggaaggccgggagtctcagccaccctatttctgtccattcaggcctctgctacagcaacagacaacccccaataccaaaatgccattgcctatgacagacaagctcagtagatggagaacctgggagaaggatctaaaagtgtagcagcccacagggaggggcagcagataggtggaggcttttaataactgaatgttagtcaggagtctgtgggtcacaggggacctgggacctgctgctgctgggacctgggctgtgcagtctgagagctgatgcttagatcttaactctgccacttaagagcttggtcaggcgcactcaacattctcaagcctctgaaagctatgcagattaaatgacataatacatgtaaaacactcaacacagtcctagaccatccaaacctaacacccagcatctgtccttataggcacgaccaccatggccaactcatcttttgggtttgcttttcctgggacagacaacattcacgttaatgcaaagttcaattttaaaattcaactttaaaggtttccagatgtgtccctgtgattgctgaatacttcagccctcagttaccatatatgtaagtgctggaaaaggagtcagaactgaagagaacttgtgatgggatctcacagtcttattcctaacctgaccactgactccactgggtgatgccctgtgatccccaggcctaaagaacccctccctatcaatagggctttggccacacagcacagccccagaactttccaaccagttccctgtctctttctctcctctcttcagctattctgagagcttttgctctgctcttgaattgcataggaaggaaaagaggaaaaccccagcaagtaagttttattgccccagcacctggaaaagttaagaaaagacagggaacacttccaactatctgatgaaatgaggtcaaggttatctgtgttctttatttaatcagggtctcccctgacctctgtgaacaagcataaccaaaagcgtgccctgggtctgggataggaaatcatgctggctcctagccaagtacaagaggccgtgctgtgtgccggcatgttgggacatgagttggcacggcacgtctggaaggccagggtcaggcagtgaggcccagcatggtggtatttggcacagaatccagcagcccctgctgtgacagggacatgaggatgcagcctccagacacaattaaacatggggcatttgctgagtttgcaaacaaacctgcaggatacagggctgaggcagcagcaagaaaacggatgtgacaattcagggcaggtagcatgccatacgtggaattcattttcgaatgcttttctcctccattaagcctgcttcggatgttgctgggaatatagcttaacctggaccagggtctggggcagagtggggctggtttgggttgtgtgcctccccaggcaagttcaccatgccaccgtttgctgagttgtgggccacccctcagggatgctcacagtttaaggggagaatcaaggcacttacaaggtgctaaggaggagggaaaggcaggaatttggggtctaggttaattggctccaaacttcactgagcaacagaatcaacagtagattctgttttgctggatttaagatgctggtgcctgggccaagctctgagcagcaaaatcaaaattcccaggagctgggcatctgtattttctcaaggccctgtactcctccactcattccccaacccatgaccctgttaatgggctgggtttgggacaactggccttgaccatagggagcagaggagttagtgatttgaggattatgcattttgccctggaatctgagtgatacggcaggtggaaggctatgggggcacagggacagggtgggggtgagcatagagataacactggacagctgtacatggcttccccattcataagcaatttcacagccatggttgcctatgaccacattctggtgaggtagccagctcagggaggacagcctccagtttacagatgaagacacaggttgggaggggttaagcgacttgctcaaggtcacgcagcctgtgaatggcagtgccaggtccctaacacaaggtgtctgtgaccaacggctgctctatgacatggcgcagcctcctttctccactccagtcccctctcttgcaggggccaggtggctgtaactctctcgtgatgagctgcagctgcctaattggttgcagaggcaagttgtcccaaacatcatggacaatgatgaaggcagagttggcttggagaatttccattcaaatatatcttataatcactctttggccaacatgtttccctcacaaggtctgtctccttctacatgacacacatctccaaataaggctctctatcatctggggcctggcaagattctagacaatcgctcagtgtggtggtgcaatgtcaccctggccaaacccagcaggggctggtatgtctgacttcatgagactttaccaattatggaattgtttcactggatccaggggctgcagacttcagggctggccatatcctgaggcaactgctgcctggagcttggtagggaatctacatcctgtcttggggccaagggtatggtctggggacacagagcagcaggagcccacaggtgggccaattctttaggacaacctgaccttcacagggctcccaggctgctagaactgagtgggccattagttctgacacagatgctcagttgtggccctgtagatttgaagggaaggccgtgggctggtttactaggccatgttttccgaggcgtctttccagctatgctgaagaatcagtctgaccttgcagaatgtctgtagatggaggaattggaagggtccctctcagctttctgtgccattcaccctggtccagccaagggagaatccagcaaaatcattgacatgcaaaggcatctttggctagcatgggccttaataaagccagctctctgagatggagggtgtagctggaaaagggtcattgaaggcagaaaagttggacagaaagctccaccccgtagggcccatctaatctctgcaagactcctggcctggaaggccaccctggtctgccctcatgtcgggtcactgagactcagcaaagcctggagagggtctccccacccctggtgcttctctggccaatgcttcttcaaggagtgaagggaatctgaaaacagtgcagaccaaatagctgctgtgtcgacgaaaggcggccgggggctgagcaaagggtggcattggtgacaccacagggtatgaaaggttagctttgcatgcctcagctccctattagattttcccttttcttcttcctgctttcattctttatcagaaattgcctagtgggctctctctcactcatacttcagcacgaatgggctggcgtcaggccgttgctggcagtggctgctgcaggcttgtttttgggagcagagtcaaggagcagaagtgaaagtcctgtgttctcaatgactccaggagcaggagaccctgcctgaccatagcccctgcctttggggctggccttttctcttttctcaccactctcctccttcctgtcccctgtgatcagtgaccctgtgacactcatgtgcacaattctgtaggagctatgcttagaccttttgtgatgcttggagaaaccacccacacccatccagaccccagatccaggaaaacacctgggaagaagacaaaaataactatgaaagcgtaggttggctgcactaacctaattctaggaccaaagaatcccagagttgggtaaaaacttagttgcctaatccaaacttttattggatataaccactcaatgcagatatttatgctatgtgtttgccagttacatccaatttgaagaaaaataataagaataacatcattaaatataatcagacatgacttatgaaagggtttgatgcaacattaaactgtgtttactggtactgttgccctaatttattgcttgtgtgccacggtaatctaatcataattacaaaaacaaatagctaggagcattctttacatctcttggtgacttagcttctaaagaggtccctcctccatccctagcagacagtattgagccacttcagggtttagagttcttaggataccctaaatgaatagcacagaaagcttggatggaccctccatctacagagagtctgcaggctcagacttatttctcagtacagctgggaatatcactcagagatcatggcttagaaaaccagcccatctagctgggtgtggtggcacgcacctgtaatcccagctacttgggaggctgaggcaggataatcacttgaacccaggagacagaggttgcagtgagccaagatggtgtcactgcactccagcctgggcaacaagagcaaaactccaactcaaaaaaaaaaaaaaaaaaaaaaaaaaaaaaaaaaaaagaaaaaaggaaaaaagaaaagcaaaagaaaaccagcccatggtattcccttcaaacctccagggctcggtacctgtgggataaggtgtgcattcccaaggccctccagccagactggactcactgaagcctttgtgcatcttggttcttctatagtgaggggcggtccatccactacccaccaaatgagacctgcacacagatgtttatagcaatgttattcataattgccaacacttggaagcgaacaaggtgcccttcagtaggcgatggataaataaatggtgtggtacatccagacaatggaatattattcagttctaagaaggaatgagctatcaagccatgaggagatatggaggaacctaaaatgcatattattaaatgaaagaagccaatctgaaaagcctacattgtgtgattccaactatatgacctggaaaaggcaaaaactatggagacactagaaagacctgtggttcaatgagatataatctcatacctgtcagaaaggctattattaaaaagacaaaaaataacagatggagaggttgtggaggaaaaaggacactgatgcactatcggtgggagtgtaaattagttcagcccctgtggaaaccagtttggagagttctcaaagaacttaaaacagaactgccattcaacctagcaatcccattactaggtatcaacccaaagaaaaataaattgttctaccaaaaagacctgcactcgtatgtttatcgaagtactgctcacaatagcaaagacatggagtcaacctggatgcccatcaatggaagactggataaagaaaatgtggtatatagataccgtggagtactatgtactcataataaagaatgagatcatgctttttacagccacgtggatgcaactggaggccgttatcctaagcaaattaatgcaggaacagagaatgaaatactgtatgttcccactaataggtgagaactaaacagtgagtacacatgggaacataaagataaagacgggaacaacagacgccagggagtactagagtggggaggatgaaagggggctgagggttgaaaaactgtctatctggtactatgctcactacctgggtggtgggatcatttgtacaccaaacttcagcgacacgcgatttacccatgcaacaaacttgcacatacatgtgttgaacctaaaataaaaattaaaaaaaaaaaaaggatctgtggttttcaggggttggacggggttgtgggagtggagagggatgaatgggcagagcacagagaatttttagggcagtgaaactcctctgtatgatatcataatggtggatacctgtcattacacatttgtccaaacccataggatgtacaaccccagagtgagccctaccaaagactgtggactctggatgataatgatatgtcaatgtaggttcattgattgtaacaaagggaccactctggttgggaatgttgatagtggtggacagtgggaggaggcagggggtttataggacctctttctgctcaaatttgctgtgaacctaaaactgctctaaaaaatagtctattcaaaaatagtaagttagaaaacaggcagtatactactgttttatcattcctttaatgaatacacctacattcaaatgtccttccttgctctcacacggccaaatctgacatgcccaggggacatggaagaaggggaaggagcagaactgccaccagtactggggctgctgcaaaggctgagggacccaatgtggagagccaaggttgggaaggatgcagagtcctgcggctgcgatgcctgcagtgggctggaacagaaaaaggctactcagtaaaatttggcaacggacacgaactcactttctctctcctagctgtgcttttcctgcagggactgaacaagggcagtgtgtgcacatgtgggagtgccagaagcaccagcgcaatccagatgtgcccaggcccatctgtgcgtgaaaatgcagacacaccacactatttatcaattagtgtctgctgctgccagtgtcaccagttctctgcctgatgaatgatgctaggctggacaagccacaccccaaggtatttccactgtctgcagcaaagcccaccaggggctgtcaataaacatccccagcatagcccccaggcactgaatgatgggagtgggtcagatgggcacagcccttcaggacccgggcagctgccggccagcctcgagcagtccactaaaagaaacagttccagatggtgcctccgagcacatcctctgggtagcagccactctgccctagtgcacaagacatggctagatttcagcccctactcagccccttggtgaggagtccttgtgcagtgaccaacctacacaacagtatactgtggctctgtgagcacctacacacacagtcccagggaaatgagtgtatctcagagatccaggagacccaaaaccaatctcagctctgccttacttcaccagcagaggttgaccaaatagatcaacctctcagggctgccgttttctcagctgtaaaatgagaggctccttcctgctctaacaatccaagatatatgggaaattgagagtacatttcccttcctttccccgggttgcccccctttcccttcttgaacttgacccagcccttccagaccaggctaaaactgaaaatcaattttaattataaaaatccgtttactgtatcaataaatcattctggctcggcttggtggtggggagaaggttacacctggaaccaagctcataagtcactctctccctctgccttgccgctcgggggctgccacccctctgctccctgctccaatattcatctccgtcattaggctgtggattattaatgatgtcctgggctgatggatcggagcccagatgctctgaaacacattgtgctggttgtaacttgattttcagtggaccccttgacagcaaaccttgatgggctttttcccctttccatggagggggtaaagaggggagtaggactgtccttcaaggtggtcccatggctgcaggtaggaaagagttggtggcacagacaaatggggtgagcctgcctctcccagcccacttactaggagacagcacagtgttatgtacatgtcaggttcccatggcaatgagacttttaaattaattaactgatcaattaatattgttgttaggcttattccttgcgtgcactaaggagagaggcaccatctgctttggatggcatttcgggggaagggggagctcctctgctggcttaagctcagtggggaggctggggaggaaggcagagatgctgggtctaaggggtcaaaacatcagcggactgccagtccctagagaccacttgtcgttcatgactccctaaggtcagtggttcaagttcacacaactctgcgtaacaccacaacccaaggtttggatggagctgggggcgggaagccacaaatagtgggtggctcagtggaaccaattcctcttactaggggggttgaagtctcacttcctttatggcatgtgacccctcgtaagcttccagtgctttatgttgtctgggcccctgagccttacatccaggcagcctgcacaggaccactgaggaaagcacaagtccatatgagagagggaggctgagcttctcccctgggtatccacagctttcctgttctccctcacatccatctagttggcagagatgcaaaatgggaacttctgtggaaaggaacctggcatggctggcccaccaccagtggggtggggactgcaggactggccatgccaaatgtgttctggccatgccatccacactcaccaccaccctgcacaggcttaccaagaggcaggcatctgcagcacttcgaccctgcaagccagcagccccgtggcaccccatcagagcaggctggggcagcagcctactgtttactagagacatgcctgggctgagttatgagtgcctccgagcctcagcttctttacggtaaaataggggtaagaaaccctacctgggttgttctgagagcttgtcacactctagttctggtttggaagctttacccatagttagaagacagagcggagctgacacttacaacctagcaaattgtccactgcatgcattgattttgtgggagagaaaactaaaagtaacactccagatgagattttaggattgtttatggagcactggactcaaaatcaaaagacctggatttgagagctgactgccacatatcggctgggtgatttttgagaagtcatttaacctttctcatctgtcacatgagataatggtgccaacttcaaggagttgctgggtaggttcaatgagagattgtgtggaaaatcgcttgggaaatagcaagtactaaacagatccatggcatcatttcatttgctaccactgtaccgttagcaaagataatttagagttcgcctgtatcaagctttctagggtgcataaatgatagtaactattaacttcttgattcagttctttcactgccttccattaaggcaccagaagagaaatcatttttccttttttgttcatctgctcgtcattatttcagatatcccgctgcactcagatacaagactgaagaagcaagaacgttataaaaaagaaagaatgaaaagaaagaagaaaagcaactaagcccagagatggatcccaaaactgaagaattggtttaattaaattgaaagctctggtgcttgtggtaattgctatgaaggaatccatatcccatcagaaccctctcccctggagtttgctccctctactttctctgcagcaggtactaaaattgcttttatctttagggagatgcagcccacagggcccagaaattattgtggggtcaactgtctggagtggggcttagggagtagtagcaaataattcggtccaaacctggctttgaccttgaatttccccaacttagacctcactctttttttttctgcaaatgaggcctcatatgccctggtttgcagagacacttaaaagtaggcagtgcttgcttttgtggcccctctgctacttctgctatacacagggcgagctgggtttataacaccacctaaaccacaggccacgctgggctcctcatgccctgagctacctcatctactctttgggcatcatttggctctgggaaatactgtcggtcctccccgcttttttttttttttttttctttttctttttgtagacagagtctcactgtgttgctcagcctggagtgcaatggcgccatctcggctcactgcaaccgccgcctcctgggctcaagtgatcctcctgcctcagcctcccaagtagctgggattacaggcgcctgccacctcacccagctaattcttgtatttttagtagagatggggtttcaccatgttggccaggctggtctcagattcctgacctcaagtgatctgccttggcttcccaaagggctgggattacaggcatgagccactgcacccagccctgtctgtcccttttaatgctaatagagaaacttgatcccagaagtagataaaatcagcttttaaacaacgacaaatgcaacaagcaatggcaggccacaggaagcaattaggaatagtgagcgggaagagccctgaagagacctgggtttgagtcccaaccacaccatataccaggttcataactttgagaaactctgggtgttgagtttgaattgtgctttggggtcagctgggtcctgcctgattgtccaggtttcaaaaccattctaagcatctagatcaaaacaggttgtttccatactttcaaaaacactattttgtttaccaattatcaagcatttgttaagtgtctatcccaagctaagtactgtgctatattggtcaggtcaggcaacgcagcaccttaaaagttgaagagaagcctttggaaccattattcattcattcaattgaatatggtcaattggcatcatgaatctaacaattaggaattgggtagcaatatgaagggtgtgtatgggaaggatcaggtggcaggagaacagcaagaagacaggattggggtcattttcagtcctgggcaaagaattgagcatgcagacaagatcagtggggtccttcctaggtatttatgaatccctgaatctcaaactgaataccttgtgtagcagaagcgagcgtacacagaccctagcagatacacatgtgaatctgggtagtccctgaagaacaggacagggctcagctgcaggtaccgtgcactatgaccctgccagccacacacatgggcactaacattctgagcagtcatctagaagccagcagccagtgcaggatgggggtcccaaagggcttggggaatccacaaaccacatggtcacacccttaatgccgaagagcaggggaaatggaggtgcacacaggtcctaactataacatgaaaagggatgggtgggaataagaaaaagtcattagaaaagaggagctctaaaatggctcagaatcaagaagaagttgactcagtatcaatgtgtggctcagcagacatcaaatcccatgataaagccttgtttccctatgttcactgggctggaacccaaactgaatccagctctagggaaaaagagaaggtttggggtaagagtgtgtgtatatgtgtggtgtatgtgtctgtgtttgggtgtgggtgtgggggggagggtaaggagctgaattttaaaaatccatcacaatcaattatcacaagtatgtccatttttccagcctgctagccagagtcaaagactgtgtgcatttgaaatctccaaccttttaaaacattactgtgaagttgaaagttcctggtgtcttttgattaaacatcgtgctaggtaatgactgttttacttcttattcttttttgcccccttcaaattactgattgttgtctgacattaaggccccatttgctcttaggaaattaacaagcctacgaaactcttaatgaattgaaactcatcaaatgtttggaaactatggcagtcttaagattcttttccttttaatctatctctctgtgaaatgtctcattttttccacatattcacttggattcagacagctgcactttaggaattaggttttgagtcttgcttatctgaagtagcagggagtcacctgcccacagaggtgcaagggcttgagaacttgggtggtttctccaaccagcaacgtgcttactgtctttctgcataagcatcgacctggctgcaccaagtgatttctactttccatccaagggtgccttagagctttaatacatttgaaaagacatttctagggtacagtctggtcatcaaacagaactacttccattttggaataaagtgactgggcttcaaagggattaatcttgtgtatgggccatgccacctgctagggagttgtgagctaatggtgggcatccttgaatcccatcttatctggatagtttctccttttctaatgccatcatcatctagcagcagaccatatacagaggttccagttgagaccttcagctttgtgaagggcgggaattcctgaaactgtcgcaaggcttggggtctgaggaatacataaccacccaagtaaggagcatccaggagcaaattccacactatctcttgcctcagaagtcaggaaaaataatcaggtaactaggaaaccctgaggaaatttcagtcatcagttcaccttgggaagtggagttgttatgtgagtgtttatgttcaggtgtgtcagtaggaggagcctgatgaggatgaagaataatgagcatagcccaaggggaacactttcctctctagtcaacaaccatttccaatccttggacaaccaaccacacagtcgcaaagccaggtgtccttggacacatgtgaatggggagaggggtgtgcccagctcacagagccctcagccctagagcagttctgaccttgacttagtatatcttccagctaatcatgagtctagacacacatgccccaaatagtcttggtagaggcttcccagggtgatccactgctgttaagctacatggtggagctgggaaccacatggcaatccttggaaacatcatgccatcatctcatggtatttagattctcagctcaaaacttagagctctgccattggcttcttatatgatatggaatctcagctcttcaatcctcagaatgcaggaaatggtttcttacatgtattcggaaaacaagcatactatgtagaacaaataacacctcaaaccaaatggaggctgttgcgagtcctcaccataataaagcaaaggaaagaacccgtggggtttctgcccatgtctgagagctgaattctggcttccttgctcctgcttacttcttagcagcaggaccttggccatcaagagttaactccatctgactctaatgcacgcactgccacccagaacaataagccaggcaatggagaatcctgccaggaccagtattgattggcttgcttgattagttggttaattgaatatcactgctttctaatataattaaaacaagataaatactggggctttgtcccgtaagcaagtgccattagtgatcatggtacacaccgtgattaaaaatgcaatcgactgggagggttatttatgaacttgccagcctctagtgccactccatggtttgcagggccttgagatacaacgtggctggcatagagctccctaacctgtcatgactgtgctggtctcttaagaaaggaacttatttcacaggggaatgcatgcaggtaaaactattttatgcttgcccctagctcccttgctttaaagtatcagacagtgaaactacagcaccatggaaataccatgcatgacagtttcctcctttgcctcactttcctcattcccaaatataagactggctttctgcccactctgtgcaattctttattttaccctcatccagtttcaccatgagtttgaaattttgtttggatcactggtctgctcatgagacacttatgaaaaattacctgaagcaaggctagttggagtgtggctggcgggagggtcatgggtcttatttacataggagcagaggggatcaccccacaggctgctaagagagagagctaaatgcttcatgtgaacagcgtaggtgcctatggactaatctactcccacatgacatctcagactgctggtgcctccaggaggaggaaggctgccaggcttcctggatgacagatctcagcccccttttcttggatagcatctgttgcttcctcagttgaccaaggaatgtttgtggcatgtcaactgctggccttcctggtgaatgtgtggtgtggggaaggagtatcatgtcaccttttcctgagtcccacttattgatgtttcagctgtccctgttttgagcaaggggacacggtagcacttcatttagggctggtgaaagtctcagttggcaaggcacttggaatacctccaaaagtgggggctatgtaaaaacaaagtattattattctattagcttgtggtcttaatatttggaatgtgtccacatgacactggacacatgcgtcctcccccacctctggctctccacattgggtccctcaacctttgcagctgccccagtacttgtggcagctctgctccttccccttcttccgtgtccgtgggacatgtcagatttgggtgtatgagagcaaggaaggccatttgaatgtaggtgtattcattaagggaatgataaaataatagtacactgcctgttttctagcttactatttttgaatagactattttttagagcagttttaggttcacagcaaatttgagcagaaagaggtcctatagaccccctgcctcccccgcccccaccatctgccctcccatgacgacagccttctccacagctccaccagaccggtgagcaaacattacagaccagatgagagtgaaaggatgctgctcatgatgcctagagtggcatgggacaccacatcagctctcttcagaactgggtagtgttttgatgacaggttaggcatgtctgaaagagccagcaggatctgaaggtgcagatgcaatcctactgtagaaataacaaaaagctgacccactggtgggactctgacacattaattttttttctgccaaaaaaagatctttttttttttctgccaactgttgcccttccaaaaacatatccctctgcaggttttattttatttttgtctttttctgggaatgtggcttcattttgttgtccttttccctgagtggctgccaggtttggatgaacaggaacacgctgctgggatgtctgatattgctattgctagagagaagagaaaggaatgaggcaaatagggagtcctgcagaggggagagggagctgtccctagtacattatgggaagtcagtgctgaggcccctacttttaatgggaaatcacaaagaaacgtgcttgagggattgacaggaataataaaaaacaccagcatgctcagaatccattcggttcaccctcaggtttctaagaactaaactcatcgtcctaaatgcttacttggagagaaaccactatacgtaaagagacatgtatatatgaagaaacaaggacatagccctacctacagttttatttttattttgccataaaataaatgcttattaatttccataccacgtatggagagagctgccacatgtgaatttcttttagcaataattgccgtgcctgggactccttaagttatatataccgcgggaatagtttccaaataagaacccagagagagggagagattcacagacaatagcttaaaaagtctagaaattatagaccgattgaggtcagcaagaaacaaattattcaatatatcccctgagggctagagccagactttcccctatgattccaaaattacttcgcagtttcattagggtgaaaggcagtgcagtctcatgagttcagaaagtaaaggttgttccttaaaatttagatagacttgacaaccacttaggatggcattttggcattctgtccctgctcatcaaagaagttgctcaaatttgtgggatagaggaatgagagcaagaagtattttaattgcaataccttgtgttgtatatatgtaatacctctatgaaaattcaggaaatcagtactgctaataaacctgatgtacaggcagaatcatttacaatgcggaggagctgtcctcaagttctggtgctgaaatacagaaccaaagaattttatcatttaaagtgcctacacaatatgaatgaatgttttctcctggctcgagtagagttgctgctcaaccatctatgaccaatataaagctaaaagagtacttgttccatcaatagagaattatagaaaaatgttttttgaaacttttcaatgcagtggagatgagtagtactcacttacatctggttcttatttttttctgagacacatagaaatggagcttccctacccccttgcagttatgtgaggccatatgactatctagtggaatgtaagtgaaagtgaaatgtataactgctgcaccaaaagactgaagtcactgtgtgaccattcagctcttttccccccacagcaacaataatattgaccacgtttgagacagaagagccacaagagggaattagcctaaattcctaagcgcccacctggaaaggatcctccttggaagatctgtcagatccatagtaaactttgaatgaaagagaaataaaatgttatgtgttaaagttcctgaatttttgaagcttatcctattctatcctatctcatcttaatatactaagttattcatctggatgtctaaaaaccatgaccatcacaataaaaccttacactgctatcaaagtaatcaaataaatagatagggaaacaaggaactttagtcacttaggaaaaaaaaaaaaaaaagaaacatacctgacaatgtcccctccctccaccccagtggttactggtacctagctttatttgggaaagcaacaaaggaaatatttccagaggctgaggcacctctttggtatagaagtccatttctgcactgccttttaaaatggtcaaataatccatgttgaatttctgataatcagagttctatgtataaagaagccaaggtcaacaccactgccatgaaatgatggatgtaactatcaagcagaggtcaaagaggatcagaattcaacagagaccatgggatgtggtcaacaggaggtcacaggctacctttttaaaagagtagcttcattggaaaaaccagattacagagggttggggaaagagttagaggtgaaaaaatgaaagtagaaactctaaactacaggctcaaattacgtggtggtaaaaggaaagaaagaaaactgtagtttaaaagagaaaaataaaacttgagtttgaaggtagaggtgaaaaaacagatgataggaagaaatgcaagattttgaaaatttggacagaaagtcccatgtatgattgaaggaaggagggatcagagcacagggggaagacacttgttaccaggaggagaaacacatgagggtttaggtaggtttttcttctgcatttctcacttgagtcagtgcatcaacatacaactaacttctaatggccaagaactccaggaatcatcgcaaacatgttttatgtccttcagtcttccctgcattctgttatcatcagtgctatttaacctcctcaatatctcttaacctatacctttgtctgcatttctacagccttaaatcaggacattaattttgatggagctattcaaatcatagctttacaagtacattacaaacttctcagtttctcatctgtaaaatggaaacaaaaacaactaatttttttaagcactgctgtgaagattaaattaaataagcccctggcagtggatcacaaaaacttcttgcttggtatccctagccctggatttcctagtttttatttattcactattttgtcaccagaatgatctgtttgatctgtttgacaatcaagtcttgcatagtttcattcctgcctaaatcaagtcagttggtctctttcatttatagagtaaaatccaggggttcttttagtatgatactaggatacagtatgatacaattgttgcccaactcttcagtcttcaccaatctctcatcttaacttatgtcccagcaacattacacttcttatagcttcccttaagacacagtaatgtttcaaagtttcctatgactttgtaatgctgttccttctgctgaaatgtccattttctctctggttttctcagcaaaatcctattcatccttgaaacccagctcatatttggcctccttaagaacgttcttcatcgctcgttctccatgttacctctccataatgtattcacttcggttgtcacacttaactcattatattgtcatttatgtctttgcatgtcagctttcaataatcatgaatgctttgaagggcaggctgtgttttatttaactctgtaactctctttcctaaagccatatctactacctggtaggtattcatcaaatgtttgacaaatgaataattgaacaaatgcatttgcctgtatggagcaatcataaaacggtcatgaagatgatccctacatagccctcatcttcatggagcagatgtcatccactctgagtgatgtctgtgtttctggaattgttgaaagtggaagcattggaacctaatgttgggggaaaatataatacactaagctcacactggaaactctttgtttggaactgaaaccctttaattcatgcctcattggttttcaacacacacacacacacacgcacacacacacacacgcacgcacacgcacacacctcccatcactttgtctccagaatcatattataggctatctcaaccttgagaattgcacccagctttgctgactgacctcaactatgtactgctcaacttttcttctgaccttgattctagaatataagggaagctatattgatgaacagcaagatcctcacttagttatctgctggggtagtattatgctgcatggtaattccgcttagaggcaaagaggagaggggaggtagatcagggaagctgatggccatagtgttgactgagaacctaggactccctacttgagtttcctctccatagccacaacttgctatgagacttcagcttgtttccccccatttataaaatggagagaactctgtaacaccagctctcatctatctacaaaaataaaaaatggaaagagacagcctccagcttttaaagtactgaaggggcgttaagcagcaactaaagtccagaagtctcacttgaggaaatgagaacttatgctcatgtaaaaacctgggtgagagtgtttataggagctttatttataatttgaactggaaacagctcaaatgtcattcagttggtgaatgggtacactgaggttcacccatgccatagaatactattcagcagtaaaaaaaaaagggggcaacaacatggataaaggttaaaagcaccgtgttgagtgaaagaagccaatacaaaagagtatgtattgtataattccatttctaggaaattctagaaaaggcaaaaatatggtgacagaatacaggtcagtgatttccaggtgctggagacagggagagaagactgacagcaaagggtcataaaagaattgtggagagtgatggcaatgtttatatcataagtgtagtggtaattacgctaatatgtatatatatatatatatgtatatatttctattttaagacctattgattttgaaataattttggacttacaaaaaagttacccaaatagtagaaagagcttctatatccccttcccccagcttttcctaatgttaagagcatatataaccatgtcctatgctcaaaaccaggacattaacactggtacaataccacgacctaagctctaggccttattctgatttcgccagttcttctatttaatttctaattcttttccagggtcccccattccatttacttgttataactcctttgtaacctcatcatctctcatttctaccaagtcctcaatccttcattgtctttatgactttgacacttttgatgagtactagttggtaattttgtagaatgtctgtcaatttgggattgtctgaggttttcacatgattagaatgagttatatatttttggcacgaataccacagaaatgatattgtgcccttctcagtgcatcctttttttttttttttttttttttaagagacagggtctcactatgtcacccaggctggtcttgaactcctggcctcaactaatcctcctactttagcctcccaaattgttgggattacaggtgagagctatagcacccagcctcagtgcatcatatcaaattgtcatgatgttgtcaagtcttgttactgatgatattaactttgatcatttggttaagatggtttctgctaggtttctacactataaagttattattttccctttgtagttaataaatattcagggtcaatactttgagactatgcaaatatccagtttctcctcaaactgttgcccacaattttgtatccagtagtgactcttctctataattattattgtaacataattaaagatttttcctcttttcttccacatttaaaaatcttgattttgtcttctaattgtttaaaatctttttattttgaagcagttatagaaccacaggaagttgtaaagatagtaaagagatgttccatgtaccctatacccagcttcccccaatggttatattttacaaaatcatagtgtactatcaaatcaagaaattgacatttctttaaaatgcgggtatagttctatgtcattttattacatgtctagtttcatgaaaccaccaccacaatcaacatccagaactatttcatcacgaccataaaaccagacacttaaaattggtgatcagaggcacattatacctcagtaaagctggcaaaagactgaaaccaaaaaccacccaaacattgccaggatcatgttacactaagcactctataactattagctctcatactgttgctgttttatcacagagaaatgccagtcccagaaagaaacaaaggggcaagggacctctccttttgcatgcctccctgattgctgctattgtggatggattcgatggaaatgagtcgccagcacctgggtctagcactcctctagctctactggagtgattccagggttgtcacccccatgcatgtgacatgtgactctcatgcacatcagcatgggctttcttttgctcccattttccctctctgcagtgactatattttgttatttgcatataccaagtgcatcttgcttccgagtcttttccattgctgttccctctgtctagagtgttctccttgaagacatctggtggccagctctcatttcatttatgcagaaagagcttcctgggccacctagtgtgaactggcccctccctgcaacccttagtcccagtttctctctatcatgtgactgtgttattccattatagcacttattgctggaagaagctgtcttggttatttattctctgctgtgtttattgtctatccctggtcccctccagaatgtaagctacataaatgcatgagcatagcctgtttggtccactgctgcctctccactctgtcaaaggaatatgagtggggactttctaaaattgttcacacccccagaagagtttttctaccaccttccttctcattctctctcctcttttcttctctttcagctctctgtctcctcctgcttccaacacacacccattgagatggaaaataaagtatagcatatcattagtggaatcacaagcaaacccagagacttcctcctactcccacccttttctgcaatgaccccccctttcccaccctttcccttggcgccctgcctgttgttgatgggtgcctgcaggaggagtgcccagaaagcagggctctccctgagtcgtccctaagcagcttattcatgaactgcatgtaagttaatagaaaaggtttccccagaaatctgcaggtttcttgccgttcccactcttcccctttgccctgttacaatctggttagccctgttattattatttctgtggaatggcatatatccgtgccattaactctacatatttctaggggaaaaaggatggagaggaagaaaagactgattatttatcaaagaaaagacattttttcctctctctagacagccaggtagattttctgaactcatatctgccatggaaatggggctgctgcttctgaaatgagtcctctgtgttgggggtgggctctgtttttacggccagtgggtaatagcattttctgatttatgaattggcatctgggggaggtgctgagcccctagatggattcatcgtggggagaacagccatataaatactcctgtcacataaaattattgttctcattttgatttttaaagaattttttcttttgcaagatggtgggattgagaagatattagtgaggaagcaggagaggaaggagtcacttggcccctttttcttagaaggcaaacatttttgtctggacattctccagaaacacggggttgcttagaagtcaattactagaatggtttacttattcagggaatacttggcactgtggcttaagtgggggaagctggatctcaggagtttgacccaggctccaattgggaattttttttaactggtgaagaaagggtcatttcatgtaagttcctcccaccttccctaaatcagtgtgaagatgcatttaaatgcaccagatgcttatgggtagctgcacagtaccaaccaccatgcaggtcctgtgagggctgcaagccaattataagccctggtgtctgccctgcaggagagtgcagtctggaggatgagtgtgaggatgactcagtataggacacaggctttgaatcacgcacaggattcccctggggagatgagtcctacggtgtcctgaacagatggcaggaggaaagcagaggctcaggagggaggacacacaccatgtggctgcctagaaaatgagaaactgttggcggtttatgctttgtgtttcagacacttctctccaataaacctgtaaactttctgaggacgaggaccttgccatagacttgtttggttcttaccccttttcttccctgaccttgaggcttaacacctagcagggcaggagaaaccacactgttttctaagaaaggccagatagcatatatattttagactttgcagaggccatatggtctctgtctcaactatgcaactctgctgttgtggccaaagcaaccgtagaccacacatgtaaatgaatgggtgtgaccaagttccaatacaactttatttccaaaaccaggtggttgatcagattgggaatgtcgcttgccagcctctctactgggtgaacaataagtgcctgctgaattgagttaaaatgatgtcaattaataataagtgtacctcactttttaaaaatgtcaaatatgacctgacaaagtatgcaaatgcagaacatgtgaaaagagttattttctatgcagaaagttcctgtggccaaataacatacaatctgttctatgaacacatgtcaagaaatggtcccttacatacaacctgaatctcagaattttctccagtgtgcaagatatggcacagacactatctttttgcacggcgccaggcttcagagggcagtaaaagggaaagaatctcccttctcatttcataggcctgaggaggagctgtgccagagtctgagactgggaggcagactcttctggatgggggcagcccaggctgttgggctgtctctaaccagtatgtctaactatgggaggcttctgttcatttctttatttctttgttttcaaggcagaataaactccaaattccaagggtcaactaagcgcctaccaccagcccatgcatggccacaaaaagccttcgtgtcatcagtcaatgccaactagttaataatgaccagcctcttcactaatggcccgaggcaggggttctcagggcagcgaaggccctgggacagagacttgccagcggctgcatggggagaatggtttgcaagaagcatatctgctggccactatcaagggcatatccacccatgctcagctctttagaaagatagtaattagttttttccccttcggtgcacacagtgaatgcagcagaatctggtatttggagaaccattggagtctgtccctctcatcttgatttgcctgaggtttatgtctataactaagaaatatcaagattgcaaggcagttcaggggatgtgtttagctcccaaggagagaaaagaaactttcacacgtcagggcttcaggcaaggagaggccactgcaaagggaggttgatcgtgactcggctggctctgtaccacattgtgtctcttgcaaactgcaggtggtgataacaatgactgaatagtaagctcccagagggtatagagcttgtcttgtgctctctggatgttccagcatgaagacatatgcacaaagttacagggaaaagatttctagacctacagagtccattgtggtcatctggaaagtgcttcctgactggtgagtggtgcacactgtgatgggccaaggtgtgccattggggcagctggaagataccttgttccctctggtcattagaggacttccatcacttgggctagacacacaaatacattcattttccatgtgtgccttaacatagtgacaggttggaaagcattgatctgctctacacatgagaaaattaaggctgggcatggtggctcacacactttgggatgccaaggtggaaggatcacttgagttcaggagtttgagaccagcctgggcaacatagtgagaccctatttctaccaaaaatttaaaacaaaaaatagccaggcatggtggtatgcacctgtagttctcagctacttggcaggctgaggtgggagggttgcttgagcccggtggggttaaggctgcagtgggccatgatcataccatcgcactcagtctgggagacagagtgagactctgtctcagcgaagaaaaaaaagagagaaaattgagacttggaagtcaaggtctcacaagtcaagaacttgaatccagttagctttactctatgtttaatacttcacctgctactccactgccacccacagtaaactgtcaacaaataactgtagaaggcaagttgttgagatagagaaatcactttaaaactagtggacggagagatgatgacattagcatgacttgagatgggagccggacgcccaaagctgaagtcaacatattgccagtttacacaaggcattcttccctaggttagtgactttcattttgaccatgactcatggcaagagatatgttttacattgcaactcagggcatacatacatgcccatatatagtttcacaaatagtagttatccttactatgtttgatggccactattctattcgactttattctattccattaaaaacaaattctggtcatgaccctttaaattgatttcatgacccactaaattgatttctcgacccactaatgtgtcatgaccagcagtttgaaaaacactggcttgacccttttccagctccccctccctcctcagaggctgggagaatggaaggtaaatgtggagaaaaagaatgagacaagagatcgagagattgagataaaaataaggaagaaggtgggagaaacacaaaaaatagtggaagggataaaggaaagaatggaaattaaatgagaagaagggagaaatgaatgaaaaatgggagacataatgagaaaaggcaaaccctacactgacagattcatatccgtgaaaactgctctcaagctccatagtcattctggccatatttatacaagaatcttccctgccagcattaatggccatagccttgataatgctgtctgcctgtctggggatttcttatctgtcagcaccatctcaaattcctatagtgactctcagagagaatcttccatctgttcttcaggaaaagaacagaaaagactagaaggcattgggtaaattaccaaggaatagaaagtgaccacacccactttacccactcctttgcaccgtgggttctatagactttgagctgagtctacacaacaaactcttggtacaaaggaaattgttttagaaggtaacagaaaagtgaaattcagagattgaggtaaagttaatttataaagaagctgcaagtttacatactccaatagccagaggtctctaactgattttgactgcacacttcatagtaaaaagttctttgagcatgcacctacaatgcacatatatttatttataaaaaatttattaataaataatatatatgttctgctcattagcatcatagcactatcaaacctttagaaaattaggaaatgaagtgagataaagataaaatagcatcttgtatttgattttacaaatgagtgatacaaaacattttactatcaccaagaaaattattataatggtaagagtgatgtgctagaattggttttattattgtttaatacatttgtttagcacttagtgatacaaggctctaaggtctaaggttcaatttatttccatactttgttttaatggctgtcataactgaaaaggacacctcacatagacgcagagatgcaaaaaagtgcattgttggctgtgctgaataaatcaagattttttttttcagtctcatgcaccaattatgtgaagactgttgttgaaattcagctagtagatttccatcttctctgatgtcaatcagctcttggaactaatcggagggtgctgaatttttatattttttaacaaaggggtcaaaattctctgaaactcttcatttggaagatttttaagcaggtagaagattctgtttccaagttttaaaagttttaagatatgaatttttaaagtgtcacatttactcattattggcaacaaaatcacataatgatgaaaatatttccaaacatcttttctctccccaaatgatctcctcatgccataaatccttctgaaagtacttactttcttacccattgtgaatgtattacttttatattggagggaaagattaagtgtttattttttcaaagttaccagcaaagtggcatactctgacagctgcttgtcagaactgaaaaggtcagcaaatgtggaacattttggttcttttaaaagaaaaatgattaattatgtttccataagcagcagacctctgtgttgtacaaaaaatttccgtggtcacttgtacatcattgcaaagtattataaagattttatttaaaggattgtttttataacattgataatatctgtcacacataaattgcaaatttgttgtagtatgttgaaactgactcagccagtgaggatgccagtgtcaagccctccaagatgttgggttcccagcatctctgtgcctctctaatgcatgaatgactgatgcatagaccaagggaggcagacactagctagtatcaacactatattaaacacaagtaaaaccagatttcttgttttaaataaattttttttattattatactttaagttttagggtacatgtgcacaatgtgcaggttagttacatatgtatacatgtgacatgctggtgtgctgcacccactaactcgtcatctagcattaggtatatctcccaatataggccaggtgcaatggctcacgcctgcaatcccagcactttgggagaccaaggcaggtggatcgcttgagctcacgagtttgagaccagcctgggcaacatggagaaaccccatctctacaaaaaatacaaaaattaattgggcatggtgatgccctgagactaccctgcatgccctgatgcacacctgcagtctcagctacttgggtggctgaggtggaaggatggcttgaacctgggaggcagaagttgcagtgagccacgattgcaccactgcactccaggcttatagcctgggtgatagagccagaccttgtctcagaaaaaaaaaaaaaaaaaaaaaaaaaaaaaaaaaaaaaaaaaaaaaaaaaaagaagcagtagttctaatagtttctcccctttcttcatcggagagtgttccttcttagcagcccttggcatcaaaatgcataacactaaagaggcaaaagggagctcagtgttttagagtttggtctctggtattctggagcaaaacagtaaataagtagcctcccctagattattgtgaagttggggatattgggtcatcagcattcaactttattttatttatttattttttgagatagggttttgctctgttacctaggctggagtgcagtggcaccatcacagctcactgcagcctcgatctcctgggctcaagtgatcctcccacctcagccccccccaagtaactgggacctacaggcgctcaccaccatacccagctaatttttgtagagacaggatttcaccacgttgcccaggctggccttgaactcttgggttcaagcaattcactggcctcggcctccgagaatgctaggattacaggcatgagccaccgtgcccagctagcatccaactttaattgtggaagacagagtaataaatatttgacaataaacaatggctcctaaattaagaacatctgagaagatgcaaagtgatacatgaattcctgttgagaactatgtaactggcagcagtaggaggcagacttttaataatagtaataaaatgtgtgccttttggaaaagaacagtgaattagagactgagagcatggactaagctcagaggtgaggaaagcttcgcagacctaggatagagagatacgatcctgggcatttgtgtgagcatgagcaagccaaacatcagttagtctcaaaggcaacagctgcccggacttcaaggggtaaccctgagaatctgattgatgaagagaacactcctttccccaaatcgcaagaagaactcagcctgtgctcatgacagaacagcacacacaaaaaaagagaaacttgggtcaggcctacagccagagagactagccaaggaaaaggtagaggaaaccaggagagctgggaaaagatagttaagtctttcccagtgaaggttccacaatgcaccaatcactctaggtgctcctggtaacatgagttctgtggccaaatgactttgagagatactacttcctacatttgtcatctcactcatagctcagagattcataatacccattagtatattaaatgcactatcaaatgctatagtcaagatatccacttaactcaagggctggatagagtggctcatgcctgtaatcccagtgctgtgggaggccaaggcaggaggatcacttaagcccaggaggagcccagcgtgtacaacacagcaagacctcatctctacacaaaatttttaaaaatttagcttagagagaaagggcacctgtagccccagcgactccagaggctgaggtgggaggatcatctgagcttaggacttcaaggttacagtgagctatgatggcaccagtgcactccagcctgggtggcagagtgagaccctatctctaaaaatcttaatctctacatatctatacatctgctcaactcagatttgctcaaacatatttgactaaagaaagcttttgttttaaaaaaaagtcctgcagaatttttgttctaagaaataaagtttgggaaatactggactaactaactgatgcttaaatctgtaccaaggcaaggaccagcaagaggtctcctacacgtgtcatgcttcatgtgaatatcatttgtctcttgagacccccacactttaatgagagtgaacatttatttcccagcctgtggattaaaaggggttttgagggaatagaactttctccagagggccttcctctcctgctgaaggtgatctcaggtgtgagtagtggccctagccaaaggccacgtctcagggaagggggttgggcacctctgtccactagaacacccaaggggccttggaacctgtggactcagactatgaggccagagccaaccaggagtggggccgatggaggcctcctggtctgctctcggtcactcttggcaccaaaaacacctaatacgctccagaggatacatgagtgagtttatgaatgatggaagaaaaatattacaggtggatttctttcttttcttttctgaaacctcccccttccaggttcaagcaattctcctgcctcagcctcccaagcagctgggactacaggcatacaccaccacgcctggctaatttttgaatttttagtagagatggagtttcaccatgttggccaggctagtctcaaactcctgacctcagatgatctgcccacctcagcctcccaaagtgctgggattataggtgtgagccaccacacctggcataggtggattttttttcaataaaacatagacattcttataacaatcaccagcatactgaaaatcatagagatgaaagctaagcctcattgagttgtcattatgtgccaggcaatgagctaagaattttatgtgcactttcttatttattcattataaccacccagccaatgggcactaggatattcccattttgtcgatgaagaaacggaaatacgcagagattaaataacttgtccaaagtcaagtggcagagccagaatccggaagcagagctgtgattctagccctgaaccaccttcaagccacccagcttgcaactggatagccttctgcaccagctggaatccttttggagaaggatatattctctacctgttcctccacctcttcattgtttttctggactttgtctaaataagtattcagataatctccccttagccattgtgcatcccttcaaaaccatcgcatacgtctctgagtcagtttcaaattgatgtctccattgtctgcttgtaatatctgaaatgcacttgaaagactcatatgagatatgtaaataaatgccatttgtaatttacccttttatacctatattgcatttagtaaagtcacatgacatcattaatgctaactagtcatcgtgaacaagggcataaattaatgtgcatcaatttacttttgaaaacgtcccattgatattcaaacggagtgtaaaatgtacttaagtatcaacatttctggtctgttttccacagaactcaagagcaagtcaatcagtgctcatggaatttaactatttccattaggataccatccctaggggacaggggagtgggttggaacagtgtgagtcaacttctaccaacacctggcctgttgagaggggtgaggtggtcaaggcccacccaccacccccacccacaaatgaggatcagtggtagtcttaagaaagagcccaaagactccagcctccagaccagagtccttgtaatgacctcactcaaaagcgtaaggagaatgtgcccttcaaactgacatctttttcttccctgatccctaactccatgagaaagttgggtttctggagcaattcccacagcaggaccacactcttttcaacacccttcaagctggagtttgctctcactttaccactgcagagcttccagaacaaggccttccctcggcccttctctgattgtgtacagggactggctctgtgtggggcatgcagtgggcgcttactaaacagacatggtgggacaggagctggaagctagcagagaagcagccctggccctgtctgtccaccctgtggagtctcctcatgtgctgctaagtggatgattataggtggttgtctttaaaaatggcacttagagtgccccgaaagtaacaggacaccggcgctaagttaggagaaggcgcaataattgtcaggacaattgccagagacagatgcttaatggagttcaggattagagacctgccagcgctttccttaactactggcccttgggtttcctcagcttttctcctgctccacatcctccctcacccacccctgctctacctccacatcatagctcttcttctctattctggggcagagagaaggaaaatgagccagttttccctctgctctagaagtcctggaagatgagggaccaaaagtttcttcagctacccaatctgtgataacttcatatatccaatgaggttggactcaaatggattcagactccttccctggagtggaagcagagttacagagaaaaatccagagacaacatagctctctctgattagggtgggagaccacagcctcctgggccctccatcccctggaaggcagtgctccttactatgaagggagtctctgcctgagtactttctagaggctttgagatgatagataggggaagcacagaatcctgggtagctggtgcctggagctcaactggcctttagccaccaagcagtggtttgtccaggcttccctgcccctaacaacgtttttgtttgtttgttttggacatagagtctcactctgtcacctaagccggggtgaagtggcatgatctcggctcactgcaacctctgccgcctgggttcaagtgatgctcatgcctcagccttccaggtagctgagactataggcacgcacaataaggcctggctaactttttgtatttttagtaaagatggggtttcaccgtgttgtccaggctgttctcgaactcctgagctcaggcaatctgcccgccttggtctcccaaagtgctaggattaacaatacattttctaattgtaataagaataatgataatgatgacagcaaccacaacttactaaaagcctactacgtgctaggcactttacatatattaacttcaatcctaaaagtgctgaaagagagttatcatcactttaattttctacataaaaaaccaaagcatgaactgcttgagtgagttgctccaggtggcacagctggtgagtactaaggacgggtatgaaaagccaagtccgtgatctgttcatgaccccccccggagcctccatcctgcacatgcttatactttctggtcacccccatggtctgtctgagagatgccaggccactgtggtgatcatactcagatgtcagagacttttgcctacaccagtgaccatgtagaaacacgtcagtcagaaaaaaacagtgggggtggtgggctgctaccctgcctactccctctgtgaggtgaggctggtgccacccagggctccatgtaccccgggatgccctagaggttgcaaaggggcacttgtcccaccttgtgtcaggctacaacaaaggagaagtaaaccaagggacctccttcatggggccgaggctggttctgagttctgatcacatctgcactgctccaccaccccatccccagagactccttctgccttctatggctggttctgacacccaagagtggggcgtaccactttttactggaaagtcaagatgatggatagtatctcttgctctcacagagggctccccattcctcgttggaggagggggctgggaaaggcattgcagaaggagctgagccctatattcaagctcagctcctcccccaaactgctggtgactctggatgacctgctccctcctctgtgcttcagtttccacactgatcacaaagtgcagtaggagcgtgttgcgccagataagccagtagcgttttccaggcctaaggttttagggtacagtggacaattcagcacctactgactgtaggaaactagggagggaagtcacttcccctctggttcctccagttctgccgtggtaaaatgcagacatcctgccttgattgagaatgaagtgggaagtgggaatatctcagtaatgacattctggaaccttcagaatctgttccagacaaatgggaaggctcccacctgagtgaaattgggtgaaacattgagacagcttttctgtttttgtgaatgtctgaggtggctccatttcctgtcactcattcctcagccctgtgcttcaagtttgctctcccaggagctatcagacataggccagcctgggtgccaggagcaaacatccacgtgggcttgtcaccgtgtcagccatccaaacactaactggagtgtacagctcggcccccacaggggcagagaggatggcagagagacggttgcatcaccatccagtgcaccttacatgagacatgcccacagacacagtgctgagggcaggactcattttcacaggagcccagcacctttggctgcagacagtatctccacaacagcctcttctatcaaatcaatgtctatagacctccaagactgtcagacttcacatcaccttcctcagaacatcctgggaggcagggtggagacagggacagacactgaggtgcaaagaaatggtaatgactccttcatcacacagggggtccctggtggaggcaacatccacttaggggtcccaagcctcaagcgatgctgccttcttagaccatgatactacctccccgttgaactatagctccttctgaagctctcagcatggtaaaaaacaatcacgatgcctcctctcacctcttccctccagagaggctggcttcactatctttcaatttcacaaccccaaacaaagaacttgcaaataaatagaagaaggaaagggacaggacaacatggacaggcctccccttctcctcttgtatgcccatctgaccactctcttttaaaatgcaaccctttcaccctcacaaggatcctgactccacttaatccacttgatttcctttttctggagtgtttatcacctgctaacctagtctctgatttatttcttaggttggttccttctttgctgcttccttttgctaaaagcatagggatatgtcactgtttcttcatggttgtattcccaatgccttgactggtgcttggcacatagtaggagggagcttagggaatgcatcttttaaaaaaatttatttttatttattttttttttagagaagtcatctccctctgttgcccaggctggagtacagtggcatgaccacggctcattgcagcctcaacctcctagattcaaataatccctctgcctcagcctcctgagtagctgggactacaggtgcacaccaccacacctggataatttttaaattttttgtagagatgggattttgccatattgcccaggctggtctcaaactcctgccctcaaccaattcttctaccttggcctctcaaagtgctgggattataggtatgagccacagtgcccagctaattaattttttttttttttagagatagggtctctctatgttgcccaggttgatctctgtttcctaaacgaatgaatgaatcaggcctgagtaatatgctataaagcaaggtggccctcgccacttcactactggtttacgctggaaggagccaggcaaggctgctatcctgggcaatgcctatgggcagggaactcacctccaggcccacctcctcaggccccacaggcgtccgcatcctgctttatagcaaggacttgagcaccggcagctcagaaggacaggctgcaggagtcccccagcacctggaagcagacccactgtgaacaggagtcagtaaaacaaaggacaccataaaagatggctttggtccaaacatcgctgaaacagatccccaaagcagaaatgtgtgtttgaggcttctggcttccaggaaggaaagggctggtgtgtggagaggcagatacattgaaattcactgagaaatctgccacttcctctgggtctatcaaagaagatactcgccttgtctgggggacagctgcttctcccctggtaggggtcactccagggcacccaagaacaaggatggtcccagctctgccacctcatcttctcatttatctgcctcactgacatttcccctcacctccttcccattggcttggcaggtttttatcacactggtttcagtgtgtatagacattcccttggggttactggaattttagtaaatacacaccacactcatatacatgcatacacatacaaagcaagaaggaggctaacagagacacacagacagggatagacacaggggaaggggtgggtgtgcatgtgcacacacagctgagagatatccagaatcatgcagaagaaagaaaagagacagagagaaacgtaacacggctctgaaagagacagttaaatcatgacaaaatgacactgacacttaacagtgcacactcgtacactccaagcagaagtgtacccggaacatggcatttgctgcaagagctcacagagggacccacacgtccatgataagagaaaccatatccaggctacagaactacgtaatttgcaaataatctaatagctaacgtttgctgaatgttctttctgagctaagctcttttacatggaatatctcattgaatcctcactcactccaggagatcaatactgtttactaaatccccatttcacaggtgcacacggaggctggggtgatctgagctggcctctgtcttcagctgtctcactcaccactttcccccttctcccctcctggcagcccgtccggtgtcctcaaaaacacatgtcacatgccgtctctggcctctgtgcttgctgttccctccacctggaccacttctccccagacggtcctctcgcaccacttcactctcttctgctttttgctcaaaagttccctccttggagaatttcccttgcaaccatctttaaaagagcactcccctccactcttctggccatcaccttatttctcctgagtcggtttaatttttcactctgttcactattacctgatctaagccattcactcattctctcattcgctgtctctctgcccagaatgtaaggcctataaggataaggactttgcttgtattgttccccatggaattcctggtatcctagaagaatgcttggctcagagcaggtgctcagtaaacatttgttgaatattgaatgaataaggtgctgagggaatgggtgacagagccagaaaatatgtagcatttgtgtgcagatatgcacatgtgtacacacacacacactccattctctacctccattagtcatataatccttaccctgcatgtcgagagctggccatccattcatcctctctaccatgcattcatcctaccacatgccaagagctggcctatttcagcatatggaatgaggaacactggaacccaaggagagtttatttatttatttattttttgagtcagagtctcactagtcacataggctggagtgcagtggcatgatctaagttcactgcaacctccgcctcccaggttgaagcgattctcctgcctcagcctcccgagtggttgggattacaggtgcatgccaccaggctcagctaatgttttgtctttttagtagagatgggtttctccatgttggccaggctggtctcgaactcctgacctcaggtgacctgccctcctcagcctcccaaaatgctgggattgcaggcgtgagcccccacactcagcccccaggaaagtttcaaacagcagtggggagtcaaagttagttgatctctctggatacttctttaactatggattcattaactgtttcacgactactaaaatatgacgcaaaatatttcccctgactgtcaaatgcctctttcctgcactctgtgtcccccagtgtggtatcaggtaaatcagagggaggctggaggtggcagagagcagcatctccatccacaaagaaactagggacaagaagggatgaaagagtgtttagaagagagagcagcccctgcccaccaaatggtaaagaggaacattcctcaggggcagaggtaacaccctagatagagcttgccgggttgctgacgaatcaaagttatctggttcttaataaaactcagaatcctgccatctctatttaagtcttcaggcgtcatctccaggcaggaggtcccagtctcaccaaaatcagagtgctctcaaagaagggctgctcttcatcacaaacagatgaagtccaaagctcattcactcatattaactctataagaatatacctggccctttctctgggtgaggtcttcctctacctgctagacacaagagagacaaggtccctgccctccaggaacttatatgctaattcatagggatgggaaataaacaggtaattttcatactgtggtgggcagcagaagggagtaaacaaaaagacttaataggaagaagtcaagattccagggtgagggatatttatgtagggtggccagcggaggcctctctgaggacacgatatttgagcaaaaaccacaggcatgaggagggaccagccacaggaaaagccagagagttttcacagcagaggaaacagtaagcgtgcaagttctgcagcaggaaggagctgggctcagggacagaacaaaggcctgtttgctggtacacggagagccagggtccagggtcacaaaatgagcttgcagaggtggagatgagtcacaggatggggccaagggaccatgccaggagcttgggccttatgccaagaatgatgagatgcccctgatggtaggaggggtccatgaacacccattctgttaacttggaaagtgctcacaagcctcccgattcagttgctcatctcttcgcctgttgtattagcttgttttcatgctgctgaaaaaaacatacctgagactgggtaatttacaaagaaaaagaggtttaatggactcagagtttcatgtggctggggaggcctcacaatcacatcttacatggcggcagggaagacagaatgagagccaagcaaatataaaaccaccggatcttgtgagacttattcactacatgagaacagcatgggggaaaccacccccaggattcaattatctttcaccaggtcccttccacaacacatgggaattatgggagctacaatgcaagatgagatttaggtggggacacagccaaaccatatcacctgtcattgtattgaacacaacaccaggacaaaaaggttgtttaggccactgccctgctgcagataccaaacagatcagagaagagagaggctggtatgtaagaatggacagcataaagcacacattttctaccaccagtttttttacacagtgatccctgttagaaaatgtgtccttcaatcccatataagcctcctggattatcatccagattgccactctcacatatgtttaggatgcccttccactaagatctgggaatacaggtgctagtatgtttcatgttagattttagtcttcagttataggagcaaccagagcaccaaaattgaaaccacagctctcttgagcccagatccatttagtcacccattccacaaatgtgatttgagtgtttattaggtgtcagtgctgttctaggggtaacacacaagtaaactaaagagactaaaaaacaaaaaatcatattcttatggagtttacattttaaatgaggaagacatataatacagaacaattattaagaatcatatagcaaataagaagagactaagtgctatggataaaaatagagccaggagaggagattgggagtttatgagtctgagtggaaggcaatctagagttttacctgtggtactcaggggacgcagatacctggatagaattccaggcaaaggggaacaaccaggacaaagatcctgaagcaggagcctgccatattgcaggagcatcacagaggacatttctgtgtccagagcactctctcccgccctggccctgcagactaggggagcagggagagcggggagagcggcaggtgatgagcttggacatctcatgaggacagagcatataaggccctgtgggtcttcataggcactttggtcattgaaaggatttaaacggaggaatgacactatctaactcaaacttttgaagattaactgctgcatggagaaaagactggaaagacaaaggtggaaacagagagagtagttggagggctattgcaaatattcaggcaagagaccatgggggttcaatccaggtgggtaacaatgaagtggtgggaaatagccatattctggaaacattttgtagagtccgtagaattatgggagctacaactcaagatgagatttgggtgggacacagcaaaaccatatcaaggtgtttatgttaaaatgaggctgatagagagaggccctaatccaatttgactggtgctcttagaagaagaggcgagtaggacacatagagaaacaccagggctgtgcacacagaggaaaggctatgtgaggacacagtgagaaggtggccatctgcaagccagggagagaggcctcagaaaaaaccagccctgctgacactgtgatcctggacttccaacatccaaagctatgagaaaacaaatttctgttgtttaagctccccagtctgtgctattttgttatggcagccctagccaatgaatataagtggtagattactgacatgcaggaagtgcttcccttatctgacttaagtttgaactttgtaataaactgaagcaataggttatttgtgttggtacctctcttttccaattctggttcaatgagggcactggggactcattcattaaaaaattaagaggggcctattaggtgaagtttaggctggcaaggcatcggatgctctcaagctgctggcagcaagagagacaaggaagtcataatcacagcctggtctgacaagagctactatagacatgtctaactgcaggccaggaatagtccaatgaagaatgtgacagccgagctaagttttgaaggacaaggaaaaattagtcacataagaaaggaaagtgctttccaggctgcactgacatcatggctaagctatgcccttagcctgcagacacagtgtgcaacgtgttctgacccatcatggctgagggagacccaccacctgaaggaggctggaattagtcttgataccctgggtctggaaaatacccaggtatatttatcaagctgctttgccctgagctctattccgcatgcccaacctgtcaagcaggcctgggttcctgatgcgctctcccccgggactggatttttgctccctgcctcccttggcctcacctgggctgctgtgctccaacccagatggaccatctagaatctcaataccagcccctgcctgactctaagcacggccagtgtctggaaactcctgtcacagagtcataaaaaacaagagtctctccatttaacaagcacttactctgtgccagccatggttctaagcttattatatgcctatctcattcaattcttggaaaaaaactatctgatattattgtcaccaacataggacagtaaagaatgctgaatcttaaggttaggaacttaccagagactacatttagtaaatgagatttaagattcccactcagacatttcaatggcaacacctgtggacttaatcattgcactgttctacaaatctccaccaagaatccacaagcccagtggagaccagtgtcggcccaggtgttaggcctttgagatggtcatttgggtggcaggccagtctccacatctgtgtggagcagccctggaatggatgaacaccctggctctattcattcctgccttcctttccaatgtgcccataatatggagttctcaggatgcctcattgccaagcctgaatggacagtgaccacattacccatccaaggggaaacagctgaggacaaagaggtgaacaaggattcagatgggcacctccagggaaggagtaatgctcagaatgctgactcagttctcaaagggggctgataactcatattaccagcttatactttgtttttttgtttttaatttctctttttttttttttagagacaaagtcttgctatgttgcccaggctggccttgaactcctggcctttcggtaatcctcctgccttggcctcccgagcagctgggattataggtgcaagaccctgcacctggctccgtttatattttccgtctttgaaagtcctcttatgttttaagtcccaggttcagaaatgctggctttcagatcaggcaagaaatcttgaatattcaatgccttgtgaagatcttctccagatgattcatgccaccaaggaaagctgcttcccctcagctcctagggcctcagaggtgggcttggagtggggagtgtggaagctgttataaaagcaaggaatgcagacaaatgggaagcctcgtgcccagctgcaggctccatctcggtagtctcccctcccaggaaaaaatactccattttccaccctaccttgggaatgagaccattcccaagccatggcagcctcatccagggcacagtgggtcccagtatggctgaagtcgggagaacggggagtctgacaacaggagaagatgtcatcgagctcttggggagggcagagctcctgtgactgttaaggcataatgcacaagccccgtgggtggcataatgtggaattcatctcccccacaatgccaagagggtccaggcagaacaatccagactctgtcagcagggtcctccagagagttcaggccacgctgacgaggatgaaaaagaggggagatctgcccctcatggccgctgctgccactcagagctaacgcatacatattcatgggatagaggggcagctcccgagaatgacccatcctccacagaggccacagggcagaggtacagcagtgctgcacctcacttggggtgggctgtgtgttgtggggtggaggactccaggaaatacccttaaatacatggatgtccaaggtgaaaccccttcctttgcctgctgcagacatatgactcctggcctgagctcagggactccagaaaaactcacttcgttctcagctcagtttgagaaccaagcccaggttttctacttcctactcagcatcagcaaacctgcaccatatctgttcttctcgggtgggctccatggcatttgctggagtttccacaaagagttgtatgtacacacaaaagttcaggccgtgccctaccccatcacatctcatcacacagactgttttctgagtcctgaccatggtgttcccttaactacactcttttggcaataaattcttgatcccacaggcttctgggggccaggaaggtgactttggtatgaggtagcattttgtatagggaaatctggacccacaatttgggcatctgtacgacgttccttcagaagaaagcaaatgttggccccgaacatatatgcatgattttgaaattagtggatttgttttagactctccaatattttgatattttaaatgtttctttcctgtttcagaacaccaagcctcagtccccaggcagcataactgaaaagtataactgaaaagatacatactacgccaaataaatcaaatcacctctctgcagctggcctcctaaggtttgtactgagccacaggctagtatttaactgcaagacaaatgtctagcggagcccgaagagccttacctgcctctctgacatgatgtagagttgctcgtggtccttggagaaggccatatcccggaggactgggccggggtccaccacctgcaccgtctcatactggagggcgttgcccctgggtccatccacccggatctgtggagaagaagaggagagccaaagtgagttcagatcctgcactgcccacagccaaacttcagccaaagaccctgtcaacagccaagggagagggcatgagttctgtctccacagtgctcacaggctaaagccaaggagtggagtgacataagctcaccaagggcctcaggatgggagtggcagagagggaagtgggggaccaagctgggcttcaccaagaatccagtcttaatctccctggttccctatgcctcaggctcaagcatttgatgcctttcttgctggtctttggagaaaaagatgaggctctgaggcttggaggaacaacatgtaattgaaactgcctcagatcagagcgtcaccctgcattggaaaggcaatattatttgctgcatttgttagcagaaaaacatgtcagtgtaaggatgggaactgctacctggatgtcattgctgttccttgaaggtgaaccaggcagggggccaaccccaaaggtttcacactaagggtctctttttttgccattgaaatagtggcttatacttataccattaggtcctgaaaccttctagaggttttgttcacgtccccagcaaaagggatgtgggaattacaggaaaatgtgcttcaggcatgagtcatccacaaccttctgcaaacactcagctgaatagatcatccccggccatccataagtccttcctagaaatgctgggacagcatagagacaatggaaagaagacttctgcccacatgccccatgaatgagaactaacctagaaaagacatgagctttccaaccctacatgatgctcatctggcctctggatgttggccaaggtctctggaaacatcctgtgtttgagtgcatagatccaacatgaccgctgcgcagtcagtgctaaaaacaccactcccataaatcaggaacaaatattactgagagtgtggctaggcaagaactaggggatcaccacacttccctaccacatgcacaactgtaagctacacataacgtaattttagagatttcaacaataaaactaaagaaaaaaattatattccaaatattcccattaggcactcttatttttaatttttaatgtataatttttaacctctcacaagatcaaggagaataaaagagtcattctgaggaactaaattacagaaagaacaccatgttaatgacaactgaccacaccaggtcccccagaaggctcccacctttcatttctcttgagtccatgaactctgatatcaggttattttgtggtttatttgcttgattttgggtttgttctggactctgatttttaaaatttccttttaagcattattttcaagcttcatggacatcaggtactgggagatggttttgcacataattccttattgatataatcctctcaatcctgtgggtttaatgttcattcatcacggctcatgtgtccctccagcatccattccaccttctcccaccttttgggtgggattgaacccactccttgcttcccaggttgtccgtgatgagcataaacaaaccagcttgatcttactctctgccacagtgattaagagaaaataggctcaagccaatcaacgtgaatcagagcaaagcagggactcatggtagaaagaagaggccatctttcttcactctcaaaggggtagaatgaacttgcggctcaaagatctgtgggcagccctctcctaacaaggaagggaactggaaccagggcaggtcaaacacagagatgggaaaatattggtctttggtgacatcgctgagccactgaatcaaagtaaccccaaagcctgcctgacattgggacttcctagttactgcagatattttctttaggttaaagtaatacaaaggttttttgcaacatcaaaagtcctagtggatgcactgataatagacaagaaaaatgatacccaggtacattaaacaagtggcctgtgggataaaatctggggacagaattagaattcagtttgactctggaagtccatgcttttcctaccaccagttacatgagagtccttgctcccagagggtttcctgtatgtctcccggtggtggccacctaaaggcagggagctgaggtcagggtctgtctctagtctgtacaattcctgagactttctctagtcattcttgattttggtgctcaaacacttgaacctgacaaatatttattttaaaaatgaataaattaatgaatgtagttcagattcctctttgatggtttcccattaagcccatgaaaacaacagttaaaggatttaaggagtcgtggttagtgtcaaaaatggaaatgcctctgattcccagagccttccttcttctgtgcccaccccaagccaccagatgtccatgctggccaggtcctttcctaatctagatgaaacaggagttcatgcaaaaccaattgggattaccacccaagtctgaccgtgcaatgatggccttggcccctggcccagccaagcttcatccccagctgggaggtgcccctggagcaggagcagagagtgatactgaatgccctggctggtctccagccccctcaggccaccgtcggccagagcagggtccccaggggagtgctggcggaactaagctccatccagtgccccttggcctgatccccaaatgaaattacattcagtgcctgagcagtctcctttatctttcgactccaacttcactgctccttaggatgaggggtttgctgggtgtggctggacatcaaaggaagccagttgacttgggggatggacagaggggtggatgaggaagcaccaactggacaaggttccataggcctggccttctgcaaggaggctggatgcagattagtccccaccctctgcactctgccagcgagaaatatgtaactggaaaggctccttctctcttttcccaccccaccctccaacaaattttcagaaaaccaaagaaaagcattatttattcatctgttgaaaaaattcacacaagacatggataaaggagtttatggtggaatttactgaatgtttgatgagcaatacaaaaatttaggtagaatggaccagctgccggctcttggacccttaacatagacaaatagaacaagagctgttatttattgagtggccactatgggtctgggacaatgataggcattttatatatatttattttcttatttaaatctcagaactcagtaaagtaagcattaatattgtccccctttataggtgtggcacaaaaaaggttaaataacttggttaaggtcacacatctggcggatggcacaggctgcacccttaccagggtctgattgtttccagtggtcatgcttctatgagttcacactctacaccaaaggctcacactgaatccggcactattgtttatgtaaacctgcattccttcaagacgtcaaaggagttgattttaaacaagcatcaccccaggggtgctggaggagccatgtctttatctactgcagttctgggagagaaacgtgcatatgaatgaagatgctgttgtaaattttctaaataatgatcccttatatttttgctttataccttgcaaagcattcttaaataacactgtctcagctgatggttgtaaaatttttatgatgttgattgccagaataatcattctcatcttcctgatgaagcagccaagatggaggctgttctgtgccttgccccaagttcaatgataaaccaatggcatataagactagaacccaggtctcctgattcctagctcagtgcttgtctcttagctatttagattttccagaagcctttgacaaggttccacatgaaaagttatttaaaaataatgagtctccatgggacttcgggcagtttggccatggagagagagaattgactaagagacaggaaaagacagatttctgcatggagaagtaactagtgttacgactagtctcatttaatattttttataaatggtctggaggagggagcaggaaaatgtgcaaatgattctaaactctttgggacagcaagaaggccaataacaaaggtgaactacaaaaaaaaatggtccaccctctgcaggggctgacagttgccacgtggcaaatagccctgggaccatgagtctcccaaggaagaggtcatgcctgctgtactcagtgcaatccccaatacatggttggtgcttagtaagtaattactgaataaatgtaaaacaaccacagtctctaatatctgagctgctagttataatcgaggtaagagtcaggatcgaggaagggatcagagccaccatttactactcccaatactcgggcagccaaaaaggcccacaaaatgttaggcagcatttaagtaagatttcatagaaaaacagacaagcagaagccatcatcttggtcaagttcacctgaacatacgagatcacattcagttcaccgctcataaggtaggaacacaatccagatgcctgcaactcaagaacagcctaggaaagacagcccatgccagaaagaaatagttgagatgaaagaagacacactgaccagtggccatggttcagtcaccaatacagaggccaccccaacacttgtaacatgacaacttgaacaaattagatttcttttttgtttgtttgtttgtttttgttttcagacagattcttgctcttgttgcccaggctggagtgcaatggcacgatctcagctcactgtaacctctgcctcctgggttcaagcgattctcctgcctcagcctcctgagtagctgggattacagtcacctaccaccacgcccagctaatttttgtattgttagtagagacggggtttcaccatatttgccaggctggtctcaaactcgacctcgtgatctgcccgcctcggcctcccaaagtgctgggattacaggcgtgagccaccaggcccagcctagatttcttatttttacatagtatagatacttgtggatcacctaaacaatgagaaaggatgaaaacagaagttgatttttttttttttttttttggtagaaaatgtaaagaaattggccgggtgctgttgcttaagcctgtaatcccaacactttgggaagccgaggtgggcggatcacgaggtcaagagatcaagactatcctggccaatatggtgaaaccctgtctctactaaaaacacaaaaattagctgggcgtggcggtgggcgcctgtagtcccagctactcgggatgctaaggcaggagaatagcttaaacctgggaggcggaggttgcagtcagccaagatggtgctactgcactccagcctgggcgacagagcaagactccgtctcaaaaaagaaaatgtaaagaaaccaatcacaggtcacgaaggtactttggttgtttggaagatgttaatctctgaggatgacaccaaggaggaaaccacatcccaatcctgtgtgtcccttgacggagcgacacatcccacacccaccatgtgtctgttgaatgcccactgttccagagcctctcctagagagaagaggtggtaagtgccagccccgccttccaggaggcctgtctcctggagggctcagatttcacacaaataatgccaggtggcaaatgctatggcagaggagtgttctaaggcctctctttgttcttctcaggagatctagccaactggagtttaaccagggatgatcagcccagctccaggcgaggctagtgggcagggagcatcatgaccaagagctaccaatatggcatgccagtgatgagagcttgactaatacaacacatagcaggtaacgtcagatttactcaaagccaccttaggggacaaaatcttttagatcagtaggaaggctgatctgaagtagcaaaattagcaggactaatagatttcataaagacgtaacatactgagagaagggttagagtaaaacttggaaaaagggcgtctgaggggaagaatttgatcatcttcctgcagcatcatcttgaggagagagagagactagagaagatcagagagccactgtgtcctctgtagtagggaggggtgcccctgcaggcctcacctcagcccccgtagatagttccagaacagcactggacaatggaagatagtacaagccacaaatgtgggtcacatacgttatttaaaattttctagtagtggccaaattttacaaaacaagtaaaattaattttcataatatgtttaatctgacccaatataccccaaatatgacattagcatgtctacaagtataaaaattttattgagatattttacattcttttcctcatactaactaaacctttgccacctgaggtgcatgttaaacttacagcacagctcagtttggagcagccacgtttcaggtgctcactatgtggccagaggctaccatattggacagcacaattctagactattctctttcctgtgtattgattctgcattcaccaagtgaccttgctaataatttggtttggtgactatcccccggaggcatgctccattgagattttgcaaccacccccaaccccaaccggccctccctcccccctgtcctctgctgcaacccctttgtgtctcccagggaccttcaagctacagcacagtgcagtgtgccccattgcccttactttttgggcattcttgggctgtatgatccagccagctgtatggtccccatcaagtcagaatgctgctgcatgggcctcattctaatccaggctcatttgatgcacccatgccttctcttcccacactctgggcaaacctcctgcgcagcaggacccctggtacccctgctcgtgggaggggaccaaccagtcagccagaatcgttgctgtgggaggggattcttggagactcttacctgcaccaagtaatactgccttgggagagagtggtgataagtgggacacctagacggtggtgggcatctggggctgggggcagcaactgactaacaattgcatagatgcatttcaatattaacgactggtgaggccacatgagcacttaaggactgagcatcatcttgcctgtgccacacagaaacctccactacagtgttcagtgtgcactgcactactccacactacatgcagcttaccaagaacacacacacacacacacacacacacacacacacacacacacacactctactctgggtatccaggcatctgcatccccagccactcagtccctggcccgggatcttccaaggcagccagcccctttcctccagccctgctggccccctgccgatccaccagtgggcaccgccacctatctccatccctggcacggtgagtctccgcactgccagacagactgctattgaaacatcagcagcgtggcctccgcaaaggtcagccatccggggagctcctggcagctgcttgtttgtttattggaacattatctgggccgggctgtttatttacatccattgaaggattgaacaataaatatagtctcccagtagcaggcagatgcttgcactagagcattctggctgccgtcttgcttggactaatctccctaatgagcaaacagtgctattcatctctaaagatgcaggccacctctgcactctccctttcctctctcccttcacatcctccccaaacttcctaatggaggtctacaccttcgagatttgggagctgggcccaggtataagaatgcaagggtgggctcttatccaacaggcagggaaatagagctggaactgtagatggagaggggaacagagcaaacctggaggcatatgtcccagggcaaatctgaattccccacctagaccctcaaacctcaaacacagaggcacgtggcaaaccagctggtggtcaggacagaaggaggtcaggccttgctcacagggccagaggtggaggggcttgtgcggaggcgccccatattccagccatgccagagccagagttaggccttgaagtgcccagaattggaaggagatcccttgcaacaaaatgcaaaccagtcagtttgcaaaagggagacttcattggggcaggcagggataggtgaggagccgaaggagggaagtaagggggccaggtttggctcctctcagaagccttgagcacatgacttcagctctcctagctgtcctgagtctctctcctggctctgacctggctctcaaggaggcagcaacaaagatccttggcaagcaatgagtgaccagccgtatctctggcacacaacagcagtatgatctctctcaggagggagcaaactgtgagccatttggatcatagatatgcagcctactcagttggacccacaggttctaaatgatgtagccctcatcactgtcacttggcacctgaaaggaagaattagcacaccaaagagtgccagaatcaggcacagggtaagtactcgttgaatgaatgaatgaatggcctgagaagctgattctgggtctgagttgccacagctggaaccaggagacacaaatgcacactcacagacatgtgtgcacacacatgtatacacatgtgcactctctggctctgaagatggggccacatctcagctcaaacacaatctctagaattttccctttctcattctgcagaaagggagagaggacaggtgatacaaccgtgtctggggcaaagaagagctgggaagggtgcagcaggttggcagcaagacagatgcgaatacgggcatgaggtctgagtaacttggcaactggctcgttgtgggttaaacgtcttcagaaaggggaccttccttgtggaagagctgcctagtttgcaggctggtagactggaggatttctcagttcccatcagactctgatgggctgcaagtccatctccccaccagaggagctccctcacaccccaggccctcactgccaatatccctacaaccccacaccaagggcatctgagaataagactgcactcatagaagcacctcacatcttccccagggcttttgttttttaaaagtattccctcctgcctctcccctggatttccaatcccctctccccattctgcttttgctttttttcacagcgcttgtccccttctgacatactgtgtcctgcgttcatttatgatggttattgtttacacccttgctagatcatacacaccacgggagcagaaatctttatcaagggatatatctcagacccttgaactgtgccacagagtaggtgctcaataaacatttgttgaataaatgaatgaatgaaaacactcaaagtaatcatcttcgtgtttcttcatcctcatggtgtagatctcccctattttacagtgagggaaccagttaggggctttccctcactgtaactgggagatgttacagcaaaagtgaaatggaaactgcccagccaggcccgcgtggccggtaggtgccctgtttcgccagcagggtggactgtttgatgccacatccgtgccttcctgcctttagtctcagggcttggaaggtgggcgtaaaccctgcttctgtgttcatgctgcttaagctgccccagaatagctccatgaggtactttgttttgatttcctgattccagccaggagaaaggggatgcaaagggaactgcaagagtgtaaacaataattaattagacaggcagtgtgtgtgcacaaatcgtgtgccgtgttaccaaacactgccaggacaatcggtccctttgggtctcccattacacacattctcagagccaaataatgatttctatgctgccattaggaacttcttgccctgcgatgtccaaaccaaaaagaaaccagtgataatggcctccaaaccttccccacctgcttgagtggtgacacaaagaacaagctacaactccagaagagaaagatgctgaagaaataagaagggaagtcaatagggctgatataaagaacataccaggaaaaggttcaaaccagcaaatttcacatgtggaatattttgaaacagcttcactgagtgcaccattcccagagactcaccagagagcactgtgtgctaaagttacaggtttgaaaccttggtaggtcagccaccccgtgaccccagagccacaacttctttggatagcctgcatcctaaaatcttggttggccatttcccatgtgcctctggttagaaaggagcctgggccactcccactcctaggaaaacaagttcccatgaataggtggttaattcaccacctgccatgcgccacacaccatgccatgcactttacacgcatcagctccttctgacacctggcagatggaccatgctcatccatgctgcaaaagaccagaatcctgagctggggtgcactggcagcgcaggatttttgaagtccaggggcaaacagcgtgactcccaactctgacacttaggaactgtgcagcctcagacaatctactaaactttcctatcactttcctcatatgaaaaacagaaataataacaatacctcattgttatcattattgtgcaagtatgataatgtcccaagcatggataatacttggcagagtgagggggttttgataaatactagcaatgattaatgtgcaatgattactattcaaatgaatggatctctatgattttcatccaagcccactgagagcacaaccctgatataaagaggttagaaggtttctatatgtgccgtagataaagaggctagaagatgtggcctgcagattggactcccaacatctgacaagttcacctaagggcaggagagggagaagaggacccacagcttagctctgggctgtctgaagacaatagagggcagggaaccaggactaaagagtctgtgctctttagcatgaattgtacagaacaaaatggacccagagaacttcccgtggctgccctgaagctacaggaattgtctaggaaaccctgagtctgctttaactcaggagagactcagaaagccaacgactttatggaggaagaacaaagcagtttcatgcccatggtctgaccaagctgcaggaggggaagtggagaaccacagcctggcctcgctgagagatgcggcatctctgaggacccagggaggatggagggcagaggtggggctggcaggatgctggggagatgcagagccagtcttcaaaagcagagtcagtggctctgcatggtgtcaggcacagagacgcaggccagaaccaggaccgtcagctcctcatccacacgcctctattgcctcatcctacagcttggacaagccatgttcatctctgcccccacacatggggaggctacctcctctcctctctgcccacacaactgttgcagtgacaaaggggttaatgcctgcgagacaatgaggactgggaacaggtgtgcaaggatgctggggctggcacagtccatgttcctctcctgctggaaatctggcctcctctggagtgggatccagcaggtgcttcatgctgttacaccagaaccaggagaaaactcctgtctagctggaggcccaaagaaaacagaagtagagagaaacccgggaatccagggactcctgtgtgagctgctaccacaccttcaggagtcgtccaggtactaactcagaggaaggatgctgctagcacagagctcggcacagggcagagactcaataaatcaactgcactagcaaagggggacttcattgcagcctcagaagcagcttcacctccctctcccttcacatcccagatttaccagtaggcaccgccaccctagagtggctcccttataagctatagggtgtgacagccatgagtgtgtcaacatcttgagggcaggtcagtggtgtagagcttaagcctggggctgtgcaggcaaccaagctcgactgctgattctgtctattatagatgtcgtaacctcaggcaggacttttcagacttgcttagcatcctcagctgaaacacaggtctcagaatttggagctcagagctgccgtgaggatctcatcaggtgaattgtgaaatgctctcagttcagcacctgatacatgcaatatacatacgtgcctgtgagctgtggctagttaatacgtagccgtgcctggttagccaatgtgaagatgaagaggagataatgtgatgctgatgatggtgtagcagagcacagcttcccctagcaaggctccctggcagctctgggaacaccagttgcttaatagatgtgtagtaaattgacaaatgaacacatgagtcccattaacattggaaaaagatcagaagggtcccagcatcctcagagactatcttccaagcttacatttctttgatgttctgtccttacaggaccaccaaacctctttctagcactaagggcacccgcagcagccagccctatatggctcccatcatcatcctgtctgcaggaagccccgtgggtctgttgctcagcccccaggcactgttctgcaatttccttgacaaataaataacccagggagtgtcagacaagtgcgtattacctcaacatctgctctccctactgggctctgccctaggttcttcccctgcagcctcatcaagctactggggcaccagcactttcaaggggcactgaggctgccatccaaggacagctgtgtgtgtgtgagagaggctaagaacagcccatgttcacctatgacaaggggcagaggtgcaacttcccagaaggtggaggatgcaacttcaacaaggctggggtgcctttctccattcactcctcatccccttgggaagcacgctggtcagagtggtgctgcctgacttctggcagaaatgatggagtttcattttgcaatgtcagtgcatttgcaaagccctagaacaggaggggattccagatttgctcagttgggatctataccaggatttcaaagtagccccagttcctgggctatctaggataattgtgtgtgtgtgtgtgtgtgtgtgtgtgtgtgtgtgtgcgcgtgtggcctaaaggagggtcagaaggaagtgagggatgcatgtgacgttacccaagatccggctcatggaaaactgagaatctcagaactctccccagagtctcccggtatgattcggtgcctcctgtgggctccagcggcacttcctgcacaccttgcttgtgtcacttatatgcattgctacatggggtcatgagcgctcactgtcttccccactccctaggagcttcttgagtgcaggggctacatgttattcatcttacccaagctcactagccagtaagtggagcaccacactgaagtttacattttctggcttcaaacctgtactcagcaacaattcttctaaaagtaggcactgtaatgttcagtgtcaccagcaaaaacaattactagagcttctttgaagagtgggcctcactcagggctatctcatagatcaccaccccttattgaatccttcccctccccgtcccacacatctctccagcacagacactgcccacatcttactttttaaaaacagcagctactctgggaaagaaatacttggaactatcacaaatgaggacccagaaattcatgagtcctggggtgaggcatgtgaatagtttacagtcagaaaatctgttcccaaagagactgtggggacagccttccctgggcttagaatgctggagctgagaagggcatccctgtctggggatgacatcaccagacagagctggaatgcacagatgcagaaagctgggggccctggggccaggagagagcttggctggaagatcacaaaggggcttttgaccaccctcatcccaggaaaaaccacagagacccagctttaagccacccccgccctcagttgaggggcctaaagacatcctcctccaatcagacgggtgacctttgatcccagtgagggaggcaccagagccaaagtgccttgaaggaaaataataataataataataataataagtgcctgtatgggttactccttctgccagaagcctgtggagttagttgcagagaaatccattttaaaataagatattggaaaaccattctctccgtcactggccacagttattacaattatttatgtggcatcatcaaggcccatgtgtttcacagcaattaaactattgatctcccagctctgaggcactgagcaaaaacctacagccactggttctggtgctctgggagttgcctctccccatgtttcagatgtgaaaactgagcccggtggggaagtcaccaagaacaagagagtcaggggatggcacattaatattaatgatcaatatgttaatataatatgctaatggtatattgacatatcaataataatatatccatttatccatttggccagcacttactctgtcaaagtgttagtttttaggtttgcccaagaaattaataatgcagtgattgaaagcatgggttccagaggccattaacaagggcttctacgcagctctgccaggacctagctacatgacctttgggaaatgagtcaatttctctaacccctggtttcctcatctggaagatgcagataataacagtacctaccacaatcagttgacgtgaagatttaatgagttagtagatgaaaagcatttagcacactgcccagcacataatcacagctaaactacagttagcacttatttacatgaggggtccatggctactcactgacccatgacacacctctggcaactcatgttgcacagctacgtcattggcaaaggagagagggaaggcttaccctcctgtgagtcgctgcactgagatttgaggggcactgcattcttttttgatggtcttgaggcaggagctgcacctggacctctgtttgcagctgccccctggatgcacatgggggtggtcctgagctccaacctccctctctgcctacctcactatacctatgtccccatcacttttcctcaagcctagagtcaatattaagctagtaatggttacacaaagtcttatttatgaaatgcatttaaagtaatattatttaatgtgtttcaaggacatgttaagggataaaatgtattggatggtgggagtctgagactggttttgaaataattctccttcctgaacttttttgctacaggaagttgcatgtgcctggaacatacactcttatattgcatggtgtggacagggagagactaaaagtagggtgacagtaaaggactatgattcttatcttggtctagccaaaaggcagttggaatagagggtaaggacagagggagaaggagatggggcttgaagaatgaaggacaaactctggattgtcacacctgggtggccaagggaatggtgggcccaaggagcaagttgaagggaatgccgtgtgggtggaaagaagaagtgcgggtctgagatctgctgaatgtcactggtgggagtgtggccgattgactgtctcattgttttggacattcaggactgaatgtctgctggatgtctgactgaatgactttctgcttaggcagaaagtcattgcttaggacaattgagtcactgtcattttagaggtggattgtgatatcatgatatcaaatcatttcccggagccagaatttagacgaccaccatggcaggctggccctcctaccctgtctctaagggtcacatcagacacattccatagattacagaatacagattggaaaagtgccggggaaagggaagaacacaaatcactatttcctacttcccttcacgttgcccccagacactacagagggctcactaagttgaggaatagaatgttctcccacttctcatcccagaagctgaaataggctccatgcatgacccaacataaacttgcaaatgaataggcagtcactttgaggagcacaggaaagacacaccgatttaattaccttctctgcaccatcaccagggtccttcaattttagtatctgaggaacttttctttggattaaacagtttcacagaaccaaacaaaagtctcattttgcaccaaaattttcacaatttttgcttagggctggttcaggaacttctttccaaagtctatgtcaaattaaaaatccagaaatacctaccattatttaaaaaatagtagggtttatttcccacactgacctaagacttaaaacaaaacgaagccctctaagggttgagtgtgtggtgtggccccttctccccacagaccttccccttgggtcagagcgtttagtcggcctcatgccaatgcccatgaccgggggtgctggttcccttctgcttcttggggccttccatggttcacccccatcagagtctggaaagggaggccacgggaagtagggaagggaggaagaggaaggaaagggtgggagagctgagggttggagaatatcaagaaaaactgagattttacaggttgttactctggggttccaaaagaggtcctcacggaggttccacatcaccagaccctgggtcctgtatcagaactgtcctgggtctgcacgctggagttcactaactggacttccagccactttacttcccatcctcaacgtagaccaggaaaagtcatgatggaaagacttctttgttcctcctcagcccagcagggctctgatcatgccagcttgttgtgttgcaagacacgaaaagaagccagcaacaaaattgtcttgcgtcacttaacttcctctcagatttctaagcaggtaattatttcctctcctccaatggactgcaagcattttggagggtttttatcagagacactccataaataaaagtgtcaggttattaaggataatcttatccactctcctgagcaagttatccagtggaatattgtgctcttcctctgtggcactttcttccttgacttttccatttggcacctaagtgagccaggggaggatgtgtgagcaagggagacatttctgctactggggcctgggaaacaggaccagaggggctttcactccggtctgttctgtgtgacctctgggaggcttgttttctctagttcattccattgctgaacatgagttgagcatgtactgtgtaaaatcccacccagaaatgcacacatttcaaataagatttggctggtttctaccctcaaagacttcttgtccaaaacaagattcacagcacaatttaaaaagcagtttcacattgactttctaaatttaattcacaccacacatagtaaggacacaataaactttattgaattaataaatgaaccatgattccagtgagggaaggaggatgattatttgtactcatgttgtatctatgaacaaactaagactcagatgggctacatgatgctcaaagttagattatagctaacaagtgctggatctcattttcgatcagatattctggttaaaacccaatacaccttggcccacatctcacgcccctcccgagtgaagcacattcaaatgattgacttctgttctggtggccatggagaggaagcagtggtcaattctgaggagtgtgcttcccagaagagtggcaatgtgagctgattgttaggaggaatatgattcaaatagcaggagccatgaggaagaatatgtcctaggcaggctggcatgagcaaaggcagagatggaggaaagtgccacgtgtgtgcagtgtagggtagtcagctgtggtcagggcatatgacttttgggggcatggtgggagggaagcccagagtggtaggttggatgcaggtgcaaaagacccttgaatgtctttcaaagtgctgggctttaacctgtacacagaggggaagtgttgtatgtttccaggatgggggaactgatatgatctgactttcataaactggagataataagcaaagcatatcctactttttcaacttggaaaaactgctatgcccttgaagaggggcactgtcattcctttaacaaagtgaacgcccacttattgcctcaaatgactaaactaaaaaatgcgactctatcaccataagcctccctatgttgtgttgggaggtggattttattgaatcgtccacattctcccagttctcttctagtcaactttttgggtttaggttaagggaacaatacatttctttgcagcaagctctctaaccagagtttgggaaaaccttgatgttcttaacataaactcaatcaactgacttaaacgcatggaaaatggtggacttaggaggaacatttcattttagcactttacggatcaagtcactatgggatagagaccctaaactctcacaaacttccaggctaagattttaaaacatagatttaaccctagcctataaagtacttaatcaataatagcttggtgcctcaaattttgaaaaggatttttatgtacatcatttcagtgtgtcctcccagcagtattgtgagctgggtttgggaagtgtccttaggccatagctccccagcagatgaagaactaaagcctggatgggaaatgactctccaaattcatgacaccactgtagcttcattaggtctcttaacttctgaacctgttgttcttaccatgctatcttggcacccacttctttttaaataagggactggggtctcacaagaaaagtacacaatttagtcccccaccctccagtttcatcaatgcagagtgagatgagtaaaacagggtgctataagactgcctgttgcttgagcctagctgtgttgtgctggggttgggttggattggattgagttgtattgtgctgcattgggttaggttgggctgtgttgtgttgtattggattggattaggttgggttttgttaaattgggttgtgtgtgttgtgttgtgttagactggatttattggattaggttgggttgaattggattggattgtgttgtgttgaattagatttagttgggttgtgctggattagattgagttgtgttgtgttgaattgaattgggctgggttcagttaagtttgtgttggattaaatgtaattggattgggttgtgttgggttgtgtgtgctgtgctatatcatgttagattggactgggttgggttgggttgggttggattggattggattgaattgggttgagttaggttgtgctgaattggattgagttgggttgggttgggttggactggattgggttgggttgtgttgggttgtattggattgagttgggttggattgggttgggttgggttgaatttgattggattgggttgtgttggattgtattgaattggattgagttgagttggattgggttgaatttgattggattgggttgtgttgtgttcagttggattgaattggattgggttgcattggatggggttggattgggttgtgttatgttgaattggaataaattggttgacttgagttggactgaactgggttggatttactggtctgggattcactagcataggatccaaagtcttccctgattacttttattctgtggcattcagtgaccatttgcctatccttgcaaagctaccatgagtttaccatgaccaggttgtgtgcaacaagagcaaaatggagcagcacaagcaaaagtcagcacagcattgtggaacaccagttgtagggagcctctcagcctgctccctccctcagctggctcaggttacacctggccaggcaatttcagaaatgggtagggaagaaatccaagagcagggagtggagaacaagagccaggcagagcaagggtcggggccaggcaggcacagtttgcaggccagagaacattctctgagagcgcaagaatctgtgcctcctgggaaaggctgtaatccattttccctgaagacccgagtaacccggtcaaagaaactcaatcccaagtggttttgacataaggtcatgaaccgagacaaggcaatctcagcagttcatcccacacaacaagcaggcctgcaggcagggggactggagcggagagggcaggggtagcatctcagggccctggttgcagggggagggagttggagcccttcctagccagacaggtgattcatgtggacactctcacccttctgagcaccagagatcacaccagggtctgaccctctggcagccccatctgctcactaaaggggaaactgaggcagaaaagagcgcaatactgcccagaacccagagtgtcgaggaaaggaggtgatatcagtatgtgctcacttgctttggacacttgagagcgctaagctgggggagggtcagcttctccagcctcctggcttcctccctccctgctttccctctccttccccagggctgggagccaagggatgcctcagctgcaggactctccctccccaccccctgcagaatgagcgtttccacaacttgcacatctttacctcctgtgtttaccggaaaacaggaaggaaggagggaagaggaagtcttttcagagcctctggtgatcatcacgcactttgctttttttttttttttttttttttaattcttctcccccactccaatctcatctgtcccctgaagggagaaatcgaacccatctgtagttgttacacaggcaaaatcacagatgctgctgtggtctagccagggtcggaggggctctgttctgtggtgtatatgtaggtatgtgtgtgcgcgggtctctgcctgtgtgtttctgaagctggtctttaacaagtgtggactctctgttgaattctgcattttctcctgcagccagcaggtggcagtgctgcgacagtcgggtgactccagtcctgtgacgcctggccccgcagcgcttgtcaggactggtccaaccgtggaagggaaggcatgtccacacgcaccccaaggtggcccacatagaggtcctgggcaaggcgatatggaggagagccatccaaaggcccttctgaaacctcctctcctctcttccattcttctctatttcccctaatctaatctagaaagggggaaacctactaacgtttcctaagcacatgcagcatggttttcagacttagcataaaacccctgcagagcttgtgaaaatgcagcttcccaggccctgtccactgagactctcacgcagcatggctgaggtggagcccaggaacgtgcattttgagtaagtgctactggtgattcccatgcagtccccagggaactccaaattgagaaatagaaaactagcatattccaggtgctgtgatgagggcttcatcctagatctgttctcagggttccttgtaaattataattctctccacctgtttcctactctaggtctgttctcagggttccttgtaaattataattctctccacctgtttcctactctagatctgttctcagggttccttgtaatttataattctctccacctgtttcctactctccaaacacattgccgctgcactcctctaccatgaagttttggctctgcattcttaacggacaattttgctgtttccttatgctaatttcctggtgctctgagatcaccggacttcctgctccagaagcaggttttctcacactgcctccctgtcatcctaacctttcttttattccgtgtaagttcctgaaatgcacagtgccttaccctgccttcccagccatggggctttgctggagccgtgcacggcagtaccatgcttccccacctctcctatgctctccacttgcttccttcccagtcaaagggctctgctggagttctgcagggcagtgccatgcttccccacctctcccatgttctccacccctgccttctcagacacctgagttggactgccctggtgaacatctccacagtcaagcaacctggagctgcacctacagacatgtgcagaggacaggcatctcccttgaaagtcagcatgacacaagacctacccacagtggtcatactgggcgcttttaagatggcaacacaaacaaactctgaaaacccagtgtattcatttgccgggggtgccataacaggtgaccacaaactgggtgtcataaaacaacagaaatgtattctgtcacagctctggagattagaagtctggaatcaaggggccggtagggctgaatccttcattgcctcttcccacctccagtgactgctggcagtgcttgctgttccttggcttgtggcagcatcactccaatctctgcctttgtcttcacatggcccgggtctctctgtctaaatttcccattcttttctctcatgaagtcaccagtcactggattaaagcccatccttcatcctaacttgattagatctccaaagaccctatttacaaaaaggtcacatgcacaagtatcagaagttgggacttcagctttccctttggggagatacagttcaacctgcaacaccccacgaaccaaagattctgctttcacttcttacctcctgcctggagagaggagagcagagtctccgtgcttctccaagcactgaatgacctttcccatgaataaagcttttgctcttggtggatgccatattggaagaggttaaagcaagtcagctttgggcttccctgagtgcagtggttctcagagtttgggctcctgaccagcagcatccgggaacttgttagaaatgccaaatctctagccttgcgcagacctacagaatcagaaactccagggctgaagccagcaatctgtatttaataagttctacaggtggtctggatgcatcctaaattttgagaatgactgctcccgcggcagggctcacaagggcatccccagcaagttccagccactgactatgtcgtttgttgccccaaatctccctgtttttctgccctccggttcctggcaatcccttgccagctgcccttccttgacggctgtcagatgcctggcacatcacctggctccacactcaccggccagcttcccagcactgtttttctccggctgcctctcctcacctggctctccgtccgccaccccctcgcgcttacttgcatgccctcacttccctctgactctttctcctgacaaagagaagagcttggcaggggttggttaagttaactctgatcacacagaaaacaaactgttatttttctgtctgccaagctgctgaaggcaaggatgtcaagcccaggatgtgtgtgaatgtaagatctacagttaccctagcgtgtctgtgttctaggcaagctttttttttttttttaaatcgtggtccagttcccagggagataccagtgacaacctcttggatgctcattgcgctggctgtgacagtctctgtacacattccctgacccagggaatgagcaactcccataaacagcagacggtgggtcacctctgacatctgctgtccacatttctgatcccctggaaggccttgttcaaagcaacactgggctgaaatgttggtgcaccatgtgtgtttgccgtgtcggtgcacataagcagacagacctgcaggaggcagacagccaggcaggagggagccccgggggacacgtggacacatgttagagtctggtgaacattcaagacaaggttttaaagatgtgtctgtggttgagggtggggaggggcaaaaaggaggccctttggagagggccaaggtgcatatattggggagcctgtatgcgggtggccaccctcccaggagagtttcaagtttctggggaggagggaagcctgggtggggcggagggggcataggaagtcctaaactccacccccagaagaaggtagaaattagcagagtatctgggcaagctacaacccagtttccgtgccttttttgtcccaatcaccaaattgggcacaattatagtagaatagcagtgagaaaaaaacaaacagtaaaaataaacatggtaagtgaaaaggttggaaaaggaatgtgccagagaaatctggaaatctttgcatgcaggcactcgggtctgagacacactttccattgggtctggaaaccaggtagaccaaggctagagttcaatttccctaaaagggcttttttttttttttttttaacagagtctcactctgtcactcaggctggagtgcaatggtgcaaactcggctcactgcagtctctgctcttgggttcaagcgattcttgtgcctctgcctcccaagtagctgagattacaggcatgtgccaccatgtctggctaattttttgtatttttggtagagacagggtttcaccatgctagccaggctggtcttgaactcctggcctcaagtgatccacccgcctcggcctcccaaagtgctgggattacaggcgtgagccaccgtgcctggccagaagggttgcctttttcatttctgtctcctagatgtcacatcaggttttaagaggctgtggctccattctttatcccacacagcaagaaggtagcatggctaaacatcctggtgcaatttcaacctctcaggaccattctctagtttcaaaccccaaaaagcacctggccacataggtgagttgctccgtcactatcactcatttagttggagacactcatctcctcttaagcacctcccgtgctgtatgtatttttaaactattgtgacttattttgctttggaaatttaggagatcattgggtcactctttgaaacaaccagagatgctcaggaagaaagggatgtcacaaaaccaggtttggataccactgttctggggttcggcttcctgtgacttaagagatctgttcagattttaaacaggacagctgatccactatctcactgggtcccctctaggcaatataagccagagaggccttaacatcagaaatacaagggttggggaggggtggtgcacatttgtatcagtgtattctcctttagcacagatgaaatacactgggtgacataatggaaattcacagagggaaaagatccgttgggggagagactcataactcaggtgaccactgaactgtgatccccacgagttcaccttgtccagcctgtcttcccttttgccctctccccaccaccaggccttaaatcacctgtacatgtgcattgctgggtgccagcagatgattcatgaaactcaacagacagatgccctggtgggcacaggaaaccgaaggattgagagacatgggtgtgttgaagtgctagcagtaacagccatgaggctacacagtccattaggttttcattttacaaagtagagtgtacttgcatcatctcatctaatccttcgagtgatctgaggagttaggcattattacctccaaagcctaagagaaagtggtaaaagcaaagccttcaacaacaaaaccccaacccaggaggcctgacctgggtccacctaaaatctctcaggacaattctaggcactctccctccaaaataggtctgctagatcttcctcctgctccacggctctgctgtgcaaggtgtcaccatgccagggagtcttctgacacgactctcccaggccatgggtgaatgttccacttccaggccactataatgtcgactgtccttagactatagccatgcttctgggttctgcaaaacaatctgaacccaagattgagaaacctgtgatataatatacagatctgtcatgtggaggagacttgcaggtttgatttttctcactgtttaaatatctgggtggctgcaggaaagatacaccaccctctgtgcctcagcttcctcgtctggaagtgagggcctcatatctctgtggtttctccaagcagaaatgatgcaattctacatgaggtgcaaactaatttggctacaaatcatcacaaaataggcctaaggatggagatggtcctggaccataccgagctaggcagggatcatcagagacaggcgaacaatgggtaaggagggccctggagcaatttatcctatttacaaaaattaggctctatctaaaaacttagcagagaactgcagacaaggatgttgaccagtgaacccaaaaccggatgccaagatccttccaagaaagtgaagggaatgaatgagaagggaagaggaagagaaagcagacaggagtgaagggagaatgggagaggaaaaaagagaaaaatttaaaagatctgccggtttgacactcacatgaaaatgtcccagcagatttgcatttcctagtaataaatattttgtgtttacttattgtgacagagtttgcatgtcatgtaatcactgtttcagttcattttccccccaatgatagattgtgataagttggttgttaataatgctacaatttacctaacaaattttgagcttgtaatacagcttcattaatatgtttaatttatcgttacagttccttcaggttaatggtttgagagtatgttggagtttaatctgaatggctattataaagtgcttgtttctcgttaaaatgtaaaactgagatacccaagatttatttgggataaaccagccagaataaatctccctcttctttgcattgggaagggaatgagggtcggctattaaaaaggctaagcattggagagccccttcaggtaagtttaaagtaattttgcagattaaacatcctttccctagggtgaatgggagcgatgcctgaggccagagtttagcctagaaggattctctggatgctgcagaaaggtagggacatcagaaatggggtgataactgaatttcgacaaaatacagtataagcattgcaggtgactggaaaggtatctgagtgttgggtgatgggttatagaaagcagaatccacaaagattaaaatcaagaacacaagccccctgaaaagcacaaaacagaggagagcagcctcctcttctccagatggaattttggcagcatcctctggctgacaaactttcacaacactcctgtaacgcatcagacacctgcccccacctgccttcacctccgggctcctcatactggtttattcttctgggtaacttttagcttagttcagaaaaagaaagaaaccctcattctgtggctcaaattttaccacccaactgttcaagtggcttctagggtgcctaacagtttctctggacctggggtgtgaacgaggttgcctcagagcattgaagaagcttctggatacggggccatctacatttagtgagtttgttgatagctgaaaagcaagagtagaattcttgccatttgaataatcagggcccctctggacaagtctctagcacccaagggcatctcagaaaaacagttgttatgggttgaactgtgtcccctgaatagatatgctgagatcctaagccccagtacctgtgaatgtgactttacttggaaatagaatatttgcagaaataatcaagataagaggaattgattagggtggagtctacaccatattactggtgtccttaaaagaagaggaaaatgccatgtggccgatggaggcagacactggagcaatgaagctgccaggcaaggatggctggccactaccagcacaaaggagaggcaaggaagggttctacacagagcctcaaggagtgtggccctgctgacaccttaatttcagacttctagcctccaggactgtgagagaataaactcctaatgccccaggccacccagtttacagtgttttattacagcagccctaggaaactgacacacgtaagcccagtgggtcactcttggcactacagggagacgtgtaaaggcaagggtgggcatggatcttacagcaggcagcggattccaacacagctgaaagccaggacacagtagcccttcctacccactgtccagaccttgtatgatccttaatcctacgtgtcaacctgactgggctgcagggtgcccagacagctggctaaactttattctgagtgcacctgtgaaggtctttcagatgaaatgcatgtttgagtggttggagtagtgcatcagactgccttcccagtgagggggggtctctaccaatctactgagggcccgaatagaacaaaaaggtggaggaagggagaattccctgtctctgcctgcctgtcttccagtagggacattggtcttcttctgcctttgaacttggactcaggctggaactcacaccattgacctccctggctcctcaccttgccaactccagatgagggaacttcccagcctccatagtcctatgagacaattctttacaacaaacctctttatgtatgtaaataaatgaacacacacatacacaccatcctactgttcctgggttttggtagaatccatgtggaatcagatgctctgatgccctcgaatggtggcccttggtgctcccgtggcctgcatggtctggccccctctctgtcctactcttgcccctgctcatttcccgtccttccccttgccttcccactgtgcctcctctgccagcccctgcatcagggctgctctgcccgcttggatgctctctcggagaacctcacaaggctggccctcgcttcccgcggccttgcacccccatggcatcttggagaggcttccctgactccgagtgctgatggttcccattcctctaacacatctctgtgccctcacccagtgttatctttttttatataacacaacctgaagttatagctgtttatttagtgtgtgtttcccccatagaaactagaaactccctaaaggcaggaatcatgtctgtttcactccccacagtgtctgtgcccagtgcctggctcagagctggtactcagtaagtgttgtggcaggaagggaatggggaaaggaagagggagggagggagggaagaaagggagagagggaagaaggaaaggagaaacagtgagaaaggaaggaagcgaaggagggagggaaggaagaaaaagagggaagagaggaaggaagaaaagagggagggagagaagaaaggagggagggagagaagaaaggagggagggtaggaagaaaggagggagaaagaaatgtggaaggaaaaggagagagtgagagatgggaaaggaaagagggagaaaaggaaggcaaaaaaaaaagaaaaaagaaagggagggagggaaggtgggcagctttgcaaccccaggctctaagtgcaccattcaaagatggtcccttgggtctgctcatgcctggagcatcccataatttgacatttccaggggtaggttgcaatctaagggtcagaagtactgagaaataagttagtcatgaaaattaagattaaatatatagattttttaagataaacttttacttgaaggttcagggaaggtcataattgcttattataaaatcatataacatatggagtctcccattctcacccctacccacaaaccttctgaagtggcaggttcttccagaataagatccatatataacttgtctgcctggaaagctaggtcctctctgactgaatttcatttgtcacccttataacaccaaggtcggacacccatgcaaaatatgcatcaaggttctgctatgccctgggttctcggacacagaggtgaacactgtgtgaggaaggtcacatctggatcccgcatgatttattcatcaaagtataccaaattgaaatcctctcataaaattattcatatgtgagttaacaaatctctaaaacagagcagagcacacggtccattgtgccctgtgtatgaagaagggacacaaagccagtctcagcagcagagagattttcagcaagtcctccctccaccagcctcctcccccatcactggatgaggagaaggttccagtccttcccactggtccctgagaacagggagagccgccctgtgtggggacacaggtgagctcctctgcatatctagaaggaaaccagcggcagggtgcaaagagaacttccagtccccatggaaagggtggccggatggacagagcgctgcctttgaactctcttcctcgttccgctctggcagcccattttcctttaggcgtctgaccctgctaatggggactgagtttccacgttaagtgaaggggtcactgggtcgggcgggcgctggcttctcttcctcctgacagatccataattagaaggagacagagcattcaaagaggagtgttggctccaggcacatcctcgtcagcctgtcaagcagaagcctgttctccatgagctattttgagccaccttctcagctgcatttctgatcttctcggcctgtgtcaccctcccccaccccatggtcttcctcccaccatgtctctgctgtgacatcactgaggcacatgggcttggcggagggctggacaaaaagggcattctgtgcaagatgcctggggctaataggagcgggggggcctcctgcccctgccccacacctccaccacctctgttccagtggaatcagatgtaagaatcagagggcctgggctgttgactctgggagcaattatgaccagggccatgaggttcaacagattcctcgccttggagaaataaagggtaatcactccttagagaggacgtcatggtggcgaaactggaatgcagagcaggagagcatgggcttggtctctgcccaggagctgccctgtaggatttccaggcccgggcaaaccaggtgggatcataaggacctatgcacactccaggagtccccagtgctctactgatcactccctctgcaccgcaggtgctctacaagcatgatttcctgtcctgctcatggcaactctgagagggagagaccattgcatatgaggagggggtgtcttctcaagactcagccaccaaggatgtcccatctggcctcaggttcacaaggtctgggttcctggggaagctgggtttgcttgatctgaggctgtggttctcaaagcgtggttctggcacatcgacatcactttttcaaaatccagattctcggactccctccagacctactggatcagaccctctaagggtggagctcaaccgtctgtgcttcaaggagcactgcaggtgatgtggatgcacccctaagtttgggaactgctgcccaaaggacacctttttgtcggcccataacataaatctctaggacaagtccaaatgcccccactccatgccttcctgtaggtggaatctgtctcttgaatccagctccagccttacccttttagcactcaccccaggctgttctggggtctccccatcatttttgggaatgctcgccctctccctgtctctggttcttggaatgaatttttatatctttatgtgtgtgtttccctcattttacaagaagagagtgagtgcctcctgtttgtgccccccaggactctgcccaagggtgctcagccctgtgcctgccagggccccaggggtccagtggttgtcacacactgcctgtgcagaaaccagggagaattgattaagcaccagccttaattgtggctgcactgcctgagagctggcagccaattccagctgcttttcctcatctgcatcatgggcctccagctcctttggatttttttaaattatcaaaataataactcacaagtcctttgcaccagccattctgaagggatagaagaacaaagaggaaacaaacgggttgactccttgtctctgggggccctcaggaaatctggtgatactgatgattcgtggggccccaaaaagaaatgaaggctcccaggttcttgtcctgctgccactgaatctttatctggtgacctaggcctggtcattctgagtcccatgatgaagatcttctggttacataatagggaggattctacattaggcaacaggtattttttgagcttagagaagccaggtgctgtcctgagcaccacgtaccctgtctaagagaccttaactctttagaagcgtgctctccgttgtgtgttgagagctggctgaaatccagaaagtgccacggacatgcaggaggcaaggggaggagcacagggcagatttccctgggctgatttttagggaatgagtgggcattgtgaagacggaagagagagggaacagactagtataaggcacagccagtgcagagccaccgaggtgggaaggacctggattgtttgggggcagtgaggtgctcaatttggctggagctgagtagggacatggtgggaagaaggtgaagctggagggagagtccctcgcagtgctggccaccttacatcaggagacctctgggacaccagcagtgacctaatcaattgctcacagtggcagagtaaccatcagaatcaggatttcaagcctttccagtaatcactgagtaaaatataacccgctcaccagtgagtgatccagaagggacagaaacagagaaagggcggaaaaggtcctcaagccttaaaaataaaacttgtcttctgtcctgtaggagtcctgagtacttctttaccgcacactttaaaatgtgaaaatgtaaagaagttggctaagccagggcattgcactggggatcctgcccaggccccaactgtgtctgcatctggctgtaggaggggagtggcccaaatgggaactcttagggaaatgacatggctggtcaatggctgagtgtcccagctgtgctatgggtctgatcttgaatctactggaatcacaaggatggacatgtccaaggtcacagacagcaccactgaccctggcagccacctggtgaatgtgaccctgtgcaccatgtatccctacttatcacaaaagcaacatctgtcataaggggttacaggtgctgcttacaaacataataaatatgtttttctaaataaagaaggctgaccaagggcaggaacaaagcaaagttactccttttactataacctccctggtcacctttgacttccaagcctgccagtcatttttcaaggttcaaggctccattcgtgtcaagacagagtagagagtgagggtgggatgggacagtggggaggggccgctcaaccctggcagtagcaacaactccttggccatgttaatgagcagctttgttctgcatcacctagctgtataataacagcaggaattaatacaaccacaaattaatagcacagaagagcaatcaggaggcagagatacattcctaatgggctcagctgagagcaggaggaagatggatatgggagcatctccctgccttggcccctgaaccttgccagctggggctggcagaggggctgaaacaccgctgcacacagcctcacctttgccaaggacagagggtttggctctgccaagggtaatcagggcctgcagcctgtgctgcaacctccacctgctcttcccagtcagagccactggcccaggaaggagcaagacacacagctctgctgctcagggacctggggcatcaggtctgagtcttgcccatgtcactccccagggaaggtgacagcatctctctcaattgctttcctccagatcctgtggttatagggagtggtcaggagcaattttctattaggtccaagtgaacagctcactcagccattgcatgtaataataacctcaaagtgcacagtatttttcttataataattataatggtggctattgctctcgggctttccttccaggccacctctccaggggtcccaaagcaccagccctctgtctcacctgtcccaagcactatggttgaaagaggtgataggcagaaccagtgtgccctgtgaggtacagggcgggttctataggatggggattcttggtcccatcctccccatcctacagccactgctgtggctagagacattaatgcatctgtgagaaagtggaaggggcccttgagtgttgagatctgggtcctagaccctgctcagataaggcatctggacaaccttggacaaggcactgaactttcatggacaatgtgtatatcatctatgtaaaatgcaagctctgaatacacgacttctaaactcccttcaaacactcacatttcattaacaataaagtcattgttcactaagagaacattctgaagccatctggaattctgcctctttcctctgccttcttgtacctgtgaagggagtggaaggaacccatggtgcccacgtcgagtgtggaaagaagcctgagatgtttaggccacggaatggacatcatttcagttgaaactttgggcaatgcactaccagggtcacagccttttcctatagtgtttctgggacctgtccgctctgaaatcagtgtgcttcttctcccccactgtccttttgtgactactggtcttcatggctatgtttggaagcaagaacatctctatcaggtcttgtttaacttgagccttgtcccggctggctgagatggtgcgagctagggaagccagtgggaagggcgggaatcatctatgggaagttggccaaaatcttactaaggaactgggattcctaaatccctcactgggagaatttattccagtattattccatgggctgggcgtggtggctcatgcctataatctcagcattttgggaggccaaggcgggaggactgcttgaggccagcagttcaagaccagcctgggcaacatagtgagaccccatttctaaaaaaaaaaaaatacaaaactaaacttagctgggtgtggtgggcgagggcctgtagtcccagctactcaggaggctgcagtagaaggatcatttgagcccaggagttggaggctgcagtgagctgtgatcatgccactgtactccaacatgggtgacagagtaagcccctgtctcaaaaaaagaaaaaaaaaaaaaaggacaggacatccatgtttatagacaacagaagtaaaagttccacttatctatgacatgaattctgatattttcccttctttctcactctctctcttactctttcttgctctctctcactcactcactctaaaataaaatgctgtttacaacccactaaactgctttcatgacacattaatgggtctcaccctgcaatttaaaagtcactgggtgagatgcactccaaaggacattcctggtttctgatgctgtggtcggaaactaggatagcagctctctgactccctgactcctccccatcaacttgttgccctgcagcggccatccctgtgtgtggctagtggggaatttgtgggaaggggtctccacaactggggcttgttgagggactcccacccaatgacaatttggcacaggtatgcagagtaataatgggctctcccagctcccctccatgctgcacctactcccagctctgagctggagctcccgtgcatcttcagccaggaagaggaagagggaggtggggaggtgggaaggtagcaacaagcaccaggcaaccatgagtaatctaggccagtgccagtgccaggggaggtgtgatgggaggcacctgggcctcctcccctgactcctgctgctgctgacagccccactgggagctgcaatggtgctcttaattgtgcctgctcctcagctgctggagggacacggccactgtggggtgcaatccaggaggtgtctgggtttggaggggtgcttctaccagagggcagggctgccaaaagatgagaggcaaggcttggggcaccccaagagacagtcctgagaaagagacatcattccccttcagtgaggaaaatcagctccgggccccacttcccaagggtcctgtggggataagacacttccaaagctttgtcataggccttgtcttataaacactgccagcaacgcttttgagcgggagggactcattccaaccaccagccctgctgattttttctctctcttctttctacacaggaaaacttaccttcctctccggggtcctggaagacctacttctccatgtttataaggtcctttgaacaaagcagcattttgtacacatatttagctgctgttgttatgcttattaaatgtgtttaataattgtgatgattttataacatctgtaacttctttgttttacattatatgtaatctccttaatggaactctgtagcccagtgtaaaacacggaagctgtagggagggggaaatagtcatatttttgcacagagaagtctcatgattatattcaaacagaggtgtctcctggtgctttataagatttcagatttcttttcttttctttctttctttctttttttttttttttttttttttgagatagggtctcactttgtttcctaggctggagtgcagtggcccagtcgcagctcactgcagcctcaacctcccaggctcagatgatcctcctgccatagcctcccaagtagctgggaccacaggcatgcaccaccacacccagctaatttttttattttttgtagagacggtgtctcactatgttgcccaggctggtctcaaactcctggccccaagagaccttccctcctcatcctcccaaagtgctggaattacaggtgcccagcttacaggtgcccagctgagacatttttcttactctagagagagacactgcagattctgtggtgattgcaaacaatgaggaagtcacaattcagggcctgcaaatgatatctgggccagaatcaggacggaacttcatgggttaaacaacaagggggaatggcggcccctaaagcccttctcccattcatgtggataatagttgtactagacatgaaacgctcttccttatatttctaccaacctgccctcaggcaccacaccacctagtgcccagaacatcggcattgaatggcgccataacaaaagactctccccagggtctaatcataagatgatcaaacactttcattcaaaatgcaggactgtaagttgcttttgctgttctttcaattacccagaatgtcagcatatctacattgacaggttaatatttggatgatgactctaagctctgtgaaaatcctgactgctttcaaataattttttaaaaatttatatttggcataactgtattgtgaagtcaaacttgatactccttaatcttttgactatttatcacccttgtacaaaatatattgtttgtgtttcaccaaaatctattgtttagtgactcccaagactttattctctaagcacagtcttcatagctgagcagttttgtacagcaaccttcacagggctcgtgagccatatcagaaattaggattctagggaggatgaacaatatgaacattttgattctggagggaggacactaaataaacagcatctcttttctgtaataaggggcatgatttaatgactgctaaaatctattctataatgctatgactcagaagcctctgttctctgccagaggttgtttgttcccaagtcctacctcctcttcccactgccccaaatcactagagttcattctccttcaatgagttagccttgtttgctaattttcaagtattttcattctggggctccctgggccaaaatagaacacccccacccccggcaccggcctttttagctttaaagctcaaggtcatcctatattaaattgatgcgttctgacattatccatgaaatgacgagtttctactcaggaaacaaagacatcattgtttgttcttattcaaaccatcaacgaatatgagttcatggcatctccatgctcctagagctcttcgaagacaggaaaaggcaaggagacttccagaaaacacattaccaaagatgagagactggctcaatgaagaactaaagctaacccatgcacctggatctgcaggtctgtcctctgtgttgccaccttgtctcaagacctttttcccattctaggagggaagtgggggcctgctggtggtctcccccaaccagcatgtgccatttggcaagaccaccagagttgctgggctactgtctgctgagaatgaaggaaccatcagtagagagatgaacagcctcccagtctgggaaagaagttgccagaacttagaggaatgatagcagagctgacatattctctgtcatctgcttgccctaccatggatggcaagattcaaggccccagctgagaagaataacaaggaaagccatgttcttatggaaatagcttctgctctctaagtattctagtccacaccaactctgtttctggagttaagatttaattagcttcattagtagtataaataagaatgttaatggctctgcttcattcacagtgactgatggcttaactcccattgagctaatgggttttagtcacatcccgaatcaaggtgctgagcatctgatccaggcaacacacatctttgtcctggtttttccagagtagtctttccaaagttttcacattgtatatcctgatatgggggttcagaaattatgggtactattatgtgcatccataacctcttcctacttggtacttagcctgatctcaaaaccccacctgctttgcctttctctctcctctagagatattccagaacagaagagttttcctaggcaacaaaagagatggggaaggagcacttattgagcatctactatgtgctaggtgcttggttccagaacctcagagggtggccaccaccaccccccactctatacacaaagaagctaaggtcagagacaagggagcgaatcactagcaaagctgggatttgaacacagaacattcaggctgcaaagctctcttcaccaaaacatcttgcttttcagcaaaaacacttgagcaactggttgctttctcattgttctgtgaatgttcctctgatgcccttgaccaaaatacacactccatgagggtagcagccaagcctctgctgactaattaactcctatagttaaaagccaattcaaacagccactctgcttctgcgtggactttgtttcctaccacttctagcttcctgctctgttcactcccatcacacccaggaaatctggaacttggagccaacaaaagctgcctctctcaatccactttgctgttgtaataacaaaccataaaattaactaaatttcaccgcggtgtaatgtgctgcataaaagcggtggcaatgtgtccgcagggcaaaggaacattccactgaaatcagtttctctttattgcattgccaacattcaataatttctcccccataaaggcagggagaatggcatgagccaaaatagaatggacacttgcaaacgtgctgtagatacctgtgcatgtgtgcagctatgtgcaaataaaaactggcaagtcacatgcacatgcatgttcatacacacttcccatgtccacacatgtcccctggctgtggaagcacatcaaattgtgcacatgaatactcagatgcatgcacagaaatacatggctaaaacagcgcacatatacctgtgttgtgcacattcatacttgttcaacacaggtgtgcaaatgggaagtcatatggagaaggttgtgctttattgtctttcgtataaatgccaccagtaaagccctcctggaattccgcagtcaactacaccctagttgcagcacattaagcccatttctaagaaacaacgtttacaaactagatgttaaatgctggaacattctcttcctattgctgagaaaagacagccaaggtagcttcagtagttttggcaggcttggctttgtccaaaatgacacaaccagaccatgttcaaaaaaagagcagggcataatgagcttaagggagtatgaggctctccttgtaacatatttccaggctgggtaaaatgtgccttgctcactcaagggtcttttcttgaacttttggagaaaacagaaagccactcccagtagctgggtgagtcacagactaatgggatttgcctttgcccagcccagttatggaagaacaaggaagttctgctgactgtctgctctaagtttttcctggggcaaatttaggttcatcttctcttgtggtggggaaggcagttgctgtcacactctcatatctacactgtagagcgctgttatatactcactctcaacttgggcaaggtcctctctgaaattcactatgactttcatcctctatgaaactcatattctcagatgcatactgtgctgagggtatgctcttaaaatttccaatttctgaaaggaccgcaggatggaaggctattttgtgtcttgtaaaaagcactggatcaggaatcaggagaactgggtccacactagttctgccaccggcacaggagccgtgaacagactcaaattcctctcggcctctaaatgcgtagatgaaactttagtgtgtcagtgagctcccccaaacttatgactccaaaatgttttaaaatccactgatgaaaggcaaatgccaatcttgcttttatgaaaaacagcacacaaaaaagaatacctctgacgttgtcaaagccagccaactattaagtctagatgtaatatgatgtcagtaaaaatgagttgttccacactttcaggacaaattgtctcaaaaatgctgccagtgcagtaattactcagatatttacacagtgattaacattttcacccttcaaatcatatgaggatgttctatagacagccagatatcttctaatctagcctggaatgtcttgtagaagagtcacaatgctcaacattcaataaataattacttagtgaccacattataaatatcaggaggtggatggtggtctgtggggatgcagcactgaataaaagacaggacctgccctcaaataataactgtgggaactgacaaccccaaccacccacttccctcgtcaggtacccatcctctggacaggaaaatggttcttgtcttctccaggaagacaaatttctgggctgcagcagtatcctaaagttatggaggaagtatggctcaactcactgctggcgagatgacacagaccacctagcactgttttccatgacaattcctttcaggaaactgtgatgactgaagaggaggaatggaagcccatggacccatccaagatgagatgcagcttcttccagaatggcaaggagtctgagaaagagaaggtccccacaaggtctcttctggctcaagtgattattccgctagtaaattacagggtaaatggcattcttgccatttcacagaccacacaaactgagactccgcaaaacataatgattaacatctgcaatcacagaacctttgagccaggctaaatgttagagatttttctacctacctctcattttgtaagtaacaacacctatgccagagatgtgacttggcctatactgcctcatcccccatctaatgtttcttaccacaccaggccagtaaagactacatgaaagtttatctctggaaataaatcttgcaacttaaatttaacaccagttctcagtcacatattctacagagcagttttccaaattttatcacatgaaaagatttgttttaataaaatcattgaactagagattccttccatttctccttgccaagatatttactgtgtacctaccatatgcaaggcatcaataaaaaagggaaaagagtgttccattttgtgaaaagtagcaattatgaatgcattttctcctatgtaaatacatgaataaaccttaatataacctctctccccctgttctctccttgccccaccctggatacaataattgtaaatgtttaggcctgaattttccatctttttaggttaggatggaatattcaggggcccccacacttagtttaggtgccgagtgacctagcatgcctgtattcaggacttattatgattagattatagaatatttgattttaactggaagtttctttataaaaaggcctctaagggttcttatgtaaaaggacctagcacagaagctgaacctaataatgaagatatttttaaccaaagacactgtaatctacacacacagcatataaaacaatatagatccagactgaaaatactcactcagcatccctgcctagctagccatagcagggaaatgggtatattgtagaattatgggcccaacagatctcattattttttacattctctaggtctcattcacaatctttgcttttgaccagtccctgagggagtctgtggcagttgagacagagactcagtggat[450 bp omitted]aaagagcacaagagaattgggaaattggaaacaataaagaacctctctctgcagcattatccatcctgcaagtccagttttctgcctaggttgtttctcatgcccaggctagagtgcagtgatgtgatctcagctcactgcaacctctgcctcctaggttcaagagattcttgtgcctcagtctcctgagtagctgggattacagacatgtgccaccacgcctggctaatttttgtatttttattagagacggggtttcaccatgttggccaggctggtcttgaactcaacatcctcaggtgatctgcctgcctcagcctcccaaagtgctatgattacaggcatgagtcaccacacttggcctcttcctaggttcttaactcatcctgcagaacccatagcagctatgcacagacagaaccagtcttggaggaagctgtagaacatttcgaggggcatgaggtttagaactgacccctatccaggccctacccctgaatgactgctaagagttggggagactcataacctccatcagaactgaattctatctgaggataattgggcatttacttactaacactgaacaagttactagaatggcacagaaacaatagcaacatgaagggttttctccaacccttgggttttgcagcctttaacacaccatattttatctaatctaaggcaccaattgtacagcacactataattttatgtactactaagaaagaaaaaaaggccggcaattaactatgacaatacattgattgtaagaagcattcaatttcagagatgttagattgtgagggaaaaatgtgtcttagaattgctaatatatagtaaaatctcaatcccttacaatggcattaaagcccttcccagaatggccccaaccaatgtttccagccccatatcctgccttcctgcatggaccagagcttcagcctgattctccttggtcagcacactcacaccttctaattctgggcctgggctgatgtggtctctcttgcctgggaggtagctatttggccccagcccccctagcctgcctgggctggtcctcacattccatttcttcctcatcatggcccttaccctgtccctttacagcacagttctgagtattttagggttgagttctttctctagattataaattccctgaggaagataaaacaatagttaacatgtgttgagtatttactgaatgacagttacataagtgtaaaccacatagatttcatatgcaagagggtgctattatctaatgagaaaaataagatatagacagcaactttaccaaattcatacaggctagtgacttagtcaaaatgggattccaacatgcttttgggtgacaccactgccccatttttaaccatttaaaatgatcttaatggtctaagcactggcatcaagggaggcagggggtgacattaaccaagcaatccatcatggattttcctctggcatcaatctggcttcaaggagaccacctaagccagctctgtctcttactattcttccttcccacaacatcagaaaaagcatttcctgctgttagggaatttatgattataaataaaaataaagcctgtaagacattactaaaaagtaaagaaaaaggcaactagataaaaaaaataaagttggataaaggtatgaataacaatgctgataataacaagagaattcactaaccatagtaatatgcttagtccaataaaggttctgtgaatataatgagttacaaacagattcatcttggctataaaataagaagcttctgtgattgttattgttgttattataaattaagctgggcttaaaatatcacgctgtagacaagggtgtgttttaataaacctgaaagcacaaccccaagcaagaattctgcctcttgtttctctatctcaaagatgtttctaggcacaggtgagaggccagcaatcctctgaccactgcaagctggcttaaggagaagggagctgactaagactccctgggccactatatgttttccctcagaagatatttacacgaggccaggcatggtggctcacgcctataatcccagcacttagggaggctgaggtgggtagatcacctgaggtcaggagttcgagaccaacctggccaacatggcgaaatcccatctctactaaaactacaaaaattagccaggcatggtgctgggcacctgtaatcccagctactcaggtggctgaggagggagaatcgtttgaatccgggaggtggaggttgcagtgagccaagattgcaccactgtactccagtctgggcaacagagtgagactctgcctcaaaaaaaaaaaaaaagaaaaaaaaaattaaaaaagaagatatttacacaagggatgggggatactggcatctggcagaagtccctttccaagatcaaaccctaggaaaaagtaagaagtgtctaaagttctagtactgaagatcaattcaacagttaagattttttttttttaaggttaggaaaacccactacaaaaggaagaaggaagctactttgaaataatacaaattagactgggtgagatccttccatggaaaatcttcttttaacaattttaaattgcagtaaaatattcctaacataaaattgaccatcttaatcatttttaaatgtgtggccgagcagtgttaagaacattcacattgttgtgcaaccatcaccaccatccattcatccatggaactcatttcatcttgcaaaactgaaactctacactcattaaataactgctcccctttcccctcccacaaggtcctggcaatcaccattctagtttctgtctggaaagtctttttccaatggagcatttcataatcagtgttgcactgttctttcaggaggccttctgaaatttgtgtcctttgaaaagagaagaaccatccttccagagccccctggcttaaagtcacaagtgggaaactgaggctcagaagagagtaagatttggcttcccttagaacactcaatgtggctgggcacagtgcctcacgcctgtaaatccagcactttgagaggccaaggcgggcagatcacttgaggtcaggagtttgagaccagcctggccaacatggtgaaatcccatctctacagaatacaaaacttagctgggcatggtggtgcacacctataatcccagctacttgggaggctgaggcatgagaattgcttgaacccggaaggtggaggtttcagtgagctgagatcatgttacttcactccagcctaggtgacagagtgaggctgtctcaaaaaaaataagtaaataattaagtgcacaagcaggtactacctctctgagagcaaacacttagtttagagcaaacacttagtttagacacatcattgccaccccacactcaccacgcctgcccataatgcccctagtacccaatggccaacttgaattactgtgtcttatcaggatgacaccagtgcagttgtttcctgcatgtagaacaggttaaatgccttctggaaagcaccagtcctttcattaatgagctcaccttgactgtccacagcacagaaggggtgccatgacagccctatgtcaagacatggattttttttttctttcccttagcccttggggtggcagtcgcctgccactgtgtgcaacctcaatgtgccccacagatattatcattttctacatgtgctacgatatgattaaggactactgaaatttggattttcttttttcacaagacaaaaaaacagaaaaactttgagctccccagaggcaagggagggaccagtgcaatggagggctaccttagggtctttacccctgcagagcaggtgtggggtctcgtggagcaactgcatgtgccttgcctacttcctgcacccagaaatagtcactaccagcccctgtccaatgagggccagcatccacatccctcccctttccctctggcagtcctcctttaaacctcctggaggtttagcttcctccttcctcttctcttctttaagttgttccattatctacatgcagggtttgatgcagatttccaatagctgttaatcaaaacatcttctatttctacctttgtcctcgaagtgttgtcatgtcacttctgtactacaatttaattaagtgtcaagcaagagatcagttgagaaggtcttgcctctcagtggaactagggaataataacatctgcaaggcttgcaggcatcctgtgtctaaacccaaagcaacacatatcatagcaggaaggacctttccccaccccagtaagaggaatgagggttgctgtggactagcagtgcccttgagagcatcttagctcagttttctcaccagaaagtggtaaataatacatattttccccaacagcctaggtgccagcattggtagatgtcggtgaaatgaatgaatgcatacatacattttagatcatagatctttagttctttgggggatggatgtaggtgtgaaagtaggaaatccattgataagcagagtgttaaataataaaatacaggcaaaaattctagactcttaacacattacggctggttactttggcaaacattagaaccgccaaagcacacacaactgcacaaagttggttggcaaacttttctgttaaatcgacactccaaagatcgtcattaatctcagtaagttattaactccaagaaatcatctgaacaatggtgaactataataatctgtacataccatatgtgcattaagcattaacacttcattcttgcctatttcctaatgtcaagaaagctcaaatgtacccagcacattgatctctcctgcagaaaaacatgttacatctcatccacaattacaacaactacctagcttgctatgttattgtcatcccaactactgggaaaggaaatgttataatccatggttctaacacacatgaggtcaggtcattcggttgctctgggaactctatagagttgtgctccctaaatcttctgggctgtgccagccaacactagttgggaactcccctccaataaccagactacattatgctcctggcagggccccaggggctccagtgtctcaccccaagagtaactcttctggcactggcagaacagtcccagcctcacgaaagagcccagctggaccataaattgtacagacaaagataaagacacacattttctcttggctcaaaggaccgcagcatggcacattacccacccctctcccaggccagcacagccgttcacatgactcccccttctcctctactgtttctcctctcccactctatcctgttctcctctttccccatctgctgcgtgagctacaaggctcctatcagccctggtcaccagagcagcatatcatcccagagctggtacagcaggctgtttgttgggatgaacttcaaatgaccttctctctgggtctttctcagcactgacttaaccttgttcccgcagacagctgtgggctaaagacaagtataccctggtccagataccactgcttgctatctgtgtgactttgggcacttgtttgatgtctccgagcctcataaaataatgctaacttcatgggatggttgcaaggactaaatgagatatgtcatagctttaatgaaacttagcatgccttacgagtacaaaggctcttcacatctttggtccactatcaggaaggcagttagatgttttaactcagtgttttaacaaaacaaaataaaaacaaagttcaaaaatattaagtgacctactcaagtcagtaatggaggaagcaaaaataaaacccaggtttagcaggttccttatccactgctaattacactcttctctctataaagcaaatgctatggcagaatttttgtgctagccctgccttccaaacatgctggaaaggccacagagcagcaggaaacctacattgttttccctactagatttaaacctgtttaatttgttggattccacaaaagaacacaccatccttcatttatactttatacttcagttttccccatctgcccactgtagcaggaggaggtcttctcctagtgaaaatggttagaattatgtaaggtacaatgtaaactcttttgagatacttagagatgagttctggagaatttacacatacacacacactttactagacatttggatgagtccaggctcctagagaaagtatatttgcagaagttcaggtagatattattgatgagctgtctattcagagccttgaatgaaaaggtgaggtatttttgatgttgatatcaataggcagtgagatttgatcagtagtgagaggatgacattaaatgaagggtcagagaaataaagaaaactgcatccctttgctaagcttggcaaagatgataaaatataaataacatggatgttcctctgattccattttttttcttctttctctgattgccacttgagataattagctaatacaataaggcaaatagaaaaactgcctggatttttgctagcccatttccctctccccagtggaataacttggattaaatagcatcaaagcactctcagctgaatcccttccccccaaaaaaggagacacagagggcaaagccagacctttcttccttttctagcccagaaaggttgctgggaagagctcaagggcccatatgaggcgggaagcagcaatgcgtctccatgacaaccacccaggccaaggccactttcatcacctgaaaactaagcaagacacgaaaggagggtgcatctgtaggaagtttggattcccacaagggcgagcctgttcaaaagccggcatgtgttgcagctgatgtgggatgggtaaaagggaacaaaaggatcgggaaccaaccaagaaactgaccaaatcaacgccagctcaatgaagaggtattggagaatagtattggctgcccaaaaagccgtccaaaatcgtttggtaggaaatggcagctgggtcacaaaaggagaggcagtctgagggtctagtgttgagtaggtcacagagggggacaagcagttgtgtgctccgagaagagtctgcaagccaccttggaggtctggggagggaaggcaggtgcccatgatcacggagatagtggtagagcccagatctacgcctatgctttctaactcagtccagggctatctttatatcttccactggcttcactttctccttctccccttttatacagtgtttcctgcagcagttgctctttcgggcactttcatgctaccagcgtgttcattgtaaccagattttccctgcagagaggcatgggcactatggtttgagcacctttccagggatggctctcctgggacagctgtgggagaaaggatgaaaggaaaggaggaaaacattccatttgcctcccagttgctccttaggctggtgctggagaagtgataaatggggcaggaggtgtcagatatcaacctggccttccttctccctacccgcccattactcaattggaaagattagggtaatgaatgaagctgaactgcctgggttaaacctctggcccttctgctcactcactgaataaccttgcccaaatcccttaacttctttgcctcctaatcttctatacagagatcataacaatcttttccaatcttctatacagagatcataacaatacctacctcctagggtttgccttagaaagaggaacccacagacctaagacctaagatgtcactagcatttctcctgtatgcttgagggaagtccagcccaaggacacaaccgacaaatccaacagtttgtgagtgaatgcatgaaggaaggttagtccgtcctcactccaaacctgttctcttcagacccagtgtttcctaacctttccacatcatgacacagaaagatcaccgtatttgtacaacaggctgaggtcaatggagaggttgttcccagctgcaagcacatggccctgaggctctggctgccccacatccctcctagcatctcccagggctgtagggatcaatatttaggttcctggtaatcaataggaagcaaagtaagcatagcccgaaattagggtgggggcaaccccagtccctggggccaggggacatctggacactaattggtttagaagtatttgggctaaaccctggagtgcagagaatcactctggttagctcaggccaatgggagcccacctcaggtcctaggggtagaggcaattcttattatgcttcctgttactatgctatgggagaaaggtggaaaaaattttttttgaggaaactaccaccatccccactgcacactgaatggacagaggcagaactcctaatgggggcagcgtcccaagtctgaggcgcccctccgtgttcccctttatacgcctccccaccatgtgtacttctgtttgctcctctgtaagacactggtagccatccaacgccgaaagatgggtcaaggaccataatggtctcagtgagcaattgaagtaaaggaccacatgtttgagcttttcttgaaagattttttttaaataaataaaagggttattgagctcttttttcccctccctttcttttaacagcacctttcaacccaggagctgccaaagaagttataagccgtgctatgtatagaagccacgtcactccctactgaaatagagaagagcagcatctcccccacagcattgagggaaagaagagggagcaactgggtccagccaaaacagggtgtgggggtagggggctggtggggtcggaggagtggctgcaaccctgcctggtgtgtgcagggagccaacacagggagggctaccaaggggggccactgccaggaattgcagcatttttgtgctggacagagctgcctcagggcatctcattcccactcctagatgtaattgatcatatttggaaaggccctcagggacaggaaacttgataaattcccattccaatgtttcacgaccctgacagtaaaggagctcatcctaataatgaagctacaggctgcttcccacagtttaaatgcatttccccttctgatgtccttcgtggagatcaggaacagctggtcactctcctccccatgataacccctcttatattgaggatgggtatcctgttgcttttcaccccttgctgcttcttattaataaaaaaaaataaaactccaatttctgtatcttgccatcaaatgcccttttcctttgtcccaactcaacccatcatcaccgtccttttttttaagtatattttttcttctgaccttgttgcaaaattgatggctcaggagtaaatatcattcccattgtaccatcccaaaaatggaggcatacacattaggaccaggtgaagggaaggaaatgaatgtgtgctgcagccctcccctttgtaagctgttccccacattctctgagtgaatcttcaaaatcccaacctcctgttcacaaatccagaagttaagattcagataagtaaggggttcaagatgatctggttaatcatcaccacagctgaggtttaaattctgttcacaagttaattgtttattaacttgcagaccagttcagatcaagaatacattaactcagggccaggtgcggtggctcacacctgtaatcccagcactttgggatgctgaggcaggcagatcacttgaggtcaggagtttgagaccagcctggccaacatggtgaaaccctcatctctactaaaaaatacaaaagttagctgagcatggtggtgcgcacctgtagtcccagctacttgggaggctgaggcatgagaattgcttgaaccagaggtggagactgcattgagccaagattgtgccactgcactccagcctgggcaacagactgggagtctgtctcaaaaaataaaaataaaaaataaaaaaataaaagaatacattaactccattcagagaaatgcaaatcatagcgtcaatgagcaggagatgccatttcccacccgctgggatggctagagtaaaggatagaaaatgacaagtgttggtgagggtgtgcagcaattggaaccctcacacattgctggtgggaatggaagtgaggtggctgctttggaaaacagcctggcaccttctcaagtggtgaaatagatttactatatgatcccaaaattccactccttgaaatatatgcaagacaaatgaaaacatatatccagacaaaaatgtatacacaaatgttcatagcagcattattcagaatagccaaaaaaggaaacaatgcaaaagtccatcagataaagaatgggtgaataaaatgtggtatatccatacaatggaatattagtggcaaggaaaaggaatgaagtactgatccatgctacaatgtggctaaaccttgaaagcattatgctgagtaagaaagaagccagacacaaaaggctacatataagattccttttatacacaatgtccagaatagacaaatgtacagagaaagatagattagtggctacctagggctgggggccatgtggagctggagagggtgatggctaagggatttgagctgtctttttgcagcaataagaatgttctaaaattgattgtggtgatggttgtgcaactctgtaattatagtaaaagctactgaattgcaaaagccattgacttgtactctttaaataggtgaattataccaaatgtgaatatatctcattaaagctgttttttaagagtactttaaattcaaaaactctgctttttaaatgtttgagaatcctttgtccttataaagaattgattcaaagttccataaagcggattcagtttccagattgtgttgataagacttgcccatggctggccaccccgtcatctctagcagagggtgtgtgagaatggccgttggctccagcttcctgggaggggagacccaaggcccaggaagaaagcgatgagtcctttctcatccaaaggtgcatgcccaagatacctgctttgaggtacttcccatccaccttctccattacaatggaaggcaacaaagccaacaggaagcaccttgtccatgtgcaccatgagtcaagtcacatgtaggacccagccaaggacctagagtccctgccacatcccagaaccacacttaggtagcaggtaccaggcctctgagctggaagcaatgtgggggaagatgcgcccacctcctgctcactcctgcctctcttggtcattccacagagttccagagaaagagataaaggagacaaagaaagaaaagaagaaaagagcatgcagagaccagttggaaaataaaagggggccaattccctcttattaagcctgttattaggctgcgaatcaaattaaaccacagggctttccacttacagagtgctattttaaggcttattagactatattaggattggcatacatttccactgacataatatcggcctttaattggatttaagggcgaggaggctgcattcagctggaatagggtccctgcaaggagaaacttgctattctcctcacagcttccccacttcccctgctggctgccatcccaggggctgggcagaccctgtaaccctttcagatccaaaacacagcttttttcctcctcctcctcctctgataagtgcccagaggccgaagcaggcccccctctcgcctacgtgtgcccatccctgactggccagcttccggtactcggtggctgtaggaggtgcagagctgtgcgtgcctgccgaggctgggcagcagacttcagactgtgagtagagccccagggagggaggccagcctccccctcctgcttccaagctgccgtgggcgagattggcagtgggaggtgcaggagtttttcatgggacagtgatgaaaagggggacttggggttggaagcagagtttaccttgacctttgaatctcctcccatcccctgcctggtcaatccttgaaagaccctcaggggcacgtggtagaacctgaatacaggagggatatgggaaaaagttcacacactatggggaagcgaacactctccgggctggtggcagtttccagacacttgtgaccaacttctcaaagctgcagcatcctcctacgtaaaataggaacacgctttccttccactcgggattgctttgagaattaattgagataatacagctaaagtggtgagtaggaggcttaataacgtttagtgccttctcccctttgctgtacaaatttcagatctttctaccaaaaggcatcataaaagtaacagacctcaccagtcaagtacgttgcaaaataatcttgggaggggaaatatcttggtacagagacaagtatgtatgaaatatcacttcccaaaatattgctcaaacatgaaaaaaaaatcccaaattccttaacattttccactaatatatgtgaacgtcgcctgctcccacttgccaagatgtttcttggctatactttgatgtcttcaatttccacgcttgtttttagctcttctgccagagccatgtgcttgtttatttttactacatttttatgacgtttctgctattgcaataagttttgcattattagttttatcaaataacagaatgtctggttggctggctgagatttattggcccagtttttatggctccatcccagaacactttttgtgattactttctaagttgttcttagatccattcttaaatatgtgcttattcctttattaaatcacatctgaggactaattgttatggtataaacttagcatcagtgcaatgccaattgctataatcttaccattattacttaatcacaggtttgtgtactcggttctatgcaacatatatatatatatatgttggaaaagttgcttggaaagctgaaatttacaaactgcatttcttcctatattcactaggaagtttctcctcctaatacatattatctcaccttgaaatatctgtttggcaagttctgtttatttgggatgttgactttcctgaagctcgaggaaaaccttattacaaaacaaaacaaaaaaacacaagcatgatttatttcatccctgcattagcttcctctgctgttcttatttgacccaataagtctatgaatgacttggttctatggttgagaggcagagaaaggatgaatttcctccatttattatggggagaacttgaggtggggggcaagcagtatcttgctcagccctgcaatgaggtgtcagttgtcctgttttctgcaaggaaggtcctcatagcctggcaataatgaagtctgttgtgcttcttgaaagctttgcaacccctgaaagtctgaattcttttcaagtcagatctgttttcctcatggagcctgagcccagggttttcttctcccgtccaacccccaacacatgtcctcattgctcactgacccccagagagttccacatcagtaagagtgggacctcctggaatgttcccccaaggggacatcaaaggagcaactgtcctggcgggtttggattaatggcatctgaatcattacagccagaaatgtgtatgcctgtaagcctggggcaccaacagtgtgtgcgtgtgtgtgtgtgtgtgtgagtgcactgcacactgagcctgtgcatattaaggggtttaaatcaggaatgagcgcaaatccacaaacatgtatccctgtgaactcacggtactcacaatttagccaggaggagtttttatttgaaacccactggggtctaaaatctttttagggctcagttttctggagttgaagtgttttacattcccacttctgctcctattctactacagttcttctttccccatcagggaatagactattctgatggcagagggtggtaggcaggagcctttcataaaaataacttttgatcataatgcatcatcattatcatcagcgctatttagctctaacgcaggtaggtcactggagtaggggcaggcttcttggtgaatggctcttggatgtgcttttttgtccacatgtgtgtgtcctaatgtacccctgctctgcagatggctctaattaatcaggacagtgaaagctcttggagagggattctttttcttcaaaaaggaagatgctctagctcctccctccacttagcaaccagcacgtacagatgtggcaaaggcagagaaatagagaagtggtaggaagtttcacaagggccctttgggaggcaacttgctgacagccacaggaaaatgtggagaaggtgcctgagccccttttcagcatgagcataaatgagtctagtggttgtggaacacaattcgtaaaagatgacacaaatgcctgctttcttctactggtcttattttaggggtgttcaggatccaagtactccttccttaggtgaaactctccacgatgggaggtcttggtttcaggcaggaccaagagcccccactttggaagttcaaagagccagatgccccctcttcctgcctctagtggtcagggccctgggctggttcatgaagccttgctcccaagcctttggatctccagcaggtaatgcactggtaaggaaggctgcttagacacttttcaggatgtcagtggtgagttaccgcagggatgacgcttcctgctaagagatggctatcacccttccagcttcccgtgtcccaattcctgaacttcgtccaagtctgttcctccagctagccatcaattctgggagggcttgatatccttcttcataaattccctttttgatttaaaataacctgagtcagtctctgttagttgcaagtgaaacatcctaactgataaatcccccaggacagctgacgtcagatttcattagctgaaaggggtgagccccactggctgtgagcaaaaagtgcaccccactttcatcacaagtctggacaaatgagactgttgggtgctcggcagactctcccattcagccgattaatatttccctggtactaaccatgtgcctggcactgccctaggaatgagagatgcagccacaaataggagaaaatcccttttctcatgtagtttgtatcctagtgtgggatgagacaagcaattacaaataggcatataaatccctctgcctatgcctaggaagagagggaggaggggtagagggcaagggggaagggggaaaaatcaagaggctttggggagggagagagaaggagaaaaatggagatcatatgatgccaacagagaaaagtgtttccagaaggagggagtattcattttgtaaagtgtacgaggaggtaggaaggtaccattttgttaaatgatagagggtagatttctatagtaggacaaggctgagaaatgaccccaacatatcagtgggcagctgatgcaggtttaaggggaagagcgaggagggggtttaggataggagagcaagaggggagatatttaatgctccttttgaacgtgcattaatggacttgggatatccagtttcgaagaactgctttagaaagggaaaccactttactcatacaaggtgaagacatcttaagccagatcttcctagaagctctacctggcagatcggtgagaagctggggttctatttttttcccaactgggccctccagtgggtctgtttttctatccaggtgctcaaatgggaaagcctgaagctcagatacagctgtttgtgtaaatggcaaagttgggtttatagcaatttaatcagcagcattaataatgtcacctaagcttaatgataccaattataaccacagtaaacattgctgagccgtttataaacagtgatgttcaagatgaacttcctgcatttggtcaatgctgttgttaaaaaacaagactagaaggttcatgttttgaagattcccatattctcactcctgtgctgaaaaaacagcgccacataagggcaaacccctgcaaggatgtcatcctcttcctctcttcactacctgctttggtcatttcccaaggccagatctgcatccaccgctgttgtccaccaaaacagagtaaggctacggcaggagtattatggacctaaccatgccagaacaaggacacagttggataattattctagcccaggcaatattggttccctctattaagcaagttctgagaagtccaggggaaaacaaaagggattgttaaaggtcagatagagcccatcaaaattctaatcaaaacagaagttggaggcaggacttcgtaagagctattcctctccatgggtggctctcatatgagaaatggaagctagccttccttttctgaggaaggaacatgtattagagagtcaaaagtactccctgagggattctaattagaggatgaggaagacagaggggcctggggaaggattcctaaggaaggttgtgaaaccacctgtttccaaagggcttcaacgttaaaggcaacatctctgcctatgagaggtgtggtgtccaaatggagagatgggtgttggctaaggaatgtcgaccagccagagtctcttccagacccaaaagcctggaaaaaatgtacatgtggctagagacaccatcttcatctaaaaacagcagaactttccaacctttttcatggcagccacaggaaatgataatctttgcagggcacatggagtaaacagaggggaggctggagagccagcctgctcagctgagagcgtggaacactgagtgccaagctctgtgccctgcatttcacatgccctccctctttcctttgcatccttcttgccttcctaatccgcctcagcaaagggcttcttgcacggttttctcgtcatcaggagtgcatgtctcaaggaaaactgctcttgtccacattctcagccaaatgagagtatcaattcatttgttcattgtaaatagagtagtgcaatagtttggtcctgaatccgtgttcagtttggaatcttaagagaccaagatgccaaaatacctgcatggcagcgtgttgtctttcccctggttgccatgaagataggatccgctggagcctctgacatcccatctcaagcatgtgaggggctcagaacttttcctaagaggaattaaggtctgtcctcattcaatttgtagaaagccactcagccttctctttgctgccaacacaaaccttcttttcagtctaacctccctgaagatagcagactcttcaggggattttactgcagtgtttggaaattgcattgtgtttttatagatttgtgcgtacacctggtggtcttagaactccacaggcaactctagtaaataaataccagctctgggccgagcccaagttaaagtgaaggattttgttaggccaaagtcagcgaaaggaattacagagaaatccatgccagaaagcaggagattgttagacacagagcactccattcaggggaaaggacaacaatatatttttttcccagccagtgtgtctcaatggagatgaggatttgtgaacaagattcaaattccactgccaccactaacttgctttttagaatccaaaatgaagtcttcctgtgactgcgtctatgtggcatcaactatttggaagggaattgagacgtttatttaattatccagatattttgaaatatacaaatcctttttgttccccacttccaattcagatgtttgtcatctgtagcaagcatgtgtgactcaggtttctcatctgaaaccggggttgggtggaggttcaagttcacttgtctacaagggatgccctttctactaacaagtgagcctgaagcaatatacccacagtcttttgggggagagcaaagttttaagaaaagatattgcctgccagtgtagctagagagcagtagctctcaaatggcctagtaatttggaggagagggttggtggagaagaaaacggaaggaggatatgactgtgttttattagattacttggaagtaattagccatatagaatctttgggtatggccgtttagaggttccaggccattatttactcacagttaattccttaatgcatgtgttcattcaacaaatattaagttgatgcctactctatgacagtgacttgggtaggtgctaggaataaagggataaaaacaagctttttaaaacaacttctacaagtgagtatataattacatctatgtcaagttctgtgaagaaaagatgaatgcagttatgagcgagtatcactgggcacaatctcataggcagggctagggtgggcttgctcaggacagagcagggtgattgagacttgaaggttgaagacaggcagggccagacaaggcaaggactgggaaggtcagggtcttgcaggctacataaggggcacttgattttatcatggatgcaaggagaatccactgaagggcttaaaatcatttagaagaaaaagcaccagaatcagaccacctgggctctagacccagaccaatggcttgactagtgaggtggccctgagaaagccattcgaccttcctgtctcagttttctcctctgcaaatgggtactacaaagagactcaaagttagacctggaaggcacctgagagttttgttttgtttttttatgttcagccccctcctatttcagaaggaaaaagtcaaggctgcttttttttttttttttttttttttattcctgagacagagtcttgctttgtcacgcaggctggagtacagtggctcaatctcagctcactgcaacccgtaccttcagagtcaagcagttctcctgcctcagcctcctaaggagctggaaccacaggtgcataccaccatgccggatttttgtatttttagtagagacggagtttcaccatgttggccaggcaggtctctaactcctgacctcaagtgatctgcctgccacggtctcccaaagtgctgggattacaggcatgagctaccgtgcctggctgtcaaggctcctaatacctgttctgttcacttcatttgactgtggcagtaatcaaaagaaataatacatgtaaacatattttgtaaaataaagaaaaatgtatacctaaggtcttaaattattatttctgatctctcccaccctggccacaaagactcacacatctcaatgttcctaagtattaagacaagagagataaaaatagagatttgcctgcatgtgtctacgtgtgtatgtctgtgtctttgtatctaagtttttacttcattatctatatctagagagaaaaaagaaaaaagatatttgagagactggatgtagttctagggcattatttacagggagcggggaagtcctgaaaaataccttatccccttgggagcagtgacctaatcaagatggcataattgcctgtcttatctaaatgaaagcatcatttgagaaacagtaatgggcctcagtgtggtttcaattgctatatagttctcaattgctattgagttctcatttgccatggagttcagcggctgaagggtaattataatgtttaacaaatatattccctttagggacctgatgttaaagacacaacatcccttttcttatcctaccagattacacagctcccgggaccattgctatgtaccttaaaagcatgggcactttctctccctaagcttacctttctgccaggcagtcactaagaaacacggtctcagagggtgggagagaccaagaagtcaggacctccaggtgggcctgtccctcatccacatgaagctgccatgagagttcttgttgtccctcaggccttgctaatgaaccccaagacagcttaggagaatatgctctgtcaattattcatccccgccaggtcccaggcatcatctttgcctatcccattgcacgaagacaggagattataaggatcagagcaaaggtggtgctcactaaaaatacagatcagatactcagtttctctttaggactatggggttaccaaaaaataagggtcccgttctatcctttccttagcaagcatatagcatactcatgacaggtcttgcagtgacatctgagctgaatgatgtttcgacaacaacaaaaagataaaaatggaccaatttggaagaagaggccccaaaccccccatagagttgttgcaggtggccagtgcctctgtccacctcggagctcagaagatggcacagaggcctgcgtgcttgtagagagagagacagtgggtgctgccctctgcattgggctggctttagcatgcccagtcctgcacagcaccctggatagcccctgtcttgttcttcttccacctcaagtctaccgagtgcattctgcttggagatgggggccacatctgctgaatgcacattttatccctggtggtggctttgttcttaacctggcataggagctcactaaatgtttgcagaatgcatggtaaatggagcaaagagatgagtaaaattgattgtattacttccagctgcctgacagtctgcttgaagatactggccttaacatggatcgtcctccatgccatccacttccccaaggactcagctgtaatgagcgctagggggtgggttgctgctctgctccagatgtgaactcatggggtactttccagggaaaactaggaagaggtaggagagagagaagtgtcgcaggttggcagatgacaatcatgagggctgtccactgtgccagcccagtgacagaaaccagcctcttcaaaggcccctgcaggcccacgatgccttgtgtgtgcactcactgcttggagaacagagccaacacgtgttgtgctgtaggtacctcgtgggctacagaaaatgatgcgttgattgatttgcttattgggccttttatttattgtgcccagagtgatgggtgaatttagtaaaggaaggaggaaagggacaatcaagtttgagaatggtctgtcagctgcagagaggctgcaccacaaccagttattagcttagaaaataagatttctccccaatcctcactttctcttttgctaagagaatattttttccaacctacattaatataagaaaaataaaaaatgtggagagtggggcagaaggaggaaaggttagagcaggaacagggagtgaggccagaaatttgtttaacagaatcatttctgtgcctccttgaacactttgattaaagccaggggactaaatcaaagccactgaaaggaagaataaaaagatgtctgaaaacaattttgtttgctggaattttccctcctgtgttctattatggtgggggtgtggctgtgtgtgtgtgtgtgcacgcgtgcgtgaaaaaaagttctattttgtcctcctttgatctttcaaagaaaagaacatttaaaaaaggaaaagaagaagagaaattgatatcaatattgttccttttctttccttcacttccatcaataactcaactggatctaaagtgaggtatgaataccaattaagcccaggcaatccacaaatgaaaacctgcagcatgtaataagagagggtttccaaggccactacagccaccaggggttctcttaatcataggtcctctcccctcccctgggcccacttaagtcataagaccatttagaggactttatacatcatcaagtaaggccaagatgggaagagcaagatggagaggcctccagttcatacttccgtcttcaatgggtttgctgtagagccacctgcagggagggatcctattgatgtggtagagctgctacaatctcagagaagtggcttgagatagcaatattcaaataagacaagaccataagcactcatttctgggttgggaattggtgtaactagcccccttgctctccaaagaggaacacacgctttctatgcatcttcaaaacttcacataaaatagtgataaatcaggggcacccagactaagaaactgatgcaaatgctagaagtgcagagatgggagtaagctgcaacttgcacgctaactctgactgactgatagtgacttcctatagtgctgtgttaagaatgactatggggttgaattttcacttagtcagaaagtatagtgacccgttaactgatgtctgccataagggttagaagaaagtcctggtatcacatgctatgtgtatgccaacctggtacacttaaaagaacacttgacttgaagtcaaaagactataaaccatgactttgggaaagacacatagcttttctgagtcacaggccctatcattaaaaataataataacaacaggaaaactaatgtacatatatgaattttgtaatttgtgaaatatgcatgcatgctacctcttttattgtagtaaagtatacatagcataaaacttgccattttagctatttttaagtgtaaagttcagtgtcattaagtacattcacactgctatgtaactattaccaccatctatcttcaaaactattttatttatttatttttgaaacggagtctcactctgtcgcccaggctggagtgcaatggtgtgatcttggctcactgaaacctctgcctcccatgttcaagtgattctcttacctcagcctcccaagtagctgggactacaggcatgcgccaccatgcctggctaatttttgtgtttttagtagagatgggatttcatcatgttggccaggctggtctcgaactcctgacctcaagtgatccacccatctcggcctcccaaagtgttgtgattacaggcatgagccaccgcacccagtccccagaactattttatcttcccaaactgcaactctgaatccattaaacaacaactccccattcttcccttcccctagcctctggctaccatcattatgcttcctatctctaggagtttgacaactctaggaacctcatatgagtggaatcacacagtatttgtccttctgtatctgacttatttcacttagcatatgtcttcaaggttcatccatgttgtagcacgtatcggcatttcctttctttttaagactgaatattattccattatattatatggatagaccacatttatttatccattcatctgttgatggacatttgggttgcttccatcttttggcttttgcgagtaattctactatgaatatggttgtacatctgtttgagctcctgctttcaattcttttgggcattacccagaagtgtaaccgctggatcatatagtaattctatgtttaattttttgaggaaccatcatactgccaccatctgttcttacatttcaattagtaatgcctgtttgaaaaactttatagagaagttgaagggtcacaaagagataaaggttgaagaaattcaagttgaagtcatccaggtatggcctgggcctggccaggggcacatggcaaattgccctcacctcctgctgcccaggctgtggctggcaggctgtcttgctcagcagagcaccagggtggaggagcaatagcttgaatccatcccctttgccactcgtctggtgtggtccctgggccaggaccagtgctctagtggggaagaacattctcactcatcagcagcaatgtttacctgggcagggcgatggctcagatgccaccctccagaatgcagaccccttcgtgggaaaggcggggctgggtatggggagggaacaatggggaggaatgggcagacatggtgggaggaagccattcacattttggttatgacatactggtgtctagactttgtcatatggagcaaatgacaggatatttggatagaaactcagctttcaaataatgcgctaacaagaaagaaacgcattgcctttctttgttccccaaagctctggcagctggcgagatcagagctagcctgccagagcacaaagctttagactccttgtcctctctgcactggggcagtggtttcatgtcagctcacagacattaagaggttgcgctgcctggatgcagcccagcccagggcattgttgacatctgagagtggcagccagctcgacaggctcttcctttctccataaagtcattgagaagtcactggacttaaaagggcccacagagggtcatttagccccctttctgcctggactggacattagcaaaaccatccaaaactatcaggaattttccttatcaccaaacatacccattccgtggtcttgctcaggggatgtggagaatgacggttcctttttctcactatgttcgtagtttcatcctgtggttgagctaagtgggctctaggatgggaaaaacccagtttgactcctagggctgatacttctagtgtgtgaatttaggaaaattattacaataactacatcgcttaatcctcatattcttcatctgttaactggagaaaacaggaatgcatgccttatctcagttaataatatcaggagcctggcacctaaaagcacaatgtaagctctcagggttattgtcccatgccaatggagatgtccccctccctggggaagactgcaccaaactctccctgacagacgtccatcctcgtgaatgcccttcctaccagggctcctgagagctggatttgggcatttctgggatagcaatggcttctcaccaaatttgaaggtttaggaaacaaacttaagggctcatctcattgaagtctatgtctggttcatttaactgctccttcaataagctgagagagctcagcagtgagtccataaaaagcactagtgaataatggtcccttgagtacactgcagaaggtgtcccttcaggggtttccatgccctgctcccccggtctttcctacggcccgcgtgtgtgtgtgtgtgtgtgtgtgtgtgtgtgtgcgtgcgcgcgcatgcatggggcaagagtgtgatggtgagtggggttaggctgaaagtcagaaaactggattctatgctcacctctgtcttcagcaagaccctccccctttgggggctcagtttcctcatctctaaaataaaagttgtacagtttcatttctggaatgacttgtggttcaatggatccatcattccggaactgtggctgatgaataggaaaaccggaaaagaaaaggaaggcatttttacatgaggcagaggggagaagtgaagtgcaaatccagggctcctgatacccagggcacacaagaggagattcagagagagaagacaggcatcagcaagtaaatctttcctctgccaagtgctcttagatagaaacccagatccctgaggaaattattgaaactcaattcctttgagaacgttaaaaagtgagctagcaaagcacattgtgaagaggaaatctgggtgtcctgccccctctgctttcatgtcgctaaccacaggagatggggctccttcaccttcacagtccctggggtgccttcctatctttcagggagcttggggactcctccagagaaacagtaagatgagttacaagccgtgaacctgtctcagtaggactgtctagttacagggagctccatattaagagaaattggaagaaacctgtaatccaatcatgaagccggggatggtggtgagttacctcctgaaacacacacagtacattcagagctccaaaaacattgtgcaggagccagaggtgagagcctcagttctttcctcacttccaggaccaagagggtctgtctttagggtaatagaccctgtgctttctgagtcttgattttcctaccattaaaaaaagagagaggctaggcatggtggctcccacctataatcccaacgctttgggaggctgaggcaggcggatcacaaggtcaggagtttgagaccagcctggccaacatggtgaaaccccatctctactaaaaatacaaaaattagctgagtgtggtggcgggtgcctgtaaccccagctactcaggaggctgaggcaggggaattgcttgaactcaggatgcggaggctgcagtgagccgagattgtgtgactgcactccagcctgggcaacagagcaagattctgtctcaattaaaaaaaaaagagagagagaattaaataagaagtatttctttctcttggctacctcaaagtaggggcttttgggaaatcaaaagtaactatttgggaagaagaggaatgactgatgttgcagaaaagacattccagcaaagggccatttaaattttccttggaaatattagttgaaagaataattgacatctgctgttggaatatgatgatgagagctttaatcttttttaattatttaaaaaaacttttttgagacagtgccttgctctgttgtccaggctggagtgcagtagtgcaatcatagctcattgcagcttcaaactcttgggattaagtgatcctcccacctcagcctcctgagtagctggaaccacagacacttgccaccatccctagctaatttttttgttgttgttatttttgtagagacaggttctcgctatgttgtccaggctagtctcaaactcctgtggcttaagtgatcctccagcctcagtctcccaaagtgcttggattacaggcatgagccactgtacctagctggtgagagcttcaaataagctaagaaagagatatctaagattacctggaaatgaaactcttgctaaacatgggctctacatgtggatatagagcaagtgcaagttgcaaatcattaactacattggctatgttcaaggaatagaagtgaaaatgctcagctgagtagccctgggctgggctgtggtggccacacagatcccttgcctagatccagagcctgctaaggatggtggcctagcagctctgtcatggactatgaccaaagaagtatttccaaaggatcaccatacactgaactcttcaggcatgacagcaagtgggcagcgtaccaccctcaaaaaggatacacactcgggagtgaggtggcagggaaggagggagatacagaaggaactgccatggagcctggaagaagaaagggggggtgaaggtattgggaagaaaggatgaaggatgcaggtgaggggtggggtggggagcgggggatgaacgcaacacacaggaagaccaagaaacccggaagaatcacgagtacagaataaaaccaataataagtccccctctcatgcaggggacatcattagagatgccacggtccagaggaaggacacatcggctgatacagctgaccacaggttggagcagtgcatctctggggaacatccatgaagaccaacagagaatgagaaggacagagcagcaaagggcacctgcagggatggaacagccaccaggagccagatgctttaactgaactgacttgagttgaaccctcacaacagacccgccatgcaggtacttattagataagagagccgaggaccaggaaggccaaatagctggcccaggttcccccaggtgccagcggtaggactgcaattctgctcgtcgaagccctctctcttccaactgtgacacttttctcttaatgctccaggcctgacggagggcagagatcacagggggtgtagaaaggagctttttgtgatgacatagaaaatacccacgcaccatgggggcagttggcaagagaggagaatgtcttggaaatgggctggacagcagggtgttgattggggccaatgtcaatgctgggcgtgatcaaaggaggggcagtgtcgcctccataagaagggagaacgaagggcatttagagggagtggaacagcagcttatttgagtattctattctgcttagtgtttttcctttaggttaactatttgatcaactactaaggtatgagagaaaagaaaagcaacaaggagacatgggggaagagagctggatggggagggacgcggctgcacccacacagatcctggctccctgtcgctctccttcctgccagcagctcctgggcctgccaggcatccagggaagcagctgtctgagcctaagcccagctggcaggaacccccactgacctggggaccagaggaggaggtgggctgtggtctctcctgtcaccctctgtctgcccaggctgacacctggagtgtctagagtggggccctcagctgcctgcgctgcggctcacagcacctgatggacacacaggtgtggcgcgtcctgctgggctcaaagacacctgctctgggcaccatgcccgtccccatcaacagttgtagatgaggctggagctgagaagaactgacaagcagacgtctgctgaggagctgggccccgccctgaaggaagacagcccagccctcccaaagcacatggttgccaggtgaaatttgcagtcaccagccgccagccatgtggtgacattggatttcaggcaatgaccttgggaacccacattgcatctgcagcaggtgtctgcattcacctcacatagcactctgaaaatgtttgccgctgtcagcaccacctgaaggggcttcccctgcagtcctcttttccatccaccctcccctaattcagaccatgccatttctctatcctgccgcacacctccacatttgagttttcctgcttggatctgcctggcctgatgtgtctggctgctcagagcccagagcctctcccagccctttcacagaagatgagagaatccctaacgcctctgccatttgaccaagacagctcctttcaacttcctcttcccctcgggcaaaatcagcagcagagacaggactaagctgagtggcctaagcccctcctttgattctcaggcccccagagccacccaggtgccagaaacctgctaagacgtatcaccagaccccttgctgatatcataagcattttttccccttctcagcaaaactgacaggacatggcttcctggaaaggaggtgaggggaggagtccccaagcctggtgagaacagagggagtgctggtcgatggcccctgtttctccactgccacctcaagaagccttccaaggagggcagactaatgcttgcactggcttggctaatggaagaagccaggggggctgtgtggaaagaatggaagagcccccagtgggcataacatacaccaaaaagagagggcaccgaccatctgtgttgacagagaaggacatccctcagtagccatcaccgaaaagcaggcacttcatgtctgccctgaaaccatcactatgaacaaagagctcatcaaagaaagggaatttttatagacaccctatagaggagtgattttgattcctaatctgtccattacggccccccgagaagtaggtataaaaagatgatatgcggccgggcgcggtgcctcctgcctgtaatcccagcactttgggaggctgaggcgggcggatcacaaggtcaggagattgagaccatcctggttaacacggtgaaaccccttctctactaaaaatacaaaaaattagccgggtgtggtgccaggtgcctgcagtcccagctactcgggaggctgaggcaggagcatggcatgaacctgggaggcagagattgcagtgagccaagatcgcaccactgcactccagcctgagcgacagagtgagactctgactcaaaaaaaaaaaaaaaaaaggtatgcagtgtggtccctgacagcaggtttgagctcccttgcaaggagaactccagcatttaatgcagaagaggcaagagtcaacttgggtgttcttccttcccagtcttagctctgagtgtagaaaatccaggtacattcctcccgaaatgctgttctggtgagtggatgcagagaggctgcccaccactgtgttatcacagatgccaccctggcatgagatgcaagggaagtagaggcagccatctggggatgggattactgggaagcccacaggcctcacaagccagaggcaccatggtttcttgacttggacgtggcctctcaaatgctggaggatgtccagcccacagcctttggtgatgctctcctggccttatttagaattcttaatgctggcaaacaacttttataaaattatccatttgtatttggatgcatacataaaaatatcctttatctgtatttggttaataaaactagtcttgctctgcctgtatttagcggtgccagctatcctggactctgtttgtgtgcctgtgtatgtgtgtgtgtgtttcattgtttctattccaatcatatcactaataaatgtctatgtataacaaactcatgcagaggagcagtgagcagattattatcctgcattctattgactccttatcacccctttccctgccctgctcaagcccctagatattgatgggtgtgactgagctaggccatcctctgctgttaggcaaaactgtgttcctgtgtgggcataccacgtcccaggagtcgacgactcacttttgccctgagggtccccagtgaggatgcacgtatgcctatggcaggcagggagagctgatgcctggttggcatgagcacctgaattagtgttggccacatatggatggccatgctggtgggcagaggcagaggtcagggggcacaagaagagtggaaaggagatcccagagaagaagcacatggagtgggaaaggcacgcttccaggttagggctggtctgcagacacacatgccccgtggttgggctggggagacgggttggggtggagagggaaatgggggtggggagtaacacgtgcaaaggtggaaatcatgaaccaggttttaagtcctttggctccgtgttatgtatacagaaggcacagagaaaagaatatgggaagttaagactgggctgtttgggtgggcaaggaaggagcttaccaaaaactgtcccaggagaccctctgagatggcccaagaccctcaaagaaagtggcccaccatcctcagctacctcttctctaactttcggtatcttacagctattcctgtatctccctaatctcaaatcacttcttgtgagagtttcctgccaatgatgtcagtaccgcttagatgtaggagcatatttctggacacagttccctgaataaagacttgggatagaaaattaatcctccccctaggagttcataaaactggggcaccgaggggactgatggctaaaaccaaagttgcagtgagcctggaagggaagcagccacttgggagggagccttaaactcgagtggggacggagacagtggccaaagatgttcacagccgtccttgaaagggatgaattaaagagaaggcatcaaggacagtaactcctttatcaaagcccatggctgggcctctctgatcagcccctgcctcctgacacacaaacacacacacatacacacactcacacacacagtctagaccacacctagccactgaagagtgctttaatccatgaaaacacactgagaaataactctggggaaacttgattgggaaggtaagcctgatgtgaaaaactgcaatcatgcatccaaagccaaaaagacatgatcttttgattatctgtgccactactctgattaatgattgttggccatcgcctctagattgacacctgcattatttttgtcccagcctggcttatctcctatcagtcaacgcatcacccacactcccaccagctgtactcaaggtggtcaggcacatgagaatgctttgggaaagatttacatcacgtgacctgtcatgtggcactacattagggctgcaggaccagctattgagcaaaggtatcaccccttccagcaatgagcttcaattttccaatccaaaagaagcagaaacaaatggctaaaaccaagtcagagatgataaccttgagtggctctgctgttttgatgtttacattttcccagaataaactgtataccattcagtatcaccacacagatcacacacgtggcgtggcctgggccctgtttactcaagcagtttcttcttcattgaaggagtccctcctgttcctttaggatttgtggatgacagtcctctgaaggaggtcaggtagatctatgcagatccttcctcccagtggcatcagctcagctactgcaccacagccttcaggcaggagtggaagcccccacaccaagcaacgtgtcctctctatcttcattacctccaaggtctgatgttactcaccctctcccacacctcacacactggaaaccagcatgatgcattagagagatgaagccttttagaatcaaacaaaatagaacaaaggttcaattctccagcacctagtagtgtctgacataaaataggtactgcataaacatcaatacaagatattctggctctgtcactcaccaacagtataattttgtgcaacatctggaagcctcaactttctcacctataaataaggaaagttgagaggcttaaagaagataatctttgtccgtgggttcagcagagggcctggcgtggagagcatggaagtgccttgaaaattggcatttctccagcatttattaacaaaaccataaaataatttaatgctatgccaactatataatgccaaacatttattacttactatgtgccaggcacttttctgagggcttaccatccattatcccttttaatcttcaaaatactatgtcgttggtaaatatcattattcccattttgcacgggcactaattccaagctttgagatggccagggcatgatgtggtcaggcagtagaagtaatgataaaaccagtagagcaggcaagacaagccctggctgcccatgagtctctagctgaacttcattgctaagttcacctttagccccagcaaccagggatgccaagtacacctttccccagaggactcagtcttgcaatgttctctccaaggtctggagaagtcaagaggaagggaaggaaaggaagaggcttccaggtcttagtgcctcatgccctaagattctatgattggtgccaggcctccgtagctctggatgtgcataggttagtgaaaccagcagagtggcagctggaaaggttcgattttgtgtgtctggccatcagctcctcctggactaagggctgtagatgtacacatttttctggcttgtcttattttccactggaaatccagatcccatcaatgctctaaagctggggagtctactgaagttactatgttcaaactttaaaacaaatacacttgaaacccctgggccttcactgtgaggaaacagctcttggatggtttggctactaatttttggctttttagcagtggctttaaataatgaggtgcccatggaaatgcaggggtggaggaggagcaatacagtgacaacaaaagagagaaatctgggaaaatgggaaactttcatgggagataagaaatcttaccgcccttattaggttttctgttctatcagggaggtctcctggctttaataaaatctcattttccctttaaactctcccatgtggtagggccttgtatttaatagggatatataagagaggattccaacctgaggctcaggtggccgggggctccccacactccagtccagcagctgggattgattgcagagctgccagtccagcaacacacaagttgctgcacatcagagagtaatcatgagccatttgatgctgacctgcacgaagtgaagatggcagcttggctcccgttcattcccatttggacagagaagctcatcctggtctttattaaaagtggaccaaaggagtaagtgatgagtcacaatatgtgattgattaggggcatctgcatttgaaagcctccgtggccttcatccatgcctaactccttaaggttcccattagcactgggagattgtgttcattaggagccgctgatgttgataaattcatctttcctgtcacatgcaattctatccagggtctggctctcagttctgaggggctgatccaccttgccttaataccacacgacaggctccttcacaaaacaagcagggtgtcaaaggctagctgttgggagatgccaggcctacaccagcaaaggctggagggaaggaaagggtgagcagctggtaattagaagctactggtgggtatcagaacgcatccatcagatgtctgcagagaggaacacacccagagtatctgtgggtcccaggagctggtgtaggttctgggctattctttcacgattgccaaagagtcaccacttgttgaaccctcgaatgctaacaacagtttctagctctaccaaactcctgttttgccagctttgcccccaagaaaacagaaaagtcatgactagcaaaatgaatcagtgtgaggcacttgcaccaacagagagcatataatttttatctagcaatttcactatcaactccaacaaattcactcttaaagccagaaaagcattccagctttctgcagggaaaatgtatgtgaggggtaagccacccagagtcagttacaactaccctgtctgctgtgggacaagctctctgtgtgttcttttcaaggtgtcagagaggtctgatggacaatgtgcacaagtctgtgtgtgagaagaccaagaaaggcgaggctgtccccgccctctgcattctcatcctggataacccaagctcatgttagtaaggcctctgaggctgatgtccccatttcatctatgtgcctttttccaagacagacactttagctgggattttgagtcctactagtagaggcttgggcaaggccagagtaggaaagaaacctggtggggcagagactgatcgggctttccaggcccacatggccagtgcttacacatcttccatgtcatcttggtccttccccttaactccatcccgcccccccccacgccccagccctcaaaacaatttgggacaacatcattaaattcacacaaacttcttccttaggatccagaaacccggttgtcccccaagaggtagaaaaggctcaagaataatgccacatggacttggctccccagccccagttccactcatcaaaagcaaataccatgtgcatgttctgtgtgtggcactggagacccaaagacaaactgttgatgttcctgccctaaagggtctcatgcagcactcagtaagaaagacaggcagttgattaaataaccacagcacagtgtgatccatgccaacatggacatgctagaggacccagtagcagtccaggaaagggagtgattctgtctacttggggaagaggaggacaggaaggacagatcaaaaaaggcttactgaaacaggtgacatctgatctgagaaagagctcctagagcagtcaaaatggtggggaagacactgtaggcagagctacatgtgttcagtcagcagggtgggaaacagcatggcatgtgggggaacaaagcacaagtggggactgccagcatgaagaactaagtgagggagagcttatgtggaatttagaaaggaaaaaggcaaataggagccaaggagagcaagaagcaatatttccttccactccagccagtcccttatgtgaacagaaaagagcagacagtagagtttgagtcccaacgccactggcatgaccttagaccaatgccttcacttcaagggtctcagcttccccatctgcaaatttggaacagccccacctgtagcatctgccccatggtgttgttgtgagaatcaaattttgataaggttcttgaagtgttgctactctgaagactgtggagagctttggcgatgtgaaaaggtctcatcaatcatcaccagggatcccagcattggccgagggactgtaccaactttgccgaaagtccttggagttcacatgctaaggggaaagcctctattgctccgcaaggcaaaggacccccagccgaggatacagggaagggaagaagaaatccatgtctctgctgctgctccatggaggagcaggatgctggggttcctgtgcccactgcatcccaattaagtatctgtttctcctcatttacacttggctcagctctccaaataccttcctttaaaggattgttttttaaaggcccttcaaactcagcaactataaacactgatgttaggcaaggcactttcagcaagaagcaaccataaggaaataaaattgctgctgttaaatctccactcccaggaagcgatttgctcagcaataaccatttctcaggagccctgatcaatcactgtttgggcaggagagaaggccttcccaggcctcctgatttctccaccctgcagtggaggcagcgcccaccacctttaattttatccagcaggccctgatggtggctttggcctggatttggaaccagaagaaattgtccctgtgactgtcctagaacggacacggggcagccatcactcctgcctggccccacctgcacccagtcctccttgatcctctctgtcttcccaggtcaaccttcggtgccaggcagggttaatcctctctctgcttttagcaggaggagccaaatcccacctatggcaatgtttgcttctggagaaacttatcttcctgcattgctctctcttcatcaaacatgaatgccagcaaaaactcctttcccaggctcacgaaatgtgtaaaaacaaagtacagaaaaagaaatcctacactagattccccagatgttttctatgaggcaattggatctctctttctctctgctagaaaaggctatttaggaaaagccagagaatacgagatgcttatgttatgaaatatcagcccagcagccttgtttactgggacccagttggaaaaaacccagattcccaagtaaataacttctctccttttcctagcaaaaattgctttaaatgatttcaatcctaaagataattttttccaagccaagtgacctttgcctcctttttatagcctcccctagaatggcctgtacagaatgtgtttccctgataagcccagagcttttccagacacagtcttctacaaactcaaatgaaaaagaaaaaaaaaaaaaaaagaaaacaaaacaaaacaaaagggagagctggaaggatcaactcctctgttcccctgtgcaggtaggaaaactgaggtgcaagatgtgacatcctctcccatctctgtggcacccacacatctgattgggcagcacagaagatggggtaccacagcctccccttctacaacatccctcatgggtccacaggagcccctctccccaccttgctgcttggagagaccatttgatttccttgtgcccctcagtggccaccagcaccaactcagtagataggttctgctgcctacttgcaaatccctttgctctccagaagatatctgtgagcaggaaggtatggccaggggtaacgagtgaaatgcagagacctggggctgaggagagaaaagagccaggatggatggcaggggagagtgctgtttctcacagcacagcctggcacaaaagaaaagaacagaaacacacacccacgttctactggaggccgcgagctgaaactgtggtatgggagaggcaatggatagggctttcaggagcaatcctccaacttctgctgacatagcactgttcccccaaatattggaagtgagggtaggaagagcaccctagaagttccatcacccaccccacccaaccatcacactctcctggtgaaaccatctatgctattccccaattatcttgtttctgtgagaaacacatatgttattctcaagagtcatgacggtacctggaagggagcactagctgtggcagcttggtgtttcatgctgcagaggtgattgttgctctgtgggccagaggtctagtgttctcaagtcgtggaaatagtgattcttcccgttgaaaacttaacacgtgctttagagaaaagagtaggagtatttaactcagagctccagcttctcaccacccctggcacatggctggcacatggtatgtcctgggtgattatttcttgagtcattggttgatgccaaagttctctactaggcaacaatccctagagattagaaaggcctaaagcaggctgtgtcctgggttgtcacctctcccctagcatgtcatagttctgaggattgtgcccatccctgaggtgttcttatgagctccttattccctaaaaactaccagacattccaagaagtttcatggatagcaggcatggcagatgattaacttcctcctgtcatttcacctaggtctgtgatctctcctgcgcaaaatgaggttcaaagaaagagaatgagaatgataatgattattgaaaagtccctcccacctctgatattctttgagctgctaagatttgaaatttcactcaatggtatcaggaggttctgctagttgagatttagtctacttcaaaccagtgacagccaagacaattctgaaatgggcactggatcttttttttttttttttttttgaaatggagtctcactctttgttgcccaggctggagtgcaatggcgcgatcttggctcactacaacctccgcctcccaggctcaagcattctcctgcctcagcctcctgagtagctgggattataggtgcacactaccacacccagctaatttttatattttttatggagatggggtttcaccatgttggccaaactggtctcgaactcctgacttcagatgatccgtccacctcagcctcccaaagtgctgggattacaggcatgagcaaccgtgctcggccagatcttttatttataacagatgccataacatttcatacaaaattccccatgattggagatattcaagtggaggcaggacaagtggctgggttgttgtgtgtgggcaagggtggctgtgtactatgggaatgggtacattagcatccaaagggtgattacaccaggcagtgtctcatgtccctcctcatgtgggagcctaccacgcaagggagaaccaggactaggttgatatgacctggcttttacaaaacccctggaggagggaaagaaatggaggcagcatgtcaaagccttgtctgagaagcattcctttctccaaagcatctgaggctctgccttacagatccccatggaccttgcattcctccatggaagcctttgttctctgtattgtgatctatttacaaataccttcctcctcagactgtgggctacttaagaacagggctgtgcttctactctttgattataatgtactctgagcaaccagcatagtggcaagagcatcatcaacatcagtcaaatgttgaaggaaagagtaaaagaatgaagaaataatcttgttcaaggttgcaaaccaccagggaagagccaatcttaaaacccaggattcccgaatctcacactatagctcttcacagtcactctgcaaatttcaaaaacaatgaaagataacatccaaactattaccctttttggtgtacacactgtctccagatttcaaggcttttgcagtagggaccagttatttaattatggtctggcctttactagtcaaaggtatgttcttgggcttcatatgttcttggacttgccaccaccgtcacccctcactgcccctgtacctcataatataacagtggcttaatataacagaggcagggctcaccacattttatatcagtgttggcttatttatggcttgagaattgcttgagatgctgaaactggccccatatgggattccaggagtagcagcagcccctccccttggggcttccgggaactacagataacttttttaatgaatcaaaataccaaagaactaaccctcccaacagttgttatccattgctcaactccctgtagagagcagcctgtggaatttgcagcattgtgatcgtgtgcaaagggcagcaccaggccctggtggtgataacaaggaggcatatttacccaacacttctcccccagggagactgtttttcctccactgcaatactgtggccctcttggctcaccctgcctggtccctgacatggctgtggaagcagatggatggaatcagagaacccgcccagacagaaggaccaaggcaccgagggagaagataatataatgtggcccttcatctcctggtgtgttcctaaagtatggatgattgccattctcaaagaatttcatgatcctgatttaaagaaacttgccaacattccaggaacccagaaaacagacagcagtcctccacagagaggcagaaaaagagacaggacgatttaaagtatcaggagcagggcctcacgggagtgagttcagattgtgcatggcaaagtcaaaacagatgatgctttagagcagtagtttccaaaccctatcacccaaagaacttgctaaagcaccgattgctggtccccaaaacagagcacctgcctcagtaactctgggtctatgtctatcaaattctcaggtgatactggtccaagagccacgccttagggggaaatggcattaatgccaactccagtaaattaggcaggataccaggaagaacttcccactgccaaggttaaacatgagaataagatcaggttactaaggacagttgtggaaatctcctgagctagagactcacgtttctgaaacggatctgaatctgttctgcttagctacaaggtaattttatctaccatggactataatcagtttcaatacaagattatggagtatctccaggattccaagcactctgctgggcactgttactggcaacaggtagcacttgcaaattgaggactggttggtttggttgtatccttgttatagatggggaaactgaggctcagagattcctgcaaggtctcacagctggcgtgaggcagagacaggactcaaactcacatctgcaatctgatcttgtcccttctagatatgaggtagggagcagaggtgcatagaacaatattttcctaaattgtacacttgagacagtgtcctacaagatataagataaaaaagaagtgattcaaaatgtcaaatggccaaataagtttgaagaaaacaaatgcaactgaagaatctgctagacttctcaggtattttaatatacttaagtgtgtagtgcatctctaagaggaggctatgtagtatttcttaaatttgaccagataatcttttatttaaaaacatctatttaaatttcaagtgacattccagttgcaaggaacacagtctggaaacatctggcatggatattaataaggcaaagaatttacacccctagcccgtgttctacttcacatacactcacacatttgggatgaatgcggagtgaatatcaggtgtgattcaaatcagattggaaaagaggattttccaagattctgcagcctttgcccagggctgaggctttaatggagagcgccaggagccccgagcagggtccagacaaagccaggtgccacagggcttggtgggcatcccctgcagcccacaatccctccagggcaggagccagaggcgtctggtcgtcatctgtgcacccccgcaggcttcctgatgtgagagacgattcccaccagaactgttagtcattccagtttctctcaatcaattattcacactcctgtttgcttgctttgagagagaggaggggggaaaacacagaaaaagccacagggcatgataaaatacaagggagaggggagaaaagaaagctggggacttttctgggctgagtatagggtagaccactagatgtgctttctaataggtcacctgcatttgtcctcttggacaaagcacacaggctgaggaggtctccttctttccctgaagcccagagaagaggaagcaggaagagggttaagagcacagccaattgcaggagtcagaaagacgcattccaggctccagcatgagcccttcatggttgtttgccttgcctgcttggataatatttgaccagctgaggggtgcagtgtagacacaaaaatcacagcccctgctgctgctgccttcaggctgtcatgcagcctactgaagtctcagtttctgccatggtaaaatgaggatggctgttcaagctcgcccggagggattcaagtgagatccaaatatgaggtccccgtggcagggacctcaaacctccaccagcctttcaccctaagcatgcacagtcaattttagtgaaaggatcaagatttttaaattgtcatgtgtagtattttgcaaatggctgctacatcatcagctcgttaataacagagagtactggcactggcatggtctgcaataattgttatcgctatcaaaatgatcagcaatgatacgctgccctttgtattcaaagacaatgctactaacacagtataacaagtgcttattttgcattgcacaattatatattgtctgagctaccaatatatttgagagagtatttgcagtatgtgtatgtgagtgcatatatatgtgtgggtgtgcatgtgtatatttatatatacatatataaacacacacaagtatatgcatacacaaatgtagttatatattatgttcatgaacttttttgcgtgtctatgtcttagtgtcttatccttatataggaatacaagttcttatgggcaacgattttcctttgtacttcttctgtatcatctttagttcaaagcagggtgcatcctttgtaggaaacccttaatacattcctgttggcagtcaggtttatcccagcagtggggaaaggctcatattgatccctccatccatgctccctctctctgaagcccactcatggcatgtgttgtgagatggccaagccaccaagcaaaccatacagcccacttgaaaaaagaccccctcgagaaaagaccccctcactgctgagttaattagctggctggctgcacacaccaggattggacatggatatttcaaagcatcttcaccctcagacttaaatgctacctaaagcattccctgggattctatttttcaaaatttattttttccaaagtaaaagtaataaatgctcattaaagaaaattaagaaaaaatgtaaataaatagaaaacaataaataaaccacacctcatcccattttccaagcacaactactgttagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaaacaaattagaattgattctttaaaaaattgtcaccagttcaaaggatttgactattttcaagtttcttcctaaatatttacacattgttttgcaggagtgttggaccagttagaattcccaacagccatgcttcaatgcacacagagccagtttcacatggaactcctgggacgtatttctgaacaactgtttataatgcttttcaactctttcaaagtccttgctttacccatccctatgcaggtgcacatggcctgttacaaacctctgcctccagaatatggacagtgagacacagaggggttgcctgctctcactaaatctccagctttgggactcactttcagtgcaagcacacagatgaaggttctcaagagccctcctgattcattccctcccacaggccaggaacctgtggcacaccctaaagagaattacactgttgtgtatcctccaggaactatacgaggtttagtgtggtggttcttagcaacagaacaaatctacagcactttcacttgttttcaagtaaccagattagcaccagtcgctaattttacatcttgccttcatacactcttgactacactttatttcccagtaagctagtagaaatgataggagcacatgacaccaagtgtttccacttccttcgccactcacctcctcctccccaccggctctatgggggaattatggaattgtgctggatagtggccatgcaggagacactgctcacgctttgttgtaaccatagtcttaaggaaaggagactggacaacaccaattaactttttttgggtgctctcctggaccagatgccaacagagcttttgcacatatgatcagctcatcaggcactgttggcttccttttctctttcccgcagaggctgggatggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccatatatcaggcccaagagataactatattccgatgggagaatcagttagtttcactgacatatacaagtgataacaccacaagagtcaaacatgcctacactccattgtccaaaattacccatgggacgcttggggcagagaaaagagaccaactacctagccaagctaagcagagacacattctccaaagtcttttttccctaaggacttggggtggcaggacatgagctatgatgtatggctggggtcacagggaggtagatgtgtctcatctgtttccattttccaatatccaaggctgacaacacactaaataagcctacacagctctgaagtttttctcagtttgatgaacagctggagaacaggagttccagagtcactgttgctctgtgggatcggggtcccgtctgtagctcaagggtagggcagaggctggtaccaggcatctggaaaagatgaaaccttagcagacttagaccatggtgcacaagatatgcccataagcctccttattcccctcctcctttctgtttacagtaaatatgtattacagttctgaaatacagtaaatatgtattacaaaatgtattaagagcctcaatatctatggagcagaactaacaaggccacagttgaagtccaaatcctgggtcaaccaaacaactttacttttgttccctggccacggatgttacacccggccccaggcacctgactcagcaagctgtatgatggcacgtgtcttagacagcaaggggaatgatcaggacaggatgcctcacctatgtccctgaaagaacaacctcaaagccccatcttaccaagtatcactttttatccaaaggtgagcatgcaagtgcatgcgcgcacacacacgcgtgcgcatgcacacatggatgcacacacacacacacattctcagtgacaagtcctcctgtggccaaccttgcccctcactaataatttgcacaaattaaaagataaagcagcttagggtcattcaataaatcataagcacaaatcaaaatctatccactcaattaaatctgaacctagctggaatcacatcgtttttgaacgctgaagtggctaatttccgaaggatgtaagaagatcattcaacacatggttattcaatatcagccccttttctctgtgatttttaaacttaattagcatttagtaaagatggcatgatgttccatagagcagcgatctttgagggattacctccagctcagaaggggggaatataaaaccaatcagtccattgatagaggggccccgtgagctgcccagcattgaaacaagcaccagaggtgggaaatggaagaaaaagaatgagtttgaaaggaatcctgccagccctgtgtccccagagtcatccccaccagtcctggcccacagtggtccaagaacaacaaagacagcctctgcagggagaacaccgggctgtgtttgcatctctgaccactcccccagcagtctggatcctgccaaatgaccgctggtcaaacacgggcgggctccagctggtctcattcctgttatgactgcacttgggttcattaacacccagccctcccctgtgggcatgcaaggcaggaagccttctcactggcttgttttgcagcctagctttttctttctcagaagtggggcaggtggtactacattcgagtaaaatcatgcttagtggggaagggaacaggctgcccaggcttggggtggacacctctggggccacatgctcagaggctctctggctgcctctctcgttagtcagcctttcctggcatacccccggtacgttaaaccgtcgtctgaaatacccagcattctgccgtggaaagaaaacattgagctcggaaaacaggtgggatgaggatattccagggacctggctcgagagcctcagcagggatcatgttccccagggttgtccccaaagacgggacacttttgtgcacaagctgcagagcatcagaaaatcttggggactgcaaagcacatcacatgtcttataggccagagcttctcaaattgttttgaagggccattctgtaaaatttcccatctactgtagatggatacttttgtcaaatactagaagaacaaattactagaagagtgaaacttgaagctgcaaaatacaaatgcattgagtatgtgctgggatgttgcatcaatatcaagttgctgtatacatttctaaatgctcactctcaatgtctgtacctatctcagcacaggccactaacaactcgttcacagagtatatgctgaattgcgctggtctagatccttgccactcaatgtgtggttcaaggaccaagatcatcatcattacctgtgaacttgcaagaaatgcagaatctcaggctccacctcacacctattgaataagaatctgcctttgcataaaattcccaggcaatttgtatgcatgtgaaagtttgagatgtgctagaatagaccaggcttctgagctaatagattataaatgttttctttccactcaaccttcacgatgtctttgagtaaaggagatactcaacgttgaagtgccttaactaagttggagagcagagggggatgtaaaaattggcagggtctgcaggctgaaatgttttatgggagttgagtaactggcaagaatgaagaagaaaagctgagaaaactgaatagcccatctgtcgccaggtaactctatggttcagaagccaccagagaattacggcactcacttgccagatccaaaggaagcccaggagagtgagcacaaagggtgagagacatttatgaatccagtattgggaaatgggcattgcaccaggatgaagcagagagcccaaggtcagggtgctggaggagacaacttgattctgtaatggagattgtgggcggcccacgcagagacagcaggatgtttatttagatcttgtctacttagctggttgactggctgcaagtttgattatcattcaccaggtctctatgccctcagccggaaccatgttcctaatctgcttggccattaagggctctctgaaccctgctctgtctccagcatagagccagagaggctggaagctccccggggtctctttctgcacctccctcccgcggcatgtctctgcttctgtctgggactgcaggccagcttcaatcaattcccaccgaccagcagcccagatcttaattaaaacattcaacctgcacacaagtgaggagagtagtcacagccccctcagtccagctgaaaggaaatcacaaggaatatgtacagattcataagagacttctatctcagggtgcaggtggggtacagccaatccctggttcccttttcggagcactcccatacacctgtcctccctattcctgtctcacctgcactgtgactgtcacttcgatccgacttccataggagttctctccccttctgccccaaatcactaaaacacagagctggggagaccctggaaactgaggacccccaatgttaagtatcttgcccaaagtcacccagccacattgtgtccctgcctgagagtaacaagaaaatgcatgatttgtaagtcaatcattcatattagtcccagtcaccagatattccaccacgatgataattttgtacttattattgtattgtaatagtctaccctaactaacaattttggttcagaaaaaaaaaggtctccttattaatgtcttttctgtgtcctgaccatgtatttttagcaatccaactaaggggttccagctgttaaactctttgaaggataagtacgtatgaagagtttcacccaattacttctcccaggggtcctaagaggctttggggccttaagttgggactacattggcttcaagggtggataagacagaaactgtctcaacctttgggttgtagaattcagggtgggatgagctcaagcctggggctcatgccagccctcccttccaattctacaagattctaggaagcattagccttcattattctattcctcaaagcagggcttctttctggcaagtcccataacatgagaggagcctgaatcccacaagccatgactggcagctcagagcagaggcgtgtccttcacacagctctggctggaagagacaacattctcaaaagaaaagggccccactgatgaccagtgatgatgagctttttttcatatgtttgttggatgcataaatgttttcttttgagaagtatctgttcatatcctttgcccactttttgattgggttgttttttttcttgtaaatctgtgtaagttcttgtagattctggatactagccctttgtcagatggatagattgcaaatattttctcccattctgtaggttcctgttcactctgatgatagtttcctttgctgtgcagaagctctttggtttaatcagatcctatttgttgtctattttggcttttgttgccattgcttttggtgttttagtcatgaagtctttgcccatgccaatgtcctgaatggtattgcctaggttttcttctagggttttcatggttttaggtcttacatttaagtcttgaatccatcttgagttaatttttgtataaggtgtaaggaagggatctagtttcagctttctgcatatggctagccagttttcccaacaccatttattaaatggggaatcctttccctattgcttgtttttgtcaggtttgtcaaagatcagatggttgtagatgtgtggaattgtttctgaggcttctgttctgttccattggtctagatatctgttttggtactggtacgatgctgtttttgttactatagccttgtagtatagtttgaagtcaggtagtgtgatgcctccagctttgttctttctgcttaggattgtcttggctatgtgggctcttttttgattccataagaaatttgaagtagttttttttccaattctgtgaagaaagtcaatggcagcctgatcaggatagcattaaatctataacttactttgggcagtaagataccatctcacaccagttagattggtgataattaaaaagtcaggacacaacagatgccagagaggatgtggagaaataggaatgcttttacactgttggtgggagtgtaaattagttcaaccattgtgaaagacagtgtggagattcctcaaggttctagaactagaaataccatttgacccagcaatcccatcactgggtatatacccaaagtattataaataattctactataaagacacatgcatatgtatgtttactgtggcactgtccacaatagcaaagacttggaactaacccaaatgcccatcaatgatagactggacaaagaaaatgtggcccatacataccatggaatactatgcagccataaaaaaggatgagttcctatccattgcagggacatggatgatgctggaaaccatcattctcagcaaactaacacaggaacagaaaaccaaacactgcacgttctcactcctaagtgggagttgaacaatgagaacacatggacacagggagggtaacatcacacactggggcctgtcggggggtcgggggctagggaagggatagcgttaggggaaaacctaatgtagatgaccggttgatgagtgcagcaaaccaccatggcacatgtatacctatgtaacaaacctgcacgttctgcatatataccccagaacttaaagtataaaaaataaaaaataataacaataaaaaagaaaaggcccccactgaaaacacagccatcattaacttctctgtctggcaaagcaagccccaggatgtgccacatcatggcccccgcttcttctctgccccatgagtcccagcccccttctgcccaccaaccactctccttcttgtttcctgagacacacccagccccaccctgcctttcagcaggcacttgcactccttgaaagtcccaaggagcttgtacttcctcacattggttgggcatgagctgggctaaggcctttctgttctccttttgtgcttctaatgttgaaaaatgatgtctgtaataagacagtaaattctttgctggtgactcaaaagccggtaagcagagaaggcagtggatgggaaggaacgcagagggcaaactctagttacttctccccataccacagcatcacagtcttagggagtttcccttttgccccatccctttcgagtaaagcaaagggatgatggaatctagtttctgcttcccctcaatgccagttagcattagtggaaaggagagtctgtgcccagccaggaggacggaagggtaccagcagctggcaggagcaggtatgtgcacgtgtgtgcatgagtgtgtgtggccatgctgcaaggtggcatcaggtaggtgacatgggaaatgcaatgcccagcatcagtctcagggcaggagaactggggctaggggaatccacttcccttcccttactcgatctcccccatagtgactggcaaagcatgttgaagaagaagtagaaactccttgcatttgtcttctgttactggggacagcttgtgctgatatgttctaattacttctctggttcacccatgtgaactaatgggcaacctcaagggatagtgcaggatcctggggctagccaaagtaaagcacccttacaaccctttagcctgagggagcaaagaatggggatgtttattggaagctgaaaggagaatcgtgtagggcagatgactttgagaagtgatcttaggtaaaggatgcagccaaccccaggctacccagcaggggtggacagtgggttaggggggcagtgctaaaagtggggaaccagtgtgaattaatctccaacctctatcctttccatcccaccagtctcctgccggggtcctcactgtcctgttcatccagtagtcagaggccagggaggccaccgaggcagactccacaatctttggagggcacaaggctctggagcatgaataaaagattcctggaatggctgggcccggtggctcacgcttgtaatcccagcactttgggaggctgaggcaggtggatcacctgaggtcaggagtttaagaccagcctggccaacatggtgaaaccccatctctactaaaaatatgaagcattagccaggcacggtggcaggtacctgtaatgcaagctacttgggaggctgaggcaggagaatcactcgaccctgggaggcagaggttgcagtgagctgagatcacaccattgcactccagcctgggcaacaagagtgaaacttggtctcaaaaaaaaaaaagaaaagattcctggaagaagcacacattggtgtgcatgggaattactcattgatatttctgtcctactagaacataagttcctggagggcagcatctatgtgccaagggcatgatgggccctcgataaatatttattacattaacaagagtatatatgaagaaatgaaggaatggaagggcatcatggagggaacaaagctaactaaccttcttgtagtctgtaaatgtgcacctgctatcaggaggccccagcctgtctttcagactcactctctgaaaagtgcggacactgtttctcccaatctgtcctcacaatctttccagggctgccactccctgagtttcccaggtctcctgggttcacagtcatgatactccaagctggcaggaggctcacccctggcaggtgatgctccaggcaggtagccgagtgccccagaggctctggcagtcactgtctggcctcagtgctcttctacagtgaggtgtggcgcagagctgagcatcgcgcattgctgtatgccctgtttcacagttactgtggcaacagccaggcttcagcctcgcctaggttgtcctggggaggatgggccgctgttggaggctacagcaatcctgtgagccacagccatcctggtcattgtgcaggtccaggcatctcaaaccagggagtagacacagacactggagtcctgctgagccccaggctggccaggagacaaaacaggcgtgatcattcacaaaacccaggagccctaggagatgccgcctccctgtgtccatctgagcacccaggccctgcagcagaggacctcctccggttggcacgaaggcgcttcacagcttcctctgcagccacgccttaccccatcccaccctaccccatgccccagccaaataaaactattacagttttattataccaattgtcagtttcctcctccgaattttctcatgctgttcctcatccttttcgctggaaatgttcacttatcctccaaggcctagctcatgcttaccttctctatcagcaacattgacccccaacacccccccccaccaccaccaccactgaccccagccccacccacccaagaagactctcccactccccattctaggctcctacagagggtgataaatcccactcccctgccagactgtgtctctcatctgattatcagcccagcacctaaggcagtgaatgggtaccttgatcatggtaccctcaagaacccatgatccagagaggctgtattggctttaacctgggtgtcaaactaaggagtcaagagcaaacagccccacatatgaacctggatttgggcatggctgattatcatgggagcacccttcctcccaacaagctcatcactcaagtcctacttttgttagctaaacattcattcattcattcatctgagaaatatttagtaagcatgacactacacaacactgtgctaagcactgagaatgcagagtgcagcaagacatagtcccggctctctagaaactcctaggctaggaggagagacaaaagagtaagtagacatggcaagggaagtggagaggatggtgggaatccacagaagaggcccctgattccatgtaagagagaaactggacatttagaggcttgaagttcagcctggatgaaactagcagagcggggcggcaccaggacactaagccatcttcagaccatggcagcagagcccaggcttgactcagaagcggggctgtgtaacaatccaggcttttctgccaacttacgacaagacttattagagattccaggcacagtggtattgagacacagaccactaatttgcaccccaccctctttttttttttttttttcgtattaactggcatctctgcctgaccttccccaatcctctgacagcctgggagtttgcctggctagcagccatccagatttctttttttctccaagccctggccaagacccaggatacatgggagagggggaagggaacagtttgtgctcatgcaaagcttgctcttgcatacagcccctgggccgggatggagccgagtttcctctgaagcggggcccagccagtagagctgcctctgtcctaccccctcgagacacccaagccgatttggtgcagatggcaccagcagatgccagtccctaggagggtccctcctccctagctaatgaggggagcaggtgaagggaccagagaatgtgatcaggagtgagaagtgaaacaaacactagattaagagttaggaacctgggttctagtcccagctctgccacaaataggctatatgactttgggcaagtcacttcacctctctgaccctaggtgtccctgttgtctgagtctgtgattctagctgtcagaagtgcaaatactgctttaaaagaaaggaaaactgggttttcacttctgctctgttgttaacctactgtgtgatgttgggtaaattccttcacctctctgggctaagattagccatcttttagaagtcacatcgcacgcaacatgcaattaaaactgagttaatgtgaggccagggccatgaatgacccaggaagaaatcatgagaatctatgaagaacctttccccactttttcccactgtccttgccctgggattctagtcatgaggaagctgctggtccacccactgcatgtgcagtcctgctctgagctcctgcccttcctcccgcactaaaaaaatctctctgcttcgccagaattctctgaggccatctgtggctctgatccaccagtcaggtgagccgtgggaccagccctggggattctcagccttcagggatcctgggcctcatcacatgcagatgtagtcctgcctttccggggcaggtgtggctgcacactccagcgaaagtgaagctgcatctctctgcagccttacagcaaatgggtagccaccacagctgctgataaacagctaggggagccattggccaaataacccacttttcacacctggaaataatgggggaaacactcaattaggcattcaggtgtaggtctggactggagtggaagtcacagcctgccctccaggctcctagaaatcactggtttgaggctgttgcaggatgacaggaccatgggttttatgggggctagttggcatggctgaggacaaggggctggctggtgaccattcaggcagaaaggaagatgaggagtggggacaagatgaataagcactttctttagagtctgaggccctgtgagaggaagaaatcaatggaaaccttgggagggaccccagagagagtcctgctgagagagggtgtcggccagataaatttgatgatgcagcactgagtgggggcacaaagtcctatttgaagtattgcaggcaggctggcacgtgcgtcccacctgtgcatctcatgtctggccatgtggcccctgacatgctgctgggcagaaccagggggaagcagcagccagttaaaccctggcacccatgcaggcagcctctgataggcaaacagcctggaagctgggagcctcaattagcctcttggagagaggggagagtattacttgattttctttgccgcccagaaaaagcaagaagtccagatgcaagtgcaatccatgaccacttgctctagaaggaatgaccaggatccccatggccgggaaacaaatgatgaagccagttagcagcctgattccaaattagagtttctcccattatacctatgcctgtacacatgttcaagacacagaaagctttcactgtttgggggtattttgttttctcacaaaatatgggcaactggtatcccaagagctgccatagtttggtgagatataaatttctggtcctttaagcctcactggagatagacagtgatgttgcctggggacttcctgggacacacagctgaacaaaagtaggggtaaggcaaatgtaccctagagatgaggagctgtggtcaaagtgatcacatcaagagaaagccttcagccagccccctgggatatccccacaatggatgggcagaaaggactctggagactcagtacagatactgaagagtatgccatgctttgaaaattggggagttcataaagggaatggggagagctgcaggttccctaggtatctatggaagtttcggaaagagatgaagaatagccaacacatatgtagcactcatataaattaactctaattttcacaacagcactgtaagataagcactatttttatccacacttgatagataaggaagctaagccacagagaggttaagtagcatgtccaaggtcgaacaactgattagtggcagggctggacttgggttttgggttttttattttttttgtttgtttttgagacagtcaacccctatcaccaagtatggagtgcagtggcacaatctcagtttgctacaacctccgcctcccaggttcaagcaattctcatgcctcagcctcctgagtagctgggattacaggtgtgtgcaaccatggccgactaattttttgtatttttggtagaggacggggcttcaccatgagatgaggctggtttcaaactcttggcctcaagtgatccacctgcctcagtctcccagtgtgctgggattacaggtgtgagccaccgcgcctggccagcagggccagactttgaacctcaggaggcttctcccaaagcctgtgcactcttaaccacggtgcagtgcaccctctccagagtgaagcaggatgctcgtttctttagggaaagaccctgccttggtgtgggaaatagagcctccaggggcggccctgccccacacctgcctggggcctagggaaatcctgccccaagatccagacccagacacctgccactctgacagctggcacagggatgggggctggggacatcacaccacccgcattctctgcagggatacccagccatccattttaggctaaaagccttctccgcatctcagccttccccaaaattttacaaatactagaagataaaagcgcaggaaccagcatgaatgaagttggtttttaagagacagtgtttaacatcaagatccttctgatgtgagtaatttggattctgatgcaattctggattgtttgttgaattatgcatcagcagcttctgttgctgtaaaaagcaccaccgtcactcgagctaatctgaaacctgcagcaatgaagacagttgggttcacagtttggatactgagatgcgtctttgatgatagtgaaccagcagaaggagagaaacagacacaagggcaagtggagagcaggtagtaggaagaattgggggaatgaggtaggattaggtgctttatttaccacacactcatgagagccccatgctgggagaaagaaaagacccaaagaggtgagcagatatcagcttcccccaaatccaggaaattccacaggatacagaaagacaagaacagagagaaccagggattcattctggcaaaggatgaagcagctcctagactgtcaaatgcccactgtctctaccacctgaaatatgatgctctccttcaagctcttgacctatgctgggggccttcctactgggccaaaggccatcatggtcatcattattaattattttctcagtgttttaatatgtatttcaggttgatatccttatttaaaagcaatagctaaggacagtatgcctatttgacgaagggcacaggggagaaaggtgatatacctaaagtcacacagctgcttagcaaccggaaggaaattggaattccagtctcctgactgccagtcaccttctcttccatcaccccaggctttgccatctcactatggaggctcccaggatctctgacaacccatcagacccactgcttaggctgggaatgccaagtcccatgcctggagcagtagaaagcaaaggcaccaaagccccaagctaagccacctagtccaaagccacgctgtgcctctagcatggtgtgtccctgagcaagttatggaacccttggtgtctcagtttccttatctgccatagacgcctgataatagttcttgcttcatggaatgagatgatccatttgaaacctttggatcaatgctaagcagaaaataaatataacctgccattttcattattgatattctcctgtgaaactgttgtgacttcagaggactgatcccaaagcctgccaggaagaccctgctgagtgtcccgctctcctgaatagcccatgtcctcactatcacaggttctattcgtgtcgcaacaaggaaccacacatccaaggcagccaagccaggagggccctgggtgtgcgggagtcagctctgtggagatgccgtccatgcccggtctgacgggaaccccagctctgcgtttctccttttcatgaagccagtgagccaaaaccaccctcctgggctggcccagtttaagagcctgggctccagggacgcagggaggcccctcagcccaattataaatcaatctagcagcactcactgaggccattgccataaatggctctaaaagctcagcctctttcggcccaataggctcagggctccaggattaatgagcatcagctgccggcaggctggtggggacagatgccgacctaatgagcacagtggcccagccctcgccagctcgaggtggacagggctgatgagcaggtgtcattgtcatgatgcccctttgccaagtgtcactttgaaagggagggctgttgtcatcaagtggcatcttattaccccacctcaggacacccacaggagattctaaaggctgtccacaaagatggcctttgtggctgccacctccactcctcagctggccctggcaccaggtttttctcaaggcctctcaaccacagggctggataagggttttagaatcctgggcatcccctcccatcccatgccatctgattggtgctgcattaaagtacagaggtccctgctagaatttccctcagtcacgtctctattacacccacgggcttcaagtttgcctggagtatttacacacagttctgcagattcaaatggattcaaatgggcgcaagggctcagcatcacactggtcaccaaagggacacaacccagtccctgcaagacatatcagcttgtatgtcagtcaaagacacaggccttagagggactgatcataagcataaaacatagcaacaacaaaaatagtcatgatcacttcttcagcatttattttgtgccaagcactgttccacgctctttatatgtgctggcttatttagtaaatgtgaatgaaagactctgaataataagagtcacgttatattaaggcagtcaatgcaggtgaaacaaaaaaaggaaagatcacttcggctgactggagaaatcaagagaggcttcatgggggaggcgggaccacactggtcctagtgcagtctgggaagagtgttccagaagcagaagcaggcacacctgggcagggctacagtgagtttgctgaaggtcacacatctgtgctttggagggcagagctgcagggccacaggtatattcaatgtagtgggttctggcatctgaaaatgttgttaggatgaaatttcaaaatcaggttttattcctgatgaaagtagactgctcttaactggggcttcactgcttcttttccatttctgtttggagtgtgatttttttaaggtaagatgtacacgcaatgaaatgtgcagatcttcagtgcacactttgatgagtttttgacaaatgccttcacctgtgtaactaacaatccaatcgagatctagaatactttcatgggcatgaaaggggaggaatgtgacctttgtgatcagatggtcccatacctacatcttctgggcatttgtaagttggaataaatcaaaataatcaacttcctcccttaccccacgccagtccacctcctacccccggagaaaaaataaaataaaattcatccacatctaaacagacaaatgcctacctagtctgtctgtgtatttgttacctttgtgccccagaaccaagcttcataccaggcacagagtgaatgatccatacgtgtttcttaaaaaaaggaattaacatcctcagattaaggtctcccaggaagtaaaggactccactttctctaagttcccatgtgacactgacaattatattttcctgtcctctctgttgagattaggaaggagtccctaggaggatgcagaagagtatccttttgtcctgtctcctacctgtcacccagactcttgtgttctctacagccagtccatcttaggcctcaaattccatatgtttgacaaaatcaagcaggtagttcaaggtgctcgtctctcctcccagctattcagcagacaaaatctgtgacataatgtaccccagcctcagacacgctcacccttctttcccaggccctgtgtgaatgggccaggccactccttgatagttttcaggcaaaacacatgagaacactcccaggaaagagaagcctccaggggtaccatccgtatgcataccacgcatttacttcctagcctcaccagcgttttgggtgtggccacagctactccccaaacctttcatcttgcaagtccctagatgtcctcctcgggaaagctccctgcgcacagcttgtgggagactgcaggctcataaacagcataagccagcattccaatcagattatttctcacttgcaatattgcacaaagagaaaaaaataatgctgaacattctgttcgtggaagaaaaaatagcaggagaaaactgtcacattgtttggtctattttcaatttcattcccgagccctgcaaatagctatctgtgcaagcaggccagaagaggactccagcgacctgacatgcacgatctcagatcaggtctctagggcctgtgaaaaagggagagacctttggctggcacatatctacacatgtgataaaattgcacaagactaaatacacactcgccaatgcaaaaaactggtgaaatctgaatggataagcttggtgggttgtaccagtcaattttccatttgtgatattgtactatagttatgcaaaatgatgccacgtggaggggagaactgagtgaagggtacaggaacccctctgtacaatttattgcaattgcatgcaaattcacgattatctcaaaaggcaaagttaaaaaaatgcgcttccagtgtctgatttaatgggactaggttgcagcctgagcatcagagttttaaaagctccctaggtggttctaatgtgaagcccaggctgagaacctttgctcatgaaggttgggaaggtgagacacacacatgaaatccagaaacaatcagcatgtgatacagtaccaaaagcttcatgaatacttgtggagcaaatcagtgaactgctgaacagacgcataaggttagaggaagtccggtaggatgagggaagacttcatggtgaagtggaacttaatcaggacggggcataagtggagaattcagaggacgggaaagggccctctaagccaataaagaagggctcagagattgtgtggccatactggggaggaggggaagaactgaacttggggacagctgaggagtgaagatggataaaacttttcataataaactggctctatccctgtgcttagacgagtggatctttcaaacacctgaaccagctctaagtccctgcaaattgccaagagcaattttcagcaaaaagccaattccccagaaggcacttggcatctctcagataagcaaaagagggggaggctggagaggcttcagaatatagtatcgatgggtataaaagtaagcagtccttgtcatggttcatgtcactttgcctgactgcacttcagctggccttagattccccagtcgagagcccagccaggtgctagaaaataccagaaatgacccgggaaagggtaaaatggaaatctcaagcctacataccaaagcgaatgcacttgactcagcaggtccctagagtaatcatgcaacacctctttattcttattttatacacaagtctaataagcttgagtatctgtttccaagcccgtagcaaattaaaaagaacaaattaagtggcagcaggagagctgcatcagacaggatcagtgacaacagtgagaagtgacaggtgccagacaccctgacggtaggcggggagacagaaagctataaaaagtaacttggggcactcacctaacatgaggaagccaccctagcgaggcacaggggctccattgtaaaggtggagaaagagctttaagatactcaagtccaagttctaaatgccttggagaacatctctttgccttttcctgttattaattagtccaacatacacacaggggagaggggcagtgtgctgctgcaggctgccactatgggaggggcagctggctaatcatcttattgcaggaaataccccctgccaaaaacacagctcccctctcaaagcctgctttctcaccttgtagcactggccactgccatcacagggtatgcagagcaaaggacaggctgctcccgagccgctcagtccatcggatcaatcaggtttaacaaggaggcatccgaggatcaggagaaacacctcctacattattaccacagcaccatcactttgcatgagacaggtctggctgggaacgccacctccagcatggacagaaactgcgtgtccttgacccagttgtttcatttcttgtgctgagcacgcccacccattgacccccaatccagagagctagtgttgaagagctcattaacaaaacacaaaacactcagctgacgcaccgccaccatgcaaatgcgtaataactggatctctcttcccccacagctaacctcaagcatctcttcttggccagctgcattgccttggctctctgtgtggttcagagccagagagggcaggctgggcagccacttccatgccaacatcccaggaggcagtgcttggagcaggaagatgagagaagatgatctctcccactacacagagcccaggtcccggccccagactcagaggccctgacgcctgctatgcctggtccacaaaagcagcagggaagggcatggatgctggcaatgcactgccccctcaggagccagcactcaatcatgttctctctaaagaatgccagtgtcccattttcatccaaatgtgaaagttgaaaaagagaagtcaggcaagggagagaggcttttaagatttcccctactcaggggaggagctggcagcgtgagcctaaaaccaggcaggcaggtaacgggagggggccctaattgctgctaaagatcacggggtaaccctgatgacacctgaaagtcttccgtggatcctcaggcacaaaacataaatcatctccctctcacttcttactgatcgcgtttgcttgctgtgtcagctgaattcccaaattggcctgggtttaaattgggacttttttttcccttcctggcctggcttttcctccactctctctctccaacctcctcccaccccatgggaagtgatgacagaggaatctgcctgcggactccaaaatgcaggtttgtggcttcactttgtggggtgggagggaagaggcagagagcagggaagagggcatttgggggcttacttcggggacaggacctgagggatcaggagggagaaagtggccatctggacccacttgccgacttttggtgtcctgtcctccttccaagtaaaccccttctcagtccccagggcagccaggagagtctgcaacagacatgctccattcagtaggggcgggactcaggaagtgcaacagggaaggtcagagccggataacgggtctgtagttggccctgctgttctggggagcagatattcacctgggctctgtggtgggccaggagacaaggctttctttctttcacttcttttgtttccacgggtccccaagcacctccataacacaggatgggtcagagcccattgaggaattaacccagaggccttgaccctaaatagctccatgagaaggctgaaccttactaaccctccaggaggctgatgtgaggctacacacaatgccaccagctctgatgggcccgcccaacacaactccaggaaatgtcccaagaaagctttccaaagaccccttttcctagactatgggggactccccccagtgacttcatcactcaaaccacaaccaaaacgatatgcagcccccttagcctttgtgaggcagaggagaaggctggtgcgcagcctccaccactgtcaccaaccagccctcacaggcccagagccagggggcagtgggcaggtggcctcccactgggtggcagaacaggatggccacacaaccaacacggcttgctggtgtcacagtgtccctgttacatggacctggcagtgcaccaggtgacatggaggccacacactacagggtagtgattaagaatggactcccaagtaagactgcttgattggcatcctaatgagcaatatgatcatgttatttaactttcccatgttttgtcccctgttaaagggggtgatagtaacagcgccacctcataggggtatagagattgagataattcatgtaaagttcttagaacagtgccaagctggtgtaggttgtgattattattctgatgcctactactactattattatccctgtggcccaggagaccagaaggtatagagggtggaaagacgaagcttcagggggagtactgcacagggtggggtactactgccttcctgtcaccccagtgttcccactggcttccccagggctggtcctccttgttgtgaaggatctgagtctgacgttctactttaaaataacatcaaggggatccattgtttcagcaaaataataagagagggcagctgagggtatgtgtgtgtgtgtatgtgtgtgtgtgtgtgtgtgcatgtatgcatgtgtgtgtgtgttggacacattctcttctgagggatgtatgttttctactccatagctctcagaagcagtttgctgaaacatggtactcccagcttggctgaaatcgggaggcagggcagtggagcctgggccttggtgattaaaagtctgggtttgaaatgggctaccgcaatgccgagttttgggttccttgtacactgatgaggcaggactaggctgtgcctacagctgctcttacttaggaaatcctaggaactgtgattccatacctgctacattggactcaccacgagatgctgagccagccatccccttttctctctgatctcactcttccttggttcaacttccctggtcttcaagaaaaacagtcagaggagcaggggccacaggaaatggagagtcctggttactgccagccttggaaagatgggtgacagctctcggtcctcccaggggaggaggtgtcggcttagcaggcctcctcaatctggagcccaggctgcaaagccagggacgctgggctgagtggatgccccacaggtcccacagcccatcacttgcagagccaggtggtatttctggttttcactacacatacccatgtggcacaaaacatacattgtgaggatgtgcagagagcatctggattccttagacttcaggttccccatcctttagggcagttttaaaaattgtttcgctggaggcctacccaggaaatcttactcacattgaaaaccaggatgaaacccaggaaaacaagtcttccccttgctacctgtaatgcactcagatatttttctttcttactctattccatttaaaagaaggttggccacagcccactacattgacttaaagccatacgatgagtttgtggccccctggcttggaaagcaccatttgagcagcagggcagtgacaatgactcaatgtggcctcagtgcaggcagaaatcccattttgcaaagggacagactgcctgacaaagtcagagtccaagtgtctccaggcttacactgcagggttaaaagaacttttcagatccatgaacctcttcacagagaaggatttctgcatccttccaatgactaattctcagcccagacagaagttggctcatttgaaagggatagcatgccctcctgccacacaatggtctgagtattttttccgtggcccataaatgaagctgacattagataagtcactcacgcacttcaagaacttcttcaaaattggagtcagttactcagctactccaattgtggcttatttcctcacttctgagatttttaggaattgagtaaactagagcgcgttctaactcacctgttgttcacctttaactctcccatctttggatgctatgggaaacccaggagcctcctgaccacatgaatgaaaagaatagggcttctcctttggcctcctagcttcagagcatctgctccctcctagccaagtatcacttacttaggcatatctgatttttatcatgtctcaaatttataaaaccaaaaaaaaagaaaagaaaaggtccagggtttacctcatccagccttctgtttcacaggttaaaagagcatgacccaggggcatttacgactcacctggaaccacacaggttgttaagagtgagggctagaatttgggtgacctgtctcccaggagccacgcaacctctctgtgaatgaaggtaagaagggccaagttcaaatctcgaatgtccttgtgcttccccaactctgcatttgcagagaaggttgagtgggcaccgagagaatcaaaatagagtaggtgttcattttgaggggaaaactcaactttctaggcctcatttaccccttttctaatgataaggaaaacaagcccaaacgggatttccactttcataagaacccttcatctcccaagtcctcatctgccttatggagtctgggatagaagggcattctagtaatagctacactgatggccctgactgatgcacctgcaaagacagatattgacgctctcatttattctggtagtcctgcctgacagactgccctaaaatgagcaggagctcattatctcagctggccttctccttaagcaaggcggaaatggcccaaccctttctgggacaccccacccctgggactcggaggccctctgaacagcagggatgagatggactgatgtggatcatcatagtagccaaatgaggccctctggtgattttcacagagaggtgtgtggcacccattttctagtgtgagaagtttctagtgtgagaagtgtgtttttgagtccattgatccggcactctggatttcctccagggatgtagatgcatcctacatgcatgcacacatgcacatgcacacaaacatgcacatacaccaacacacaaatacacacatgcacacacacttgcacacacacatgtgcacacaaattggctgctcaggtcctgcatcccagcatgccccctggaaaccaacctactttgttttatttttattcctgggactacgtcaatacatctctcctggtgtggagggtgggcatcagtttgaggggcttgtcctagtcagttgggctaaatggggccaattcttttgctttccagggtggatgcagggctttgttgaattgtgaagaatgttaaatgaaactgtttattcatatcacaatctctgctatgccacagaacatgaacttagaacacacagattttatacatcggaaacaagaaatgtctaccacattagcaaagacttaataaaatttcatagctttctagtgggaacataaattggaacaatacttttggaaaacaatttagtaacagatagccaatctttaatgtgttcataccctctggcctagaaataccgcttctgggactctagccaaaggaaatagtctgaaatacagggatttaaaaaaaaaaagacctttatgcacaataattttcatatcagcattatttataatttaaaaatgagaactaacttaaatataaaacagtaggagagtgggtaagtaaactacaatgtatttgcataatagaatattaagcagatgtttaaaattatatttatgaagagtttacaaaaagtggggaagttagttgagttacaaggttcactgaataggcaggaaaaaatgagacatagagtataatcttatctatggaaaatgattaacataaaacatcgaaaggaaatattaatgatagctgcaggcggtggcattctgggggtgcagtttttacatttcttatagatttctaaatgttttaaataaacaagtatttttcaattcttttttagctttgaacacaaaaacactttatttatttatttatttatttatttatttttgagagagagtctcactctgtcacccaggctggagtgcagtggtgcaatcttggctcactgcaaactctaccacccgggttcaagtgattcttctgcctcagcctcatgagtagctgggactacaggcacgtgccaccacatctggctaatttttttctatttttagtagagatggggtttcgccatgctggccaggctggtctcgaactcctgacctcaagtgatccaccagcctcaaactcccaaagtgctgggattacaagcatgagccactgcacctggctaaaaacacattatttataaaaggaggtccagtcacatctctcccattacctctgcagatgactgcagagaagtgccctctctgcctgcctccctcccgccccccaccccatgtcatcttctctaagaggaatgcgttggatcacatgatctctaaaacccactctgctctcacattctgtgtcttgaaatatcatccccctgtgtttgagactgagaatgggatctcaaaaaggggtccaagcagcgaaactatgctacaagtaaaacactgtaatcatcctaacaagacatggacttggatggtcttctagaagatgcagctgttcttttacagtcttcagagaaaaatgctgacttgatgtccttgggattgaacatctggagccaaacatccaaattaatggggtcgcgggcagctgccctgtgaagccagaaatccaggttagggaggtgggggctcagctctgtgcctccatccaggccctagctggagctgaccttccagggtactgcagtagatggcttggtggcccacacaggcacagcaggacagatcccatgtcctataaccccctatggcagctccagccccgagacgtcttcccttgaccaaactccatgggattctttttgtccgttatgagcatggggcaccttcttacaaatcatctgatggtctcatggtttccagttccatttcctcaaggacattgtctgtcaccccttgaaagtctgtccctccttcgatcatcccagagtggttgagtggttcacaggggaggggaaatgagaatccacacattgaaccagctccccaccctggatgagggggttaattggatttttcactctttcaaggtggaattccatgatttgataattacatgggactgtatctctcccctggactttggccatctttcccaccgttcagagaaaatacgacttgtttctagacctgatattcatccagcatgcaccaggatggatggaagataaaatactgaaatgtttccacactggttggtaaattaccgtcacctgcggatacctcccctgtagtcccaacaggctggctcgtcctccgggagatcccccagtgacctccctaagatgtgtcacctaaagggttaatgcctggcccggcagggggcccccagactcttcacccagcattaagtctttgtgcccttgaagtttaaatattttgaatctcacctctccctgctccctctttggaattgagtcccttgggttgagagaagctgactgtagttgcctgggataaccacgatggctgaaatgtaataaggaggaatttaggcttggatcctcacactctccctcctgcttctaggggtgaaagttgggggatggcaacagttttgggcaaacaggtaggaaagggaaactgtgcccacctccccgtgcccccctcccccagcccatgctattctcagcattcacagttcctctttacagacaggactgagaccctctgagccagcactgtagaatcccagaagcagcacagtgccttccatctgagcttctgaagtacatttcacacatagcaccttcagaaggaacaggaaggagagacacttttcctgacttcgcccatgaggagaaggaagcacagagatgtgaagctgccttgtcactcgcacagctgagacagacccaagcctagccttcccccctccacagggataaccgttagaactgccaactctgtcccaacgggcagtgaggagatctgacaggattacgtcatgtgctctgtaactgggagacacatttatgagctgacaaccagagaggctggtgtcatagaggaaggagggttaccaagtgctgccttttgataataaaggtttcgtctgtctaggctgcctgtctccaagcactctggccaaaaacagacatgcaatcactcccctccccaaggcgctggtggggaagactgctatcgtttatgcttttactcatctccatcaggaggtgtggaaggtgccacaaacctgcctcgactccagctagttccccttctgacggtgcacccacccatctgtccattccccacagcaggctagcatccattctaggtggaaactccactggaagcccaaacctcagacgtgagccccaggagataccagcctgtacagcaagccccagtcctcagtagcatcttttagaaaaagttctggtgctttggccatcatcccgattacgtttgcccatgacatgatccggctgtcatggaataaagaaacatgagggtttcaatgcaaggaatgtttagaaatagagaacgaaaagaatgtgcttgatctcatgttttcactttaatgtattcagagctggcagagaaagggggacatttaacttctaattaatgagttgctccatgtgtccaaacaactctcccatctcttccctcactgcagatgaaagcccaagttctcttggagctgggtgattctctgtgcaggttacatttccccagactctgaacgggtatcttccaccaatcagattgggctctggcacctcgccacctgttcgggcttcaccctggaatccctcatcagcagccacttctgatgcgtaattgacaagaccatagctgatgaagggtatgttacgggcttggctctcaccatcaaatctattttcagttgaaactgctttgaatttactgacaccaaagagcccagaaggtaagaatgggctgtcattgccattgttacgattgtggctgtttttggaaacctgggtcttttcaacttatcacaaggcttcagctaggccctgatttcaacttctgccaccatctgagcacgagccttctgagtccaaattccctgtatatgttgatatcatctcagtaaacattgaggaacaaaggacatgaagaaatgagtgtcagtccgtgtgagggagaagaaaaggcccagaaattctggcatccccagttcaaattccactcttcaccaacttcaccttgcatttccacaccacagacttcccaggagcttggtctctcattcacatcgatatttatgcttggaatgtgaaggatcccaaattctacgtccaatcacatgttcacatccctgaatgctctgaccaccccagacatttctgaaatggcttagctcctgcctgcccctccaaacttgaccaatgccctctgcctcccttcatgaaggtctgtccacagggagcctttctcaggccctcaaaggtgccgagtttgttctccacttcacaacccccaggtaggactgtgtcctcgacttagaacactcttcccctcacctcagctcctcacattctttaggtctcagagcaaacattccagccttccattctgagtagacccccaaaacttgattatcctctatttcaaaaccctacttatttatttcaaagccctgataactgtttattattttatttatttgtttggtttttggcatatctccccctccagacctcagctccatctgttgaatgaatgaatgaagttgctagatgaaatggtatgcctactatgctccaagcatgcttcccatgctgacgatacaacagtcaagaagtcaggtgcattgccctcatggagccgatcaccttgcagacagcgacctgcaggaaactgaaatcataggagacttgggcaaagacgaagggagcaggaaagaggcagaaggaagggaacagcatctcgtgagctgacaacgaaatcctgtataaatatcacacaaaaatctattagtgttaccagcatagagggcaattgctttttaatataataagatcttccttggaggcgattatgaggcagtgataaggatcaggtgacatgttgaggtttggcacagatggattaatttctgtttacatctagttgttggcagcatgggggagttcttcgttttcagggaggaggtgggaaagaggacctctggggaaagcagccaagacacaattcttgtaggtgttattccagagagctcactgcttgctgtggatcccagagtgaactggagagaaaaccagggcctggagcaccggggagggacctccatgcaggacacgctggccaagctttggagggacgacccctctcctttcctcctaaaccttggggtgccatgacagaggtaaactattgctgatgtggagggattagtgactaggaaacaaagatctgaggtctttagaaacaaagtcacttgatagatggggggtggagagagaaggaaggaggaaaatggaaaagaaggcatgctgttcttatacagttcattcccgacactgtctcaagcattaacactctcattactagatactattcttccctgagtgttacacagaggtaaactgaggcctgggcaagtccaggacagacccaatcgtactggaacagagtctgcctccggactcgctgcacaggcacacagcaaagcctggaagcaactctgaagatttcctcgatggggtctttccttccttccctggagcagcccaggggtttgcttcactggctgggcctcctgtctccagtaactcctggagtgaacaccaaagtcccccagcatcaagacaggggcacacaaccaggacaactctgaccctggagccagggggctgtttattccaccatgtggctgctttttccaacatgtgacagatgtcacgattattctgccaccaaagaggcaccctctgccactcccctaaagcaccaaccccaacagacatggcctcaacctaaacccaactcagagcaaaacacaatggaaaacacacctaagcaattcaatggtgccttacaaatggagttactccacggttctggttgcctgaaactgctggtttatgtgtgtggcccaggcaaaatattagcaatgccctcttttactttttaaaactcttccagtttggaaaataaattccagggtcttcctacttgtgatgtacctggaaacccatatattatggaatctacatagagatgatgctattttagagtatatacacccatgaccactatacactcctcactcccaaccccatatcaaccatccagtaaacaaaactctcaacaccccattcacaacatgtagccatcaagctgtgctcacaaaaaaaggtatgcactccgccaccagtcatactcttacactgctagtcactacacaagtctcccaatcatggcagatagagctatctctcttccactattcgggcctagacacgactacacatatctcataatttgggggagcactgggacatatgcacccacttggacatccatccaaatcagccttcagggattttaaatggaaaagccccggttgctgtaatggctacaaccttgtaaggacatgagtccaagttcattaagaagctgggtacagatgaaccctgttgctgttgtgattaataatcataatagacagtcagctggagggcttgccagctgtgccttccaggtcctggttctgggatcccctctcatccaccagtgagtaatggtttggtttattggaaactctcttttcattttttatggcttcaattaagcgatggggagaatccatcatgtaacctttttgctgcactgctaaagacttccggaggggaaaatatttatcaaaccccaaaccatcagaggagagactgcggtaaacctaacaggagactggggtggcagagaggtgaccgagatggtagggaggggagaaaaaaatatccacacagaggtttgatgcttggacaagagccatactctctgtaaaatatctgcttatttcacaaatatcaggctactcctcacctcacatcccataaccacagaaagtactccactgattatgagggtggctaattaatcagcccccagtccccagtcatgtggattcctatagcccaacaggttcaaggtggcaagaagaacagagacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaaatcctctcccaaatcaatccattggaatccacaacctcctatccttggccctacacaggcccctaccctttccccgacctctaccaggcagccctgctggtaagcagagccgtctcttattctgcccttcaaagtattcacaccctaatcttggccactggcattaatctttcatttgctatttagacatctgattcctggggcaggattgagagatgtcccttgggagatcaagttggccagaggggaggtccgaagggagttggcggcctgcagagcaacaagggcctgcctggaattaatggggtcatcgccctgctccccatcgcccaaaggaggaggagccacagccagaagacacagatgtctgaagaaatgagattgcaggtctgtctgctttataagacgtgtgtgtgtgcacgggtatgttcacatgtatgtgtgtgcgagaccagggatatggcctctcagcttgtgtcagtgtagctgctgttaggagatttgtatctgctctggtgcagggaacagaggtatcaggagagctgggcaaacagataagactcaaataaaaatgatacacatgtgggccctgggagacggtattgtctccatatgctaactagtaatactacaggttagatagtcagcctgcaaaacataactctaataggagatagatggtggaaatacacttccctttctccctctttctcctcctcactctcagctaacctttatcaacacaaagttccagggactgtgccaagtgttctttattaattattttcatcaatacagcaaacccacaaggtaggactatcagtacctgtattttacaggtgaggaaactgaggtctggataggttaagtaaactgcccaaggttctgcagctagtaagtggtcaaggagaattccagccaaagaagtttcactacagataccaaatttaaccaatgatttaggaagaaatgaacagataagtttgatatagactagagagcactggggaaagaatagattatagctatgctgtctgataaccagctactcgtggttctttaaaattaaattaaatttaagttaggtaaaatttaaaatctagttccttagtcatactagccacatttcaagtgctcagtagtcccatgtggctggtggccaccagaatgactagtgcagatatgaatattgccatttttactgaaaattcactaggtaacactggttagaggataaggctagatgatggcaaatagaaacacttttcaggataaccagctggaggaaggatggcattaacatgtgagttcttcccatctagaaaggacaagaaaagggtgaagagcaaagaggagaacctagggcagcatgacatggatcaattggttgctgttattaacaagtgagacttcaagaaatgccacagaaggaaggggccttggagattagcatattcaacctcttttcatacattacaataaggccagtgacaactggggaggccaatggcccaggtcacatagccagttatgtcgaaggctcttcccatcccacccagcctgtcattctgggtttttcccatcatcctcatccttgatcccttctgagatgtgcacagaaaatatcagagtactcagaggtgatttccaacacgtcttcacactattatgactcctgacaggtaaatcactagctgtattgctgcatcttcctttcttataatggcacagggctgtccaagaatgagacattgaacatttgtaaaatagcagcaattgaaaagataaatggcaaacctggagtttgggaagcagcccagtaggactgtcttcctattcagtctcagtaaatacttcttgaataaaccaatggatgtttggctggatggaagagtggatggatgacacctaacagttcttcaaccactttatggactagtgccccattctcccacccccatactgttcatcacaaactcacagttgcttctctacaagctactaaaatggaaaacatctcagcatgtggaaaaattcaactgcatttcagattctagttaaaaaaaaaaagtgactatatcctgccatgcctatataagtcctgcaacggaatgttgctgaatgccttcttgtctgcactagaaattcacactctcttaagctaagtgtatgcccactctacagggactcccgcttccccctggcctcaaagatcattacctacctctttgcgtgaggccaatccatcctcttgacagctcacttaccacggaccagggctgtgggggagcctctgacagccagagatgaaatggcagaaagggctccttgtctggacattcttgggcatctcctacccgccacattattgtcaccatggccaagtgtgatccctgtgtcatgaggcctgcgcttaggattggggctgcctcctctgcttcttcctagacccttgcttcgtggttgttccctcaaactacatattcagtcacttaaatgacgcaattgttttgagactcagtgaaaaatctcaggatatagactttgtccagtagataaggaatgaggtaatgctttagttcacaaattccttgagggcagagattttatttctgtatcttttaaatctgaattcccagtgtacagaaaaatgccttgcacaaaataaataagcaatacaatagattaatgaatgaatgtatatatgtgtgtgagggagagagagaaggagagagagaaaaagactgaaaaggagagagagagagaaagggggagaggtgggggaggaggggagagggagagacggagggagagagaaggagcaggagatcaacaaatgcccaatctgttactctggtttctgcctgggctgctgttatttcatcccaggaaagctggtttactctttggtccgtgggtctctgttctctttctctctgggccccctatctacctccttagttttgtggggaaattgctttctctgcaaccacctggtcctctaaagactctcttcttaggtcactttggtttatttggacaaaacgcttctaattcattattcctcctgtggaagactttttgagtttatttagaactagcattctgggcactgagtcttaatgaccatccacagacaagcacctagccaaccaaccccagctctttgctgagtccttctagactcttctgcagctctggcacaagcactgcccttcttgttgctgctgtatgttttatcttattttttaaaagaatgattacaccccttttccaggctctaaagtgacctgaactcaggaaaggttctcctctccatccatcaaagttcattcatccctcccccaagtttctccatgatttctactccagtccctcagactccagtggcaaattcacctcaaatttttggagttgtgattgctcctgttttccaccataatatcaggattgaaactttctgctgaacatagttccttggcctcccaaaactttccagatcaagatggatccagcccagcttagctctcaagtcctagaatcccctgctcagacaaagcatatcacatcctaatgctctgtgtggagggatgcctattgttaatgtctttgagaacatgaagcttggctaagaactggttcacaaactcactgcttgaaattcaacaggcatcctgggcaccgcctggagaaaggaagaggaaagcagggagctctgctcagattccatctctaagaccaaggcagaggctttgtagaaatcaatggttttccttccattgcaaagggggcaactggcagtgacgagcagaagggtggagcagggggtgtgggaagaagaacaaagagtaagcaggaggggaagaagtgagaggcagagggtgtaaccatgctcccatcctctacagattcttccccttcacttcctccaggcctggattcactttcttttttaatggctggggccagtgatttgttcccatcgatcactattgatgtttttcaattgtatccgtgacacttttggcaatatgtttgtaaacacagagccttctgggatctcacttcttgtcaccacgtacaggcaccgtctccttgtcactgagtattagctgtcaatcaaagggttgggaagggagctctgtgtccttggtcctgggacttgcttctttttgtctttctgcctggaagtgaacattcctcattcattcccagagggaaaatggaaaccttcctctttaagtgggagaaaattgggcgagaacaaggaaaggtttctacctggggccaggcatcgtgtcctgggcagaggaaaccacagttcttctggggagaaaaatgcagcagagaatcttgtacccaccagtttagcttggatctgggctgcaggagcagagaactgctcccttgaccacaggtagctgagcagcctgcatccaaatttcatcccagataactgggtgaacaactagaaatttcctgggttcacctagacaaggagctttccaacttttttgatcaagacccataagtaagataaataattcagctcatgactgagaatacacatacatgcttaattgaaataaaagttaaaggaaataagaaaatatttaaggagaaacacagccttacaacaagtgatacactctgatagtttctgtccattcttctgtttttcttttttgaattctggtcatgttccattaagttgattcatgactgcctgctgtgacccacagtttgaaaaaatactggactagaccaagggtcagcaaacttttctgtaaaggccagataagaaatattctcagctttgcaggccatatggtctctgtcacaaccactcaacatttccgttgcagcatgacagctgccacagacaatacataaacaaatgaatgtggctgtgttccaacacaactttacttatgtacagtaaaattcaaacttcatgtcactttcatgggctatgacatagccttcttttttttttaaatcattaaatacggaaaaaaaatccttagcttatgggctgtacaaaatcagaggtgatctggatttggcctgggagccagagtttgtcaccctctagaccacaccacatcaaccaacgcttgcagcatgttgccagtccttctcttcaaggcttctggcatctacaaataggtgggagtgaggggatccccaccaacctcttccacacctgcccacgagtcaaggtcaagtccacattgctcctgtgcctctgtattagagcatgaattctaatgtatttaattgatggtctctgttcccctgaactgtgtcctccaagaggatgcacttcttgtatcacacgtttctcactctgccttgaaatgtctctttgcttgtctacccatgggactgtgatccagtagattcctgagctgctggtccaggggacagcaagagagcctctgccctttctaatacttttcttggctcatgcatagaatctatggctgggctcatcctctggtgctccttggtacctagcctcaggctccagcctccacagcctcctcagctaactaaagccacagggctcccacctgccccacaggtgcctctgcacaacaaaaagttctttgcctttaagcacctgaataggaagaagaacactcagttcttttcaaatttacattttaacaatttttttaagtgtagagttaagtggtgttaagaacattcccattgttgtgcaaccatcaccactgatatggtttggctgtgtccccactcaaatctcatcttgaattcccatgttttgtgggagggacccagtgtgaggtaattgcatcatgggggcaagtctttcctctgctgttctcgtgacagtgaatgagtctcacgagatctgatggttttaaaaacaggagtttccctgcatgcactctcttctcttctcttgtctgccaccatgtgagatgtgcctttcaccttccttccaccatgattttgaggtctccccagccatgtggaactgtaagtccaataaacctctttcttttgtaaattgcccagtctcaggtatgtctttatcagcagtgtgaaaatggactaacacaactgccatccatcttcagaactttttcatcttcccaaactaaaactctgtccctgctaaactctatgatcctattcccctgtcccccagctcttggcaactaccattttactttctgtctttatgaatttgactactccaggtactttatgtaggtggaatcatacagcatttgtccttttgtgtctggcttatttcacttaaacctcatgttttcgaggttcatctacattgtagcatgtgtcagaatgtccttctttttaaaggctaaataagagaacactcacttttaaaaggtggttcccaaattgccctagaatgtaagaggagttttaacatatgacattgacaacaaactctcttcatctcttccccaacaataccaaggatggatctcactccatcttcttatcatcactctgcccctagaaaattcccccgttctgctcaccctctctgtcttctctactatggtgtcagggcaaccgagtgggctttatttatggctgacatccctgaatttaaatcttagctgcttctttactttattgctaaagttttttttttttaccacagcttcagttacaaaacaaaaataactaccttctatataatgactgttgtgaagaagaaataagatgaaagatacaaaatatcaaacacaaaacttacaacttagtgctcaaaatggtaattattattattatcccaattaataatgttttccagggtcacagtctggtcctagtatcccaaataaaccctagagatccccaagagcatcccagaacctcttttttgagacaccaatttagttaccaagagtatcgcagtgggaaccccagcttagaactgagatgtcaaatacatcactgcttcgctgcaaccctgggcaagccaatgtctttctgtattcttcaccctccttggctgtgaaatagatcaaatgatgcttctaaaattctcccaacaatgaggtaatgtcttcaaagtgccctgagcctttcacagggaagtcgttgtcaaatagacacctgtagtcacagaaaaacggttatactctgggaatgatttgctcagttggttaccgaatggtctgagtctatgccttatgcaagccccaccctaggagctggaaaacaagggtgaacatgtgagcccagcaccctccttcaccctgtatggctctgcatggatgggatgcaaagaatctgacttcctgcagaacaatgggtgccttacccagacagaactgatctctcacctcagagagcaagaggggagaagatgaacatctatttgggatctactgggtccctccagattttctacagccacaacggcatttaattcttcccatgtatgtgcacacacagagaagcacggaaggatatgcaacttacccaaagtcacacagctggtgcatcattaaagctgagatcaaaagtacggctgccgacttccaaaatccatgaatgtgccacccttccaagcagccatgctaataggggccatcgtaattgtccagcagtaattcatccagagacagattcgtgttggccatatctaatggcctggctctcggtccccttctgtctcctttatgactcaagctaattcacgatgtgcttagtcagatgtccagttgccagtttattgtctattaggtttgcagagggaagggaagtaacatttgctgagcactttccaaggcccaggccctgttccaggagctcctggccatacataatctctcttaatcctcataatatccctataaagggggtattattaccccactgggcagaggatcataaagattaagtaactctggataaccccagaagatggacaaacgtgctggcctagcacctcgggaaacctctgaaagcgagatctgccaagcaaagcctcccacagccgagggagccaggcttctccacctcatcagaggcagagagtcaagggagagcagaatggatggtgtggcaggttctgattaagaacattcatcatccctgccccgctagccccttggggtggcatggaattcgttacacgactcctgaaccgtgttcatcctctccagcctcctcctgtgcgaacaccgtggaattagccaggaggggtagcaaagaaatcagatctgccctgcggaggctctgcattcccagcactgtgctgggtactttgcattgctcatctttcacttttacatcaatcagatttagtccatatttctattttgcacaattcatgttattatttcatttaacttttcccaacctgccaaagcttacgtagtgaagggacgctcccaagtccactcagctgggaagtggaaagctaggatctaggccctgttctgtcctccctcagggctccaaacaatctgtcacactgcagcagagagaatgaaggggtttccctcttcccattttgctgatggataaactgagtctgagagcaggaagttgcagagagctgcagagatttggggccagaatatcagtcacatgtatgcccatccagcttttctagagatggtcatgaagccaaagaggggaagtgacatccttaataaaagctcatttcagcaaaaaagctgaggaatctgtttaattgatcatcactcctcccttccacaacagcacagggttttaaatgggactgggctccctgtctggaattctactcctccctgaaatgatccgataacaacagagctgattgtgactggtcctccctccccttctctctcctgcagaatgtttttcttcatccctgttttgtgtcttcgtaattgcgttactcacatagcaacacatggggatggccacactacagccaccaccatcggggccacaaggagaaagcaacagcattctaggagaacgcaccactccccatcaggcccccttgaaccaggcggggctgcatggaggtcaatgcctctcagggctgccctcccctctggatcagctcccagaacatgccctttgcctctaaccacgagcaggggtcacctgaggcccttgattctagccccactttagctttcccacagagaaggctgagacgttgaaaggcatgagcccacgcctcctcctcgccagggtctcagtgactccccagccccaggaagaggagcagggagcccctcacccaacatcaggcccatgtcttggaaacgcaggggttgtggattcacatgctggtgctgctggtctgccccccgctccctggcctgggttttgctccatctctgagcaacttttggaaaagaggcagatctaggaaatccataccaagtcccaatatactctatggctgaaggggctgaggagggagctcagctggagagccctggcccaggcccacaagacagtagagggggcactgctccttgtggacgtccaaccaggctgatgtcgtcttcatccttctgtagggaccaaaatcttggtggaacccccacccttcctggcaagtcaggaggtcagtagaaccccccaggccagcattcctttcccagcctcattcctgcccagggctccctgtgacctgcccctcccccatgtgaggacactatacaccctggatactgtcccctttccattccatttgtaattgtccctggcagaaacagcctccctcaaatggtgaattctcacataaatgtttggggtgatgcatatcccagttacccagatctgatggttacacattacatacatgtaccaaaacatcacattatataatcaataacaattttatacataaataaataggaaaaaaacgaggttctgctagcgtgtggtttggcagctgtcaaatcttgtgctagagccgagtcctgaccatggtgtgccctccacgcatcgtccagctcacccatcctcccaggaaggccacccctctgctgggtgtcagcatcacggcacctgggtgggtgagccgctcactgccccgccctaccccagctgccctctctagccccactgtgccacgtccccttggcaaggccactgtctggagtctggaacacagaaaaccattcctggaccctccgcactgccaagtctgtaaaagagcaggcgcctagcctctctccttggaggctcaggccatgtcaatctcttctacgtctccctagtgccaagataataagggggaaagtttttttctcctccttccagagtgcagaccaattagcattttttaaattaccattggagaaatacacctaattagccactttaaaggaaagctttaaaaaaaaaagtcataaatttctaactggccacagcttggagacacttttaaagctaattgtgtgtttctggcactgacaggggaattggtgaaagtaagagaccgattttatgaccttggtgggaaaggggaggggaaggctgaatgacgtccttaggccaagaaagggttaatgtctgtctcccggaaccccaggcccctcctggctcctcctccccttcctcaccctccctcatcagatccccacctctccccaccttgagccctgccttaccccagtcaggggtacctgccttagaagaggcagacaggaaggcagacaggcaggcaggcagacagggccacacactcagccagaaaatcatacaaggaggaagaaaagggcagaggacaaagagagaggagaaggacaggggaaacagagaagaaagaaacatttgaggaaactgagagaaaggaaccaaagccaaattccagaaggctgtttctcatttgtgcttcctattaaactctccatcgaggtgggggcgggagctgggggctctggcctgctcttgaacatggtgcctccctcagacagttccagtggaggcagacaggggcttctgcagccctcgggcctcctgcccaggctccctgaccctgctcagtggccccaactccctgtccctgaaactgagaaaactcttcataaagtgcaggcacaggactctggggtgcctcatttaggaggaaggtggcacagggcagtttctggttgctcccagcctctgccactgctgtggattcattcctgcctcagaaaaggggaaagagggcctctcccagggggagatcagtgtacaactggaggagtgtcaagaagtgcggccaagcaagagaagatgcccagagcaactgcacagggcctccatcatcctgcagagcccaccgccatggctcatcagcccttcaatggcccccggtgatgacccagtagagcggctaaggtgatgggggtgggggtcctctccctcaggaacacccctccactggctgggttgccgggcaggagttagggtaggaacaggacagtatagatgtattgtctccacctctgtctgaggcacacagtgtgaccagcgctgtcatgtctgcccaaccctagctcagtgtcatgcccacctgacactaggtgtggcctccctgttggttgaaggggcagcagcaggtgtttgcattctatacatggaaacttagaggcccagaaacactgaggcaaatttgctctagtagcagatttagtaccatctaaagtcctgggaggcacattcttcattcactgagaccctcctttctatagcttaagtgagagtctggagaaattacagacagtttcaaaacatatagtcttctggaaagcccagaacatgcattctcaatgggtacaagagtgctccccagagggtgaaaattagagggcaaaagaaaaaaaaatcttagatataatgatttgtggccctccaaaggtcaacattactcaataaattcacatgtcgtctcattaaagagaatttaaattaaatttaacttgtctctaagggggaaaaggtgatttttaaaaagctgagaaatgctgacctagggcagtagcccctagagtcctagagtcccacaggccagagctggatccactcacctgtacccccttgggaccaagctcagcatatgaaacaagaaatggggcccaggaggggattcttccccagaactagtcagtgactcctactgaagacactcacaaactttaaaagtggtgggagacttgagcaacctagcagggcaactgggtaagacactgcaatgctgtctcttctgccagggcagagggaagagcttctgggagacaaaagaccttggggcctcttcctgctcctcaccccagaccttaaagccttcagagaaatggcgcactggacgtctgagctccaggaggttgactgagggcaggattggagtgcagggctggaaggattcatgaccttaaaaacagccaggggagctggggtgccccaagtagaagactagggtctacagcgccccatcagagcccctcacactcttccttttttcctcccctctctggttccagaggctgggaaagagggaagagaaataactacacagcagaatggacaggcccccacccacccagtcataaactcatgggtgacaattgtgggggccctcacctccacccctaaaagaattgaacctgggctagctcctctaagcgagtagtacagctttcagcctaacaagtatccatctttactggcagcttcaggggctggtggaaagagctctggggtcagacctgctgggctttgcacaccagcaagtcatggtctgactgtccctgtgatcttggagagtctggttcttgggaaggggctctgacttaccctattctcctgcccgatgccttctctagaacccatcatgcactacgtgcttcatacatgcttgcagaatccaatgtgatccttcctttgcaaatgtttttgcaaaaggaaaatggaagtgaccatctccccgcctcagggggttgttgggaatgttaaagagatggtgcggacatgcagggagaacgtgtgcataacaggcaaggtgggcatcccctccacatcccctctcctctccccttgctagaaaacccatatgcttctgcaaagcaggtgagacgaggcatgggggaggggaggacatcggcacagacagggaaaccaagggacactgcaggaaagcctccaggtgacatgggaggccccatgtaccccaagtgccctgcatgagctgccttctgcctgcccccaccagagaaccctgcagtgaagggacaaattcctaatagcggggacgtcccaggagggtccctttcctggggctctggcccaaagagccagcacctttgatgctttcccaaagatctcatagcagggaccccattctacccactcaggctgaaatcagtgggaagtccctatgctctccccatctggctctccctagctttctgggggtgatggatggctcaagagttgcaatttttgttctgttaagaaagcacaaacaatccgatgccaggaggcgaggaccttgctccctgttggcgcctggtgcaatccccagggagctctaccagtgtcagcagagaaagggaaaacagctgggtctctagggcccgagagcaggcgggagatttattattttggggtgattaaaccgaagcttccaacacctcagtgagtgtttccttcttgctacccctgctactcagacacaggaaccgtatggggcagcctggctcccggtggtcccctctgtcccggtccttgagaccactgccaagacactgcctccatcagacggccaagctctggccagcctccaggtcctcgcctacctcccactccattccctgtctgcaattgtttccaatcagtttaggaaacagctctgagaacaattagaaaagataacgaggaagaattacataattacagttctcctagatctcaggcacttcaggggaaaagaaaaaggctgaactgagtccaaacagggaccaatgtgaggaaaagatggtacttctggaaagctttcggggtgcaagggcttagaccctgaaggagagtgggaaggacaaaggcactcctatgtctgcctgctggtcagctgggggctgcctccagctcagggcctcaaaggacggctcagaaagtcctcatgcaatgcagacctctctgtggaatagccatgtagactacagaaccacgtcccccttcaagatcatgcagcccaaacttctcattgtcaagatgagaaagaccaagagagaaaaggtcttgccccaagccaacagaactcaggactccaagccccaggccaacactttgtccatgtgcaggctccttaacttctgtctttggtccctgggttacaattcactggtcccacccactggacagctgggaaattctaccttcttgaccaaaatggatgggtataggaagaactttgccctctagagtaaagatgggcaaacttttcccaggaagggtcagataaatagtttaagttttatgggccatgcaatctctgtagcaacaactcaactttgccatcacaccacgaaagcaggcacagacaatatataaacaggtaagcatggctgtgttctagcaaaactgtatttgcagacactgtaacttgaatttcatattattttcacatgccatgatatattgttcttttgatttttttcaaccatttcaaaacataaaaatcattcttcacttgtgagctataaaaacaagtggcaaacaagatccagtccatgggttggagtttgccgactgttgctctaggatgttgctagaagactttgtgcttctctgattattccacacccagagtttaaccattccttgactccataaacccagcatggtatttagaacaaggcttgatggtcagtcttttctaggtcacattgccgtggtaggccaggctattaccaactatgcaagccctcaggaaatcatcctacgaggtttactcaagacacctctgacgtctgtgagaacccagtccccaggagcagagtgggcagctggatgacagctttccctagatgggcaaacaatccctccccagaagaatatggaagaggaattgcgtctcaatctgcccctctctatgcagagggtatttgtggcatatgaggtaataagagaccaacatcctgagtttctatgcagcacaacctaacttaccactgtcttctcctactgcctctccgtttagcaacagggagtaccaagtatcttcattcattcaaaaccagcatattgagtgaatgcctattctggcatcatgccagaggaaaatcaggcacaggatatcagacacatacagacatcaagtctctatgcggttagtaccctgacagcagggacattactcctcttctgcacccagcacccagcaccgcatgaggcacacaggagaagctcaggaaatgctgagtgaattagtaaatcaatgtgcaagatggaaatggttaagtagcacaaggcagatcaaatcctatgcaagcagagaggagggagaattaggtccagctgaggaagccaagaaagggccaatgacagagggggcagttgagctaagcctgacaagatgagtcggattagggtatgcacagttggggcacagagaaagaggagagaaaaattccagccagaaagaacaactagcaaggcatgatggtgtctataagaacatgcatagctgaggttgcagtcttcatgcctcttgaggagtaatagcttgagtgctaacaacccagagttaagctgtttctagattgttgagggccaagaaagtcaggcaaaagagtttaaacatctgtaggtggtaggaggcattgaatcttctgagcaaagatggttgggtggcaatgagattaggaaagtgaacatggtggcagagtacataaggactggataagcaaggagtctctttaaagaaaccctaaactaggacaggagcagcagcctcggccacaccgctgggtgaagcggaagagtggctgtgggccagcgggaggaggtgggacttgtaaagtgattcatggttatgagtgtagacccgggaatcagataaactgggctcaagtccaactccagcacttactccctgtaaatgatcagtcctttctagaacccagtttccctatctgtaaaaccgaggcaataaaatggagtcatcatctcacagggtccatgtgaagctgagatgtggttaaacatgtgaagtgcttaccctcgtgccctgcatggagcagattctcaatagaaatttgctaatcttggtcaaattctgtccattggccaggagtcccagtcaggccagagaagcttgtttttgccagagaggtggaagggtagttgaccacagtccacaatcactccccacctcccctctccccctcccaatcctgggtggtaaggcacacaccacatcctcaggaagctgacatacaccctcctcgtcactcctcagccagctagtgaaaaccaacaaccagaaatgtgcagtcccatgtggggacctttgtcaggcaagtcaatgtgctcaacagaaaactcatagccccaacactgtgagagggaaggaggaagggagggggaagacgtgactcagaagttaaatgccttctttcttagaacacaggagtgtcacagcattcaagccaagacctctgacctgcaagacatctgacctgcaagagggctcacttttgggaaccctcatgctcacgatttaggcctctgacctgctaggaacatgatcagcatcttggcagagagagcacaggccctgcatccaggcagccatgagctctggtcttggcctcagcgctccctggccatgtgactacgtaaataaggacatcagttaaataagggtacgtgagataatgtgtgttcagcacagaccgtagcccagtgctacagaggaatctggaatttggagacacggttgctcacacctgagacgaggataggacctcgcctctcataatcaatgcctgcctgagaccttggtttctgcttaggtggaagtggttttaaccaggctcagaccctcctcatactgcctactggtggcctctgtcatgagctctcccccacacctttttagatggctcctctgtcttcctttgcgtggaggttctgtgtttctccacaatagtagtctcttctcttccctggtccaattacagcccaccctcctcactccaagaagctgggtatcccatccctgcatctaacggggtaccagaactggtgacggacgactcaccagtcactcgtggcattctctaagaagcctttagttagtcctctctgcaactcccttcgaatcccgtttatgagtgaccagtctcccaaaagcaagaatgccagtccaagaaagcaggaatggggatttgagaaaaagaagaaaataaatgtgtttctgtgctcagggaagctctccacacaacacagctcaacttcctactcctgcattgccatctggttgctactggcaaccaggcaatcatatttttctagtcccagatataatcatcataatcaatatagggtatttatcccactccttggttccaaggaactcaaagattttcacatctattattcttccttcactaacgtgagggagagaaggggaggaggtctgcttgttgatggggtgtggggaaggactatttcacagatggaaaaactgagggaatgggtaagaaggaggctgtgggaacatctcttaagaaaacagtattgctaaaagcagtttgcatttggatagtgcgttcacttttgaataaaagtgaaaaaaatctcatctaatttttacaacatccctctaaagtaggttcatttatcgtatagacaaagcccccaaaagtaaaggatctttccagaaacacaccactagaaatgacattgcctaaactcctaggcctttcgagtcccttttagcatttttttcccgcagcatctctgcaaacaagtacagtacattgttggagctatcatgtctcttgtatgcattaccaccccaccattgtaagtgtttctcattatacttacattgtgcattacagtggctcttacacataggaggtttctgtctagttccggttgatacacacaccaaatgggcaacagggccaacaaaaatgactagactaaagcacttgactgcgttggaaaacttaggagccatatttaatttcctaaattctataaatgttcctttactagagtaaaacttggggggaaaaatcaatagttttgactctgagatcactcaccgcttttgacaactctgtgatgttaccttttcctacagccactggtttgatgtcaccttttgtcacagtaacaaagcaataccaaaaacatgctttgggggtccctgaagtggacaggaagccttctaccctacatacccagcaaaggcttcagtgccacccttgctcattagtgccaaacacaggtggctggaggtaaaaagacactcaatgaaacacaactgcaagagaaaacatgtggccacggccacagcagaactgttctaagatagggcgtctttctgaggtttgtgctcagcattcatttccctttggagacagtagaaacaccactgaaaggaagagagtagctggcttgtgcatgaagcttcctctctgttctcagaaaagagaaccagctggacaccatcttatcttttatcatttcctacttagagagctgcacaatttaccccttagaaggagaggccccaaacagaagacctgacctgtgatacctgtgatatccgcgacctcctgagcaaggagataaaaggactcaggtcagccctgacttcctaacctcatctggcacctcttcggattctagaaagaatcaccatattggaaaattccctccataccctcattccattcagttgagtaggcagaggggggaaattagaaacaaaagtgcctgacatgctaacaccaggctaaggattcacagaaggaaaagttgatgatcccagtccctagagatggatgaaccagtgtcagcccatcaatgaaagcatgttcagcacctactaggtgccattactatgcaactattccaagctgggtcttgaaaccaggctggtctgcccaccactgcgcagccttgcctgactccaaggacgcttcccgcctttggttgcccttcctttccgttcctatttcctcagtttctgacactttgcttttgtctctccttctctctccccagtgccctcactggcatcagatttggcactccggtgctggctttccaagctctcttttggccacagtgtgcacccagctcccggttccatggttttctggccaccgtagtgtacccacattgctgtccctggggcccagctcaccttatccatcttggttggcatctctgccatgcctgtcccagctgcccagggtgggaggcaaggagggcagagaggtaggtgaacactctgtgcatgctatcctgtctctccctgatgtttagcaaaattcagacttagaagttcagattccctcaagacacaaaccagtttgtggcttttcttaagtcatgctgtttcaagtctatcttaaagtagattcctgactacaactattgctttctttgtataatacttgcttctttccaaggagcttgccatctgctatctctttttagccacataacatctttgggatgaaacgtagtcagatgaaagaacatgaaccccatcttgcctcatttggggacaccaaggcacacagaccatgaatgatgttatcctaagtgtggaacggtgagctccactttgctctgaccaccttcagctgcataagctggcacagccttgacgggtacagatgtagagagttagaggattagtctcttgtgtggatgaaacactagccttgccagggatttaccaaagtccccactctaatttttcacccaggatgaggaacccaagtccagaggctcaacacctctttccaggtctctgctctggggccaccctgggaagagacacagggctgagatccaagttcccagtctgttccatctctccccagcccttctttatgcataaaggacacttgttggggagtcagtctgcgcttctggcatctggacacatcagcctatatctctaggactcgagcaggaagtatgtttgcctcgcctcgggcttcctggccacacagacccacgtcctcatttagaatggtggcatcatggagccggctgagatctgcagtcttcagtgtcagctgcgggtccacaaactcctactgaacacgtacccatagccccaggggaaaaaacaagggaggaaagaaaataaccaaggtggggaggggggagagattctggaatctagacaacatcaagagccctgtttccatgacaaccactacttaatacagttgctcagactgcagcctgttctaatcggccccgtggatggagcctgcagacccagaaatggcctccagccacggggctcccaagcagcctggaggaccaccaccatcctccaaccaccccaatctcctacaaagagaacagagggcaaaggaggggtgaggctcacaggggaggtgagaaagaacaatgaggagtgttgaagaaagtggaaagtgaaaggaaggagtcagagatacagccggacatccggggggttgtctgtggatgtttgctggggccacctgtgttcggcaacacttgtctttgtgttggtgagcctgtgagcacccatgagacgcatgacaggctgtagccagcgtgagtgtgaccatccacagcacgtccactgagcccatctcccttccccttcctacacattggagtacccgcttcctctcttctctcttcccctacaaagctctaagctttgtagtccaaggataacccctgtgaggcaaaggccagggtcagcagccagccagtaggtaccagcagcttccaacaatttctcagcaaattgttgggatagaaagaacaatagtactaatattctctaaattagaggtttctggcttaggggcacccccgaaccctgctcctcacagacttctccagttcccagaaaatgatgggtgacttctaggttttcttccaatccacatatgagacctcagaggctggcaacttgtcaaagtcacctgctgggtcaggtgtcagcctggagactctgtccctggaaagccacacatctccctgcatactccaggctgcactctccttcttcctgtattcatctggcaatcacccaaacacgctgcaaatcagatgacatatgacatgctgcacactccgtccaactctgaagggagtccgtctatggggacaatgggtctggtttatattttaagcagctagagtgaaaaacggggagtgatgaggtaaggccatggcaacgaacaccatgccactatccaggataattacttcgcccagccatcctggagccaggcggcggaagccttgccccatagattatgagcaatgagacagggccagccagcttaggaattcccttcctccacctgcaccttcactgcaaatggaaacacagcagaaggaaccaatgcagtgggagatcccaatcaaagcaagatgacctgtccctcaatttccaatcgttggagaaatgcaaagaaaagtccctatgcatacccctcctccaagttgctacatggaaaatcagagctctgaatttcggtgatggctgctgagccaagagacaaggaagacccaaaatcagcataggacagagatagtgaaaaggtcagtgagcgagagagaggaaaggagaagctgaaagatgtttgccgcaagctaggaatgacctattaaaatccccagccactccctcaagctgggatgcggtccctgttggtggcttcacagctgctataccccactcaatgcaggctgcttcagggctccaggacacttgtactattggccagctcagatgccacccctgcaggagcatgtggaaccatctgacttggatatgactgggctttcctgctgcaatgccctacagatgctccatcgccatatacacatgccttgctcagggatcatgcccatgttgaccttggccccaaaacacggatgggaaggagcatgcccagggagcagccttatattttcttttcctttgttccctgagtcctcagatgaaaatggctacaagctgatgctctggagaagagaatccaattcagtggccacaccaactaatacagggcatccactttgctcttcaaagacaatcagaagtgcaatagtcagaacatggcgcataggaagatcctgaaaagtccaggcctgtgccagctgcctcccttcgtggtcctaagtgcaaccccttaaagtatccgaagaaattgactcctgaggggcagaaatctagcaaggagggatgtgaccacacgtgtgtgtgcatgtttgcatgcaagcacgtgcacagacacacacattcttacaaatgaaactgcaatcactggtgatgtgtgggtgtatgtgtgagagttagggggttgtgcatgtgactatgtgaagctcgggatcacaaatggaaggagagctgcatctgaggaaaaaaaagaaaaaaaaaaaaaaaacagaaaaagccaccagccctgtaccctccgcaccaagagatccttagcttgttgcactctcattggcctcttcagcctctcctattttcagtgaaactctcctttgtttctcccaccccaggttggccccagaccactaaatacacaccacctgaagatacagcaaaacccagaagtggtgaccacagcaacatgagtacacacactgcagactgtcagcagcaggagggtcatgtgattgcagagggcagcctgacaagcccatgtgattccctccacattaagtggaaaacactgtctccactgagaaagagaggtgaagaggtgggaggagtgaaaagtgaaattaacttgagccaagattacgcccatgggttctgtggaggccaggccggaaggaaagtcaagaggaggggcaggaactgcatccagcgtgtggttgtgtacggttgtggttctgggaggatggagcttttgagaagtgtgtctctggtacaccctatgcaggaaaacctcagcacgacttacaggtgtataagcatgtgtgtgggtttgcacgcagcatgccaaaagcatatttataaattgggttaaaggttggttaggaccacagattctggttaaaataccagctttagagtatatgaccacttagagcttcagtgtcctcatctatgaggtgtagataacagtaagtaactatcatagggttgctttgatgacataatccatgataaagcacgggacatagggcctggcatgtagtaagtgctcaataaatactaatttggtttattattatttgatgttccccatgatctcaggtctaaaatgacatagcaaaaatagggtaggtagatacataacattattatttgcaagaaagccacagttcatattacccagttaaacagggaatggctaacttctcaaccacacactgaatatcaagataggatgataattctaactggataatctcagtattagtctaacatatatttaaaagtatcccatagtgtcattgtaaagcaaggactttgatattagactatgggagtattctatttttgccacttgctggtaattaggctggcttagcctaatgccctgcacatattaacacctcaatagctgtttttaaaaattacagctctgtggagttttagatgtgcttaatattgacaattctgttcttggtctaatagctttttttttcaatcatccttatagctgattgtcaacatatcaaaacaaaaagatttattccatatcaactgcccactgctagacagtaagtcatcgatggactttcacaggtttatatgaaacatatggatgtattaattcttcaacccacattgagatgaactgtcacgtcccttttaaactccatcacaggcagcaagtattaacctgcaattattaccgtgtataacgtgctttacaattggcaagaacgtcaacagtccctggttcattcagcagccctggtatcattcacaaactgcagttctcttttttttcctcaggcctggagggaattgagaagcagaaaataatctcaggcagatccagctgccctgacacttgcagtgcagctggcaggtgccggagcttcagacacgtggcccacaggtgcaacaaacccaccttgcttgggctctgcaaccatagagtcccgccccggccaatgaagccatccctgggggtctctgaaaattctccaggctatctgcaaactggtctctcagaatgtgtggccagctacactttagaatacatgaacaagcaatttacttggtgattcacattgtacatacatgtatacacacaggtacacatggatatacaaatacacaatatatccatacatacatgtgcatgcatatacacacatatgcatatatatacatacgcatacacacatacacatacaatgtgtatatccatgcatagctacccttcccagtcaccttgggtgacacattttgctggggatctttgtgggagaaggaggggcattttctgctgctcaaatagcttttggaaccaaaacatttgcaaaccacttgtttagggggcaagacctgaactcaaggagcaagacctgaactcagaggttcgcacaacaggtgaccaaccaaagtttgcggtcctaattatttctactctcttttccctttccctaaaggccctaggacagtttcctctgcacccatggtcctctaggccctgctgagtagggcactactagagagagaagcacctggttcctgacctcaaaaattcccagtggtgaatgagcagtgtggcactttgtaaagctttatggaattaggataaatgcttctggctattggaaaaccttatttcacatgtgcacacatgtgtgcatgtgcatgtgtgagtgtgtgtgtgtgtgtatgtgtgtgtgtgtgatctgtgtgggcttgtgccatgctgccataaaacacaaatttatcttcataatagggtcaattacattctccgatttccccacaagtgaggcaacaaaaacaaattttgagcttcaacctgcaggagaatgccaggatctctgtgttgaaaaagggagccttggtttaccctccccctgccttgcacagacatatgttgcacagacaaacacctggaaggtgcttctcaattctttgaggttgctgcctctcacatgcagctgtcaaatcacaccccatcaacatgacacagcaaataacactacgacacgcaaccagcaacttttgaaagtatactctccccacacccagccccgtctgccttctccagcgtgggctgctgtcttcaaactaaccatcctgaaactgctttaaagagcctgacaggtaatttattctgtggcagaggatagcaatttcattgtccagaggcaagagatccaactatatcagaaaatccgtactctcaaggaacacaggtttaatatgataacgattctaagggtgtgtgttcataattcttcctgttctttcctccccttccctaaagctgctagtgaatgcttttgcagttttttttaagggccctccaaagaactgacataaaataaatcaaatattttaccacgaaaggtgattatcaaacacttatttgtgaaaagagtcaaccagaaggggtcaaggcctagctgctgttatgggatttttgcccacaagtaaaatgtttttaaaaattgcatctgactctcttggcagaaaacctgctgggatctataaggtttcacttgggcacctggtagagaaggggatgaagagcaaaaaaggttggtgaacaggacaacatccgcttctagaagcaaagtcaaggccgctatgcacttatttttccaaaataatatgatagttattttcacattttatttgctaaaatccatgcaaagtaagtattattatttccattttacatatgaaaaaaccaaggcttaggatattgaagactcagcttcctcaaatataatataggaacagtagaccctgggtccctcccaatggtaaatcacaactttgcatggtgagctcccatcagaaatagaactagaactgaagtctcctaactcttagtctctgcctgctagctcccaccccatgtgactgcatcagatctgcattgcaacaaaaggtaaattcgatgggtaggtgatttttaaactcgcctttgtcaacgaacttgtcataagatcttggacaagatgcttccctttttagtattttggaagattgaccagtaaggggaggctgatagctcctcagatcatcgtgagttctttctgggtggcagtgtccagcacagtgcctggagtacaatatatcctccataaatgctcactgcattgaattgagaataacaacaaaattctcttaacccccactgatgttccctagctaggagcacgttgcgctccgaagcacaggacattgcccacagatcccaaggctataggacttagcatttccatgggctcattgcactaagctcagtgtttttaggtagtaatgaatggaattcttttttaaaccctgcattcggagtctatttcatgcctttttacatttcacattatatttatatttttaaaaatcattacctattttacattacacattttaaaaacctattcagtcaaataataatcctattccttggctgccagtcagggaaatgaaggtctcacaaacagtgatttgcccaaggccagcaaagactgaatatcagagaaggatgatcccaaaggtagactcagcttaatgaggccagaggtctgttggggcttcactttggagaagtccttcagggtaaggagtgccaactgctttgtgaagtggcatgccaccaatgctcggtcaaaatcacatgcaagagtgacactcctgacctcaaatcaccagttgatcagagtcaggggcaagacaagggcacagatcttctgaggctggagaaccacgtgctcaccctatctgggaggagccccaagcccttaatgatctcacgtggccttcagggacacccaggcactccagagacaaaaagagaagacagatccagatctgaaagagcagagaatgagttgtcagtcagggacaaagagtgggagattaagggaacatgctaagtgtcactagcctggattcttgtgtcagggccacagaggtccctgatgccaaaagctgggataagcctgtgggttgcatataagttgcgtatgaagttactgcttgatgccagcaagcactgaaacaagaaagagaagcctgtaaagatggaaatgaggcaactcccaacccccatcccactttcagaagttttaacagatgtcctttccactcccttttttcttgggaatgcctcaagattcttacttttctcgaacgggcaactttccccaccacctacgtgttctttctagattccaatctgctgcttctccatggggttctttctgttctttttcttttttcttttgctgacctttgtcctcccaaatgttatcactcagagaagtccccctccgcaaacttccccacttaagtgtgctctgtgcccaggccctgggctaagcacgagatgtggaaaactgaccaagacaaaaaacagtcccaggccaacctgacctcacagtgtcaggcattaagcaagtaaccaagctgcccgcatcagcaataccttctggcccctgatttttctgtctctgcgatttaccttgccctgatctagcagacttaaagggatcagtttttggggctggcacggcctgagaggtcaaaccccgggacacagtgcccaaggctggctggcgtttgatgggatggcaccagtagggtcctattggttgctgacaaatagagtcggctctgcttacccagcccgtgctgcaccagcttccatctgaacacccctcctgctggttttatcacgaaggagaccaaccaaccgaagcctgagatcatggtacagccatgcagatagtcagacctctccatgcttttcccactcctgtgtcttcaggggcctagctccctcagattctcttggggaacaagaagctttgcccaactgagggatgttcctttgctgatgtttggaggttttccttcctttttgtggccatgttcctacagccaaggcaaatccaatcagcagtaccatccttgttgcaccccgtcctctgtgggggaactttcccggcttctgggctgttctccatctggttccaaaatcccaagccttcagagagagcagtcgcactgcctgaagtttaaatcaactaggcaatttgctttctagaactcaagtctgccgatactctgtacagtttttctttcctcagtgcaaacgagaaactgatggtttcatgactgtgatctctctgccctctcctcccagatgtttctagagtcaattccagctgccaccgggcctgttgtccatttcctggcacgtgctcagtcaatacaaataaagacgatgagccgacactgcgcgtggtcgtgaccatgttcccctggattgccctggacttggtcttcctttagacacttccctcttcattaacctcacgtctgcatcctttctttattacacataagtgaaaatattgctattgaaggattcagcagagaaaatttccaaagaccaacatgtggcatctccagggttccccttcattttctaaattggtacttcactcaaaacatttctggcataacttcttttcaaaaaatgtgtgcttccattccaagcaacataataatagaccaatcccatcagtgagcagaggagggccatggattcctttggctcccctgctgccattcagtgctaaaacactgtccaacaaagccacatccacctcagtgaactgggtgggatccccctgcctttgttctttctctgcaaatgcctggcttagaaactaagcctgattgaaaacctgcagaccaacttaagaacattgtcttgctgaatttcagccttgattaatacccttttctagaatctgaaagtcctttgtcttgaaactctagtccacacttactcctgtccttcaaatttggaaattaaaccagatactcaccttctcatcattttaatgatgccctttggctcaggtgttgttgtcagaaagtaactcttctctttctttttttgagaagaagtctctctcttgtctcccaggctggagcgcaatggcgccctcttggctcactgcaaccacctcctcctgggttcaagcgattctcctccctcagcctcccgagtagctgggatgacaggcatgtgccaccatgcccagctaatttttttactcttagtagagatggggtttcaccacaatggccaggctgatctcgaactcttgacctcccaaagtgctgggattacagatgtgagtcactgtgcctggctgaatgtaactactttattgacaaagaggacccagttctgtcctttgagtatcttgaatggcaggtgtcatctaatgaacatgtaaagggacctaagttccagtaaccccaggcagcctggtgcacatctgtgttaaggtgtgtgtgttggtgtgggagggtgtgtggggtttgtgtgaagctgtgccaacctgtgggtgtgcaaccatgcaccctctccactttccccacacctgagtggtctgctggtcaccgtcagtagaccatgcatgcaaaatcattcttctggacgtgcaggagaaactgaaaaccagcactgtcaggtgtgttaaaacccttaagattggttctcggctgggcgcggtggctcactcctgtaatcccaacactttgggaggccgaggcgggcggatcatgaggtcaggagatccagaccatggtgaaaccctgtctctacttaaaaaatacaaaaaaattagccgggcacagtggcaggcaccctgtagtcccagctactcgggaggctgaggcaggagaatggtgtgaacccaggaggcggagcttgcagtgagccgagattgcaccactgcactccagcctgggtgacagagcaagactccatctcaggaaaaaaaaaaaaaaaaaaaaaaaaaaaatttgttctcatgaacttcctggcttagccaaccacatccacccttccatgtgtaggttaatattcccaatctgccacctgctcctccttctatgtgatttctcgagcagatgcaaagagacttgtctggggcaactcacaccccacaccatcttgatttttgtctctggggtcttcaaagccctctccttgccacagccgagtgagcgcccctgccttggcatccactcatctgaccatcatcagtgcccctgtgggtcttccccctgaaagcatctcacacaacacatctagttgcctactgccatggggtacagtagataagagacttgtctccatagtgtgaaccagaatttattgcatctgagcaaatcatggtcacagctatgtagctttgacattcacttctagatagataatggcatttttcacgccaaaattctttgaaagcaaatatatgatctggcttcattccacaaccagaccagttgaaacacctcacttccctgtacagaaaaataaaagtgagaaatacaaaaaagcagtcctagaaatgccactgaccccaccctgtggatggaaggcagggtgggatgggaccgaagggtgccaggaagctcttctctctgggggctctgctcagccctcactgtgtcccccctcagggattccagctcctcacacagcctctcaggctcacgtgataaggtgggaaaatgaaggtcaaagttaaagagcaaaaactcccgagaccttgatgaaggaggttgtttgctgtgccctgaaagttgagctgatgtctccctggtaggcttaggtcagctctgctccaagttaacacaagcccaggagccccgatggaggaagggaaggcccaaggcggggcaagactaagacagccaggtgtggtcttgagcacaagaggtagactgacccccaacctccctgagctacacgtggataacagtgcaaaccctttaccgttgttgatggttaaacaagaaattgcatgtagcgtgcttagaccagaggctgcacttcatccccactagtaaaggttaggtaatattaataacaacatacgaacaacaacaaataccccattatacttctttttgtcacctcacagcccaacaaactaggcacaggcactgtcaccatcccattatgcaagaggaagtccagcccgtgtgccattaactatctgccccaagtctcactgctaaaagaggaattgaaaggggaatttgaaaagggtggaactcatggattccactggaggagcccagagaagaaacctggtaaaggttttcaaatggcccagctgcccagacaatgcatgaaatctgaactctgactctatctctcttagcctttgaactgcctcctcgaagagaagtgaaacttaactttataaaccagacactaagatgcatcttttaaacaagaacatagagtagctcttcccctatatcaagcatcaactatccaggtaactatgttacctcattgtatcctcacaaaaaccccaccctatccgaattcccaagggttccattttacagaggaggaaatagagagtcaacaagctaaggtaatgagtctgaggccatataactagtaagcggtagatctgggattccagcctagagctagctggtctttggcaccattcccctttgcagcaggcctgcagcagacacacacacctttgaattcctcgacaggcctgtgcctggaccttccatcctcccttcctctccccacccgcccacatccataatgcgcattttcattaggcatctttgcccagtgatctgctgatttgttatattagaattgcaaacaaatgctctcatttcatcctcctatcccctctcttgccctcctgacatctgaaattcagcattgatttttctggccccgctccactgcctaactgacatttccggttgatttcaccttagaggcttgcagttggctcaccaggctcccactagagcccagaatggaatagcgcatcacctggataagcagaattggacctcatcccctacttcctgctctcagtgctctcactgtgtcagaactcagtgccctctagactctgtccccattaaccgattgatggatatgcatacctcagtccttcaagattctcaatgggaagggaaggaggggaaaactgtggaaaatgtcctgggaggtgggaccaggtgaattttgatctcctaagtactgatgttttcagccatagctggggtaattggacctcttgtggaggagaaaggggattatgaggaagaccaaatggactgagagatagaggtgggaaggggactgggataccatgttacaaacagaggatctctcatatcttaatccatcagaagactcatagaatgatcacttatctaaaatgggacttaataatccccagaggtcatctaagtcagtcttctgtccacaccacacagcacatcttaggaaggtgagcatctctcctaagtttaagaactcaagctgggtgcagtggctcatgcttgtaatgccaacactttgggaggccgagttgggcagatcacttgagtacagaagtttaagaccagcctggacaacatggtgaagcccacctgtacttaaaaaaaaaaaaagattaaaacactttttaaaaaaattagccaggtgtggtggtgtgtgcctctggtcccagctacttaggaggctgaggtaggaggattgcttaaacccaggagacagaggttgcagtgagccaagatgatggcgctgcactccagcctggacaacagatggagatcttgtcttaaaaaacaacaacaacagaaaacacctcaaacaaaaaaaacgtatagcatctctcacaccttctagcttctgtctctgataagtacattggactactaggttccaaacagagctacgttttcctcccaggacttcccattcccagtgggtactgaccagtgggtatccaagttggttttttatggaagcttccattttgtcaataaggaataggcccagtgtcctgtgaagtggtcagtggtgaccagctccacaaggagaagacaactcacagaggtacactagagtggccattgccagctcacaatagctggttgttacatttttaggaagtttgtgatccagttgttaaactattggtagtttgcgaacaccagggtagaagtatttacaccatagaaattggcatctgctataaattagggcttcttttttctgcagagccaagagtttcatgaagagggtgcccagtcatgtggtcaacatagaaagagggagaggcatagaaagggtggggtgaggaggacgaggtggaggcaagtcagggaaaccacattctttagtatcctcggaaaagcaaactctaaacaatcacctttccttccttcctaactaggaaacatcttattccctctgcagctatatgttatttcttctctaaggaaagcagttattgtttcttgttctcagacctaaagtggagaaaactagagacagaactttggatcctatcatttctcagaagccatgagtcagagaaggaagaaccaacaaagggctctgaactatagactgaattctatatgcacatttatacatagcccagttctagttgtctctagagatttcttatgtagaaatatctatacaagacaacagctaactgtagagctcatcaaaatcagggattgtacctttcatttcttatataaccatggttgtacctggtaagatattaatgttacaacaggtaatgaataaaattttggtttattaattgaatcactttgaattgaattggattggtggcaaaccactggtttatgatcagatgtcaagacttttcaaatcccttttctaagaggtaaaaattagctggttggctggctggctagaccaatagacactgattaggcatacacatgaccttataagttatcttgagctcacacccctggctctactcattcctgtattgtccagttggatggctttgcttctttctccacagttctcctggcctcttactcagatccatgtgctttgggcttttggttcttagtaagctggtaacttggcccctgactacattcaactgtgcaccttgaacaacccaaattaaaacaatccaaagcctagtcaggtcaagacaatgaagctggtgccaccatgtccacattcagaagtggactcagaaggcaggaggaaccatgttctccaaacccccaactcaatcagtgtttcccactgcagatgatccatttcagggaaaccatgcccaaagagatgaacggacagatcctggtcacatggcaccagctctactcccataaaggggtgaggaggcagaggtaccttatttagaaacctgtccttttctggatcctctgtcacacatgactgccactgtcacacatgactgccaccattggtcatgcttctctctttcctgacagcttcctccagaaccagaggcaaagcaccttcagtgccctgtacaaaagcccaggtttgctgggctggggcactgcctcaacagagaggcccatcctccccaacctagtggcagaagtccagactacttccaccctaatctggcaatgggtgttcgccttgggggaaccaagacctctctgagaatcttctcaaatattttggaaaatgctcatgcatccattgttttacagacaaacttacagagctcagcggctgtgacagtccccctgggggccctgggctaatggcctctgatgaaatgcctctcccagtcacactgtccatttccttcctggacaccagctcctgtttttcatttctcgagtcccctctgtcctccaggaaggaagatgactgctctatggtacacctccacatacaggtgagcacactgatatccacagaggccatgcaacttgctcaggctcgcacagaagttactaggagagatgggatcgggatgtaggtccaggaggctgtggctctttctagaatttaatgcagccacacagtgctgtgtttgtggatctcagaagcaaccacatcaaaaccctggcctctactcttcctcagctatgaaggaggtatgaaacctcatacatgaagtttcaaaatgggagggagtgctcctccaaggaagcaggtaggtctttgctcagaggtaggcgggacacgtgattagctctgtgtgtactggggtgatgtcttcagaaccaataccgtaaatgcctctgacacaccgtttccactgttaatgagaaagctctaagagccattaatctcattactgttctatcagcagccagtgatcatgttcatttcactcctcctctccaactccttggtcactcagctactgagaagggtggactgggaaggctggaaaggccaggaccctgccctcaactgaagtcaacggtggcatcactccagaattcttggagcagaggaacctgctcagcctgctataggaacaatggccaaggaggcagctgtgtccccaggactcctagcccccttagtgggcctcttcagccctctttctctctgagattctggagtatttctgtatgtccatgagggagcactctgtcccactatggcctggagctccctgagcaagtcggaggcccaggaggcccacatggatgagtcagtccctagtcctcttgttttatggctcaaggtcctctgcaggggtggaatctttgacccaaggctaaggagcccagaaagatgattcaagtcagagaataattccaggtcaccctctcttctgtagccacaccttcaaggtgtagattatacaaacccagaagtcctagttactcactaacccccagccacttttgtgaaaatggcacttgactgctatgccttatggaagaccgtgtctaaggaaggagcgtgaggccaggtgtggtaagtctagaccacgagggactcagggcccacccttcacagctgaggcctcatccacgctggtccagaagtcttcccatcataagcatctcatcttaaggagcggctgggttatattccagtccttctggctgatgtctgcaccctgggcctcctctttgctgcatccttgccctgaggcttcttgaggttatcacaggaaaagggttagaggcagcagcggctgctgacgtcacatcagtatccccttcaccaccaagagccaatgtgctgagcagcttagagggtatttgaggaagcatgtccacaagggcagatgggcctggtactcgggaagttgggaaaatacaattagacagaagcctggtcccaaatcaaaatttcagtaagggcttgcctgcactgatgtccagcaaggaaaggctatttcctttgtggggtctcctgtactctgttgtcagccctgcctgatgggcccagtgggtaaagggcagtgagctgagctgtcattgaaatatccctgcatgtagagagtctttctagaaggaagcaagagcttggtccacggactcccatgagactccaaaaagagaaggcagtgccggcccctggaagagaccaagctcacactcctaagctaccccagtggcccaggagtgattggcacagggatgggatggggctgtgtgggaagggcaagttcattggtaggcagggccctcctggccctgacagccaacgattcccatctttcttcaatcaataaaacttctgctcccttcagtctgtctggaagctcttcccaaaaggaggctcaaagtatcagacaccaaaatattacatcacactccctgcccacttccttccccaagagtcctctcttattccaaaaagggatgctggaaggacacacaagagtttcttgcccttttcttttggttttatttttgtctcaagtctggcttagccatgggagtcagagtagagaaagaagatgttttcctcccctgctttggccaggaggataattccaaaggaaatcaaaaacctttatctgtcatcatctcccccagcaaggcatcccagcaccatgcatttaatagaaagagaaatcgttccagcatggagagatggaagagacagcaataaaaggccaggcttctgcctcccacattagcgtcccacccatcaggaagcatgccaagtcacttcagacccagggagcctgtggcatgcccatctctaccaagtacatgttagcagagctcagaaggccaggaaaagaagaagtaatgtgtccaacacaaggaaagcgatggtggccatgacgtcttgggaaatccaaaaaaacatggcacacagtgtttctagtctcgcatctctccctgcaaggctcattagtgagccctcacacactgcaagatatggtctgaaaggtgtaagggtccagctcccagctccctgggggcctgatactctaccctctcgcttctgtggggagagatgcaaagaaaggcaatatggccatctcttcatgggcaactctcttccaacccaagctctctgatcttcaaaggggagagatggggttggacatgagcatcagtgcaagggctcagagaaatgtatcagctgcaagacagctcccaagatggtcagaaatgcaggtcctaattacatccctccattggctatgaccttgggtcaccacacaccaattatttactctggcaaagtgattagggaattggaaccagggaatggatatgtgttggggtagaggcgggaacctgggggttcagaagatgaggatggcagtggcaaagatgctccttctgcatctgcctcctcctaattggggtcactgcaggcaacagttagggagccacgcaccacgttctagtttttggtcatggggaattatgtagaggccccaaaatgacaagagaagtggaggaaaaggaggagagaaggataagggccaaaaaaacagttgcccatgaacaaatgcaaatcctatgtcaattagggagaggatggaagcaggtcaacaaacctgcccttctcccaagaagagagagaagtcagatcaggcaggtgggagagcagcaaagatgggcaaggctggagagaaaggtgacacagaccccacacagggactcagactgcagggccatggttctccaattatgaccctaggactagctacagctgcatcactcagcccttgtgagaaatacccctttttggatcccaccctagctctattgactcagaaactatagaggtgtgttttaacaagctccccaggtgatcccgattaaccttcaggtctgagaacagtccccagaaggaaaaggaattccagtttcccattgcatcctttgcccacagtgagggttttttttttttcttccagacagtctcagtgtcaccaggctggagagcagtggcgcaatctcggctcactgcaacctccaactccctggttcaagcaattatcctgcctcagcctcccgagtagctgggattacaggcacgtgccaccatgcccagctaatttttgtatttttagtagagatggggtttcaccatgttggccaggaaggtctctatctcctgactttgtgacctgctcaccttggcctcccaaagtgctgggattataggcgtgagccaccgcgcccagccaatgagtgcttttaaactccaaattccccttcaagacctcatatcactttcagtgactataataatcatttctctccagagatgtagtctttgacccaccgtcagcagaaaggacatcagagtgtggtctattttgaaagagcagaatgaggtttgcaccacatgctgagcacacccttgtccctgctctctggtgtgggcaacagcctagcagcccactgggtttagtgtgtctgtcatcaccacactttcctgtgcaggaatggcagcagcaacaatgctgtcaatgaaagtaaaggaagcaagtaagctttgagcacccatgttgggcactgtcctgagcatttgatatgccttctttcatccaatcttcacaacagccccatcgtatagacaaaacatgttcagaggggtgaagccatttcatcaaggccacgtgactcttaagcctcatctcaaagttcttgttcctgcttctgcattgccttcttaagaacaacaacaagaagcctctccattttctttgcagttaatttgcaaaccacaaagccaaaagctgacttatcacccttgcaagaaaaggggcttgggttctgtgaggggcatttcttggctttaacaagaagctgcctgggaaatggccctacaaaaggaggccaagtagagtagggcatagaaaggacgttgttctgagctgaagtgcgcccccccaaccatgtcactgcctttccacaaattcatatgttgaagtcccaacccccagtacctctgaatgtgactgtatttggagatagggtctttaaagaggtcattcagttaaaatgagatcactagggtggaccttaatgcaaactgactggtgtccttataagaagaggaaatttggacaccagtaggtacagaggaaaggccatgtgaagacacaaggagaagacagccaaagagagaagcctgaggagaagccagccctgcctataccttgatcttgggcatccagccaccaggagagcgaaggaataaatgtgggagccacccagtctgtggtactgtgctatggcagccttagcaaactcatccagatctcttcctgtcctacggtgggctgtccaccttcccacagctccttcagcatcctcgatggggccaatgctggccaagagaagcaggttctgtgtatccctgcactgggtggcagcctgaggctgtagaagtaccaccctgactgaggaggttgggagacgtctgggaaacaggcagccccggctgtcagcctgcagcctcgcctggacgctgtttgcactcacacacactggcaggtatctgtggtcatcacggtggctgttccgctgtttgcctccctcctggcaggtgcctgaaaataaagcatgaagcccagacagcccaaggatggaaaatcatggagctgagacaaaacacgtatttgcagagaacaggttcaacttcaggggtggggaggggcgcctggctctcaggatggtgcagagggaatgacagagaggaaggtatcaggtgtgcagcaaagcagaacatgagaaggaggagagggccaggccacattcaagtgtgcccaagtatatgacacacacacacacacgcagagtgagggccgctcgaattgacacttggagacatgccaaaccccaatgcactcactcacacatatgcctgcatgcagaccctgggtgacacacacaagcacagtcttcctgtctgttgggagcccgcgcagtatgtttgctgagtgaaaatgctccttggagaatcctccgtttgcattctccacacacaccctttctttctgggcttcgaaattgtgcatcaagcgtgcagctgtgaaaagaatgatacaagcagagaagcctgccaggatgctccatgtggcctagcggaggggtgggggagtggggcccagatggtcctcagccagtctgagggtgtgggtgcctggctcccagtgacctgacttacagtctcagtccctctcctcccctgcccagacctgaccatcaacccctctgcccacctctggaggcctgggaggaagatgtggggcatgcaaagttgtcaggagaatgcaggtgaggccagccttctgcagctcacaggatggacgagagaaggtgcccctcccttgtctctggccctgatgggcctgacagggcgccggtgggagggcaggagggagacaaaaccatttatatgtatttctggtggacatgtttgggggtccctcttcgcatctcctctgttcttttttttttttttttttggagatggagtctcactctgtcacccaggttggagtgcagtggcacaatctcagctcactgcaatttccatctcccaggtcaagcgattctcctgcctcagcctcccgagtagctgggactacaggtgcccaccaccatgcctggctaattttttatattttagtagagacaggggtttcactgtgttgcccaggctggtctcgaacttctgagctcaggcaatccacctgcctcggcctcccaaagtgctaggattacaggtgtgagccactgcacccagcctctgttctctttttataaggccaagagcgtgctctgaacttccatctcaaccaatttcctagaagaggctggaggtacagaactaagccaaaacaaccagagggactaatcaaccgggtctggacagtgataggattaaagtcagtgacaaattttattatggagctctaaccatgcccagataagtgtgtgacgagaagataacgactcagctgcgaaccggcagccactggggagcccttaacagactgagcccaggatgggccaggaagagaagagggcagtggaggggaggggaggggaggagggctggggaggagttgacgaatcaatcagaaaggctgagggcagggctccctctccattcatgcccaaagaccaccctcagcccagcccacctgggagaccttggatggaactggttcctacatccccatagagataaccgacaccatctgatttgtctcacattccccagtttccatttacactttaatggttctgtattttttttaacctcatcattacctttcagatctaaactcattctgccaacactgaaccctgtctcccatgtcacacagacataaggtatttggagctttttctctggtacctaagtgagtacctgtattctttttaactttctattttaaaacaattttagatttatagcacaattgcaaagttaacccaaagattcctgtttatcccacacccagcttccccttgtgttaacatgttacgtgtaaccatggtacaattattgaaacaaaattaacattgtactgttaaccaaactgtagccttatatttggaattcatcagtttttccactaatgtccttttgctgttccaggatccaatccaagatcccacactgcactgatatttttcttcctatccatttcagattattcattactgctgaaagtaaacaacaatttgatgaaacacatcttaagtcatctctcctttaagcacatgtcccccattgcatccatcaaccttccctcacaatgtaataagaatcacagagaggagctaaacaactgggcagcttgtggtgccatttatgatgtttcatgaaggtaggttctgaggatgacatggtgaaagtggagagaaaatacctccctgtgtggttggccagataatagtcctcaaagacacccatgtcctaatcccttatacattaccttctagagcaagagactttgcatatgtgattgagttgaggaccttgagatggaggagattaccctaaattatctggtaggtcctaaatgcaattgcaagtattcttttaagagagacacttacagaggatagagggagactttactacactgagagggaggcagtgtgaagacagaggaaagagatttaaagatgctatgccgttggctttgaagatgcaaaaggagccatgagccaaggaatgcagccccagaggctggaaaaggcaaggcaatgaattctcctctggaggctccagcaggaatgtggccttgtgcgcaccttggtttcaggccagtgaatcctattttggacttctgatccccagagctgtaagagaatacatttgtgtcgtttgaagccaccaaatttggggtaatttgttacagcagccataggaaaccaacacatcgtgtcatttagaatagtgggcactcgagacatactcattgggcgaatatacccaggtgtatctccttccagaacccactacaccatgcagtctgaaaacgacaatgtaccccattcctgctattttctggtgaggatattaaccagcctactagaaccaaaaagttctttagaattatctagtatatgcttggcagggtctaccaaagcggtacacatgccatgacctagcaatttcactcctaggtatatttccaacagaaatgtgaatatatatggtcaccagaagacctgcatgagagtatcaagggcagcactgttcatagaaggcaaaaactgaaagttattcaaatgttcatcaacaataacatggaaaagtcaatgttggtgtacccacacaacggaatgctacacagcaataagaatgaacaaactacagctgcatagagtgagctgggtatctctctcacaaacttaagtagagcaaaagaaaggagacacaagagagtatggactgcaggattccaggcacatcaagcagaaagcaggcaaagcacatctgtgccatgagaggtcaggatggtggctgtccctggtgggagggaacagaaggggacttctggggcatgggaatgttctatttattggtttcagtacaggcaacatggaggagtttagcacgtgaaaactcaccaagatgtacacttaggacatacgcacattcctgcctgaatatgacagtgcaataaaaagttacccaagaaaccccagtttggaaacagtccctctgccaagcccatccactcccaagctgtgtgcagtggagagctgggcgaaatgcctaacgggacaagcactgcaaatgaggtttgcctattaccataattacatctctgggaatgtgcaaagccctcattttcccttcatgtctataatattgtggggacacaggatgcaattacagcctgaaatatgcagcttaggaagtataaatacacacatctacgtagacctaggtaaaccgtgtgcctttacagagcacgaccgaaccagagcccgcgctcttcctcctgccacccagccgtggagcatttggaccctttgggctgctgtctgatctaagacggcagctctgaggatcaattcccctgagcagacagttttctgaaccagaacccctaatttaaaaattgcctgaagaagcagaaagtaagaactggaggaacagtaatagttatcactgctaattttaacaccaacaagatcttacattcggggaaacgatctcccaccccttttcttatttgaaatatagccttcttgatcataatctgtcattcaagaggagctggatgcaagtggattggcagtaggagaggaaccccagggaaagaccaaagagcaatgagcaggctacagtcaatttgattttgtggattcttccagggccagcacttgcggaggttagagatgccggaaggggtccaggtcttgggtttgtgtgtggtttatttccctcgggcattttcaattcatattcctgctcccctagatattcaggcccatgggcagcattttagcaaatctgggcttgtttcaacaccagcccaagcaggcacagaccagaagagaaatctgttggtggtggggatgctgggggcagcgagcctgatctgaagtggggaggctccctcgatcctaatatacaatatcccaaaacaaagtgaaaataaagtttaaattaccttccggtttcgatgatctaaatcacacctcccttccagaagtgtagataattggagttgactaaattgtgaaaatatctgattttttaaattcattgtgtacaagagtgcccccaccccgccccttctcttccccatgcccctcctataattaacctacacatcagcatataataccagtacccaatgcagtcacgatggcaaccgatagcaagaatacttatggctgtgtacaattcagatacaactgtttaaattccatttggctgagtactgtggctcactccggtaatcccagcactttgggaggccgagttgaggggatcgcttgagcccaggagtttgagaccagcctaggcaatataatgagaccctgcctctgccaaaagttttttaaaaacttaggcaggcacagtggtacacacctggagtcccagctactttgggaggctgaggtgggaggatcccttgagcccgggaagtcgaggctgcagtgagccatgatgatgccactgccactgcactccagcctgggtgacagactgagacactgtctcaaaaaaagaaaaaaaaaaaaacctcaaattgtaatttctctaaatattttcaaaaatagctgcatggaaaaaattagctctgtgcccacccttctctcctgtggctctgtggggtccacttctcaagtgacagcttcataggcttcccagaggttcaggtggcaaagaaccttgggtgatgttttgccagctggaaaccaaatcaagtcaggacaactggagatcaggccaccagctgagaagtgtgggactggaaaagtcaaacctagcaggcaatatttaaattcaaaattgagtatatgtggtcacagcctctctaagcctcagtttctccctgtctttcctttactaagaatgaatcctaccctctgctaatcccacacatcacccaccacaaggatgattttggtttttcagtaaaacaaaagcagaggggggatgggagcagatcctaaacgtttcagaatggtgttcacactattctctcttagactcatggtacctctgcacacagcctctctttgtaaggctgaacaaacagaagcaagcaaccaagcaagcagaaagatattgcagccccaaaaagtaaaaaataaaaaagatgaggataatcacaagaaatattttcctatgagatagatttaccaaaaggaaaaaagaaagaaaatgtctgggaaatgtcgtttttcagtaagattcaagaggacttttttctgaaaaaaatcaaagtaaacagcatctcaaaagcaggggtcagcaaacttttccattaaaaggctagggaagaaatatgcttggctttgaggccacatggtctctgtacaacaaggcttccctaaatagaaacaatatgtaaatgagggagtgggactgaatctggcctcttcctctgatccagagggaaggagctgccctcaggtaaggttgcatgaatggctgaagttaaaacctcactataagaagcaggaagtataatgcaaaaaagaaagtgacagacgcacttgaaaagctttctcagaaataagatgacagtgaggaaaacaaaataagatctggaccacaaaaccagacaccccagtatgtacatacaaggagccctccaaagagaaaacatcacagagcagacatcttgatgagaatgataataataatagtgataataaaagcctttcctgcattgaaaactggaggctatagattaaaagaacatatttaaatccaagggaaaagaaatcaagtcaacacacatccatatcctaataaatgtttctgatgtgtggagaaaattctataaaccttcagacaaagtaaatgaagagattacctacaaaggaatcaaaatccaacgggcctcaggctcccctcctgtattcattgctctaagacagcggagtcatttcaacaactttgagggaaagaaaaatactcagtcaagtctccatttacatttaaggttgacataataacagtctcaggtatccaagggcttaaatattattcccttcatgggggaaaaacaaagtcttaatggcaaatgccgatctactaggggacaaatcaaaattaagaaaccacaggtggaaaatttacaatgttgcagatctatgagcaatgaaaagctattaaagttgtccaaatacttagtataatttcaattataacatagtagaaacgtcaaaaacagtgtttgaaagggatgaatccatgttgaaattatcataatgtaaaaataatacaggtcttaaaacctagatcatattaataaaaattggaagtagggggaggagaaggactaaaatcatactgtttaattcttaacttcgatgctttagggaatgtgggtttaaatgtgctttcaaaaacttaagggtaaccactattaggttaaaataggatgaatactttccaaatcaccaaaagggaggaaagcagagaaagtccaacccacatagcataattaacaagtgataaaaaggaaataggaagtaaatgcatcaaaaagaaaaccaggaagcttaaagacaaaaaacagaaaaacaaggattgtgctatgaaatattaggctgccactaaaaaccatgtttgaagggtacttaatcacacaggggaatgttcacaataaaaagtagagatgaaaacataatatgtacatatatatactctcaactttgtctgtatttaaggttcatagagaaaaaggcatagggatatactcaagtatcttcttttatttaaaaaaaaataattattattattttgtacagacagggtctcactatgttgcccaggctggcctctaattcctggcctcaggtgatcctcccacctcaacctcccaagtctttggtattcacaggcatgagccaccacgcccagcattaataattttttgaagatgatagaatttcaggttattttttttcttgtttattcttgttttatattttccacaaataacacacatttctataattttttttttttttttttttttttgtgagggggaccgagttttgctctttccacccaggctggagtacaatggtgcaatcttggctcactgcaacctctgcctgtcaggttcaagtgattctcctgcctcagcctcccgagtagctgagattacaggcacacaacaccgtgcccagctaacttctatatttttagtagaaacggggtttcaccatgttggccaggttggtctctaacttctgacctcaagtgatccaccccccttcagcctctcaaagtgctaggattacaggcgtgagccatcgcgcccagcctgtaataattcttaaaaacaatcaacattataaaaaataaaaattgtagggtaccatgaaaccaagctgattgttcttcccaggggaggaggaagggccagagaggatttggaaggtattatccagcacaggttaggtttgatcagtcagtggatgctgctgggttggaaactggattttccatctaccagtgcacactcagccctcagtattcttagagcacatgaggaaaaaaaatcactattaagctttaatttccagagcccttactgtgtgctttgtgcaatgtactttattctcacaacaacccagagatgtaagtatttttagcccatttgacagatgaggaaattgatgccagagaggataagagacttgcttaaggttacatagatgggaaggcaagctgccagggttagaaaccagcccgtttgttgaatccctaataataatgtgtccccttccttctggaagttaggcagaacttgtgtggacttcactgctattattttttaatctgctcattcttccctctggcttacggggacacaccatgagggccactgtctcttactttcagctggactatgaatccacatgcccctgattctttcacaaagatgctgcaagccacccctcacaagggcttcctgagcagacatcttattccttccagtccagcatcagtggataaaacagaactaaattcatcgctattccacccaccccaacttccttccttcataaactagccacagagcagaggcccaggagcctgtccaatacatctcagggtcccaagtacttctccccacaccagcctaggaaaccagggctggctgtcagcaaaatgaataaaattcctatgtttgcctaaaaggcaggggaggggagtggagagcttacctctgaattgcaatgttactaggacacagtttgctgtaataataccaattaacatttctccccacttaatagtttctagtacaggataaaaatagcaatacacgtggtgctgagatgcgaaaaataacaatggaaatctgctctggaagagtcctgctctgtctcaccagggaagggtgaggaggtaagtgggaatattaggggagattcaggagggagctgcagagaacctgctagaaattaagagtctgccattgtcttacttctcttctgtcctcagtcaccagctataccaccagaaggcccctgtggcatggcgagatgccgtccggcttggaatgagaagagttgattgctgggtctccactctggcactaaccagttttgtgaccttgcctgagtcagggaacctctttaacctgattccttatctgtaaagtaagactctcagcacctgcatctcaggtgggtgtgcatcgaaatacagtgaaagggctttgcaaaatatgtggaatatgtgaaaaatgtgtcaaaatgctttgcaaaatatgtgaaagggctttgcaaaatgtaacccgagattcacatgtgagggtaggtccctaagaatctgtagtagtgatgcaggtggcacttgccaatacaacaacctttattgatcaacaaaacgaaaattaccaggagttagtccctcccctcagcaggactaaaggatgccagtggtgtaggcattctatggcgcaagctcagcggacctacccttcaaggaccagcacctgtctacaaaaagattcctcagatggaaacagctcttcctaaggacgagtgtggcctggccagaagcccattttcctcaaagctctgatatatttggctaggagagaggatgcccagtcatgctggagaaatttcctggaggctggcttctcttcaatggctgtcactcagagcctgacccagccccggggagcccaggtgccatctatggggagggtgaatgatgaggcactggaagtttccctccctcctttcattccctccaccacttgcatcccccactccccagacctcaccccaacaactggacacacagcccatagatagggtgatttcacgattcagtctagacccccccaccaggcagtgtggaggctggggcctctagttgtgctgcattgggtcccctgagctcccccgaggtgtcctaggagtctttggggaacactgggaaaactgagagggaagctctgaaaccacttcgtacccaccaacatacaccctcaacctgaaatgatttttaccagtttaatgtttggcttccacataagattttatacaaagaaaaggttctgtctctaaactctaaaaagttttacaatctttgttcctggggcttataagaatccagggaaaggggaccttaccttggtccttggattggagtgaagtcacctaaggacccatccaaataacgaccatgttttattcctagtgggaaaatgtagtccaacagtaacaccatccaaaatctctctgggcatgtggctaccacacctaagtacaaggaattttctgtttcttggaaaaagcccttcgtcctctcccatgtgctgtcatcccaggatcatggggcctgggaatgtcagttcgggccagatgagttcaagtgagcaatgtgttatcacaaacttggaaggggagacaggaagcaggtttggtgggaaggaaagaaagcagaaagacccagaggagaccacttttcctgcagagctggaggagagagggactggaagagcccacagagacccatctgtgtttttcaaaacgcatttttagaaaaagaggaggctagggaaacagagacacctgcttagagccagagaacattcccttcgaagggattcaaaagcacatgggcaacacaagccactgtgccaggtacccacgcaggtcaggggcctggtctcaacttgggaaacatcaagaggccagcaagctgaagcccctcagctcagcttctcccctcagagacgaagaagctggaagccatcagccagctaggcagaaaggggtcatctatcattgcttggctctgaaagatcttagagcaagaaggatccaagagagagggccagtgtgaaagggggaaatatgcaggagggacaatgtctgacattttttggaggctgtaggtctcgggcaggagttgtggctgaccacactcagctcagcctgagcccaacagggcatgatgaggacccgtatgggctctggagccaggagtcaggccctgcattcaaatcctgcctccagagcctgagacatgtggccttgggttagctctttatcctgtccggacctcagtttccttgagcgtccttagcaacgataagcatatctactttgtagggctgttctgagggttgaaagagttagcagatgtaaatcacgcagagcagcatccacacttggtaagcctgcagtcagtgttggctggagctgctgtggggaaacccccttcacgctgagccccattgggtccagccctcccaagatgcaaggatggaggtgggtggatgaagttcccctggtggcagtgggatgtgaacagcacccccacagcaattctctttatgtgtaaccccctccctcgggggcagtctctccacttccatcttttctttttctcttctctctccattttcctccttttttaactttttaatcactttctaagttctccccctgtgttcttttagcagatttgcagagccatctatcaagaagcttaaataatgaaggaccatagttgcaattgcctgttcacaggctcttgggctttctgggtgattagaggagactcctgctgggggaagctgcctgactagaatgttttctaacctcttagagaagctcccatggctgctatgccttagctgccctccatgatcattagcgactccctaagcagcccggtcaggtaaactgcacactacttgctccacacatggaaaagcctcagagggactgagaagtcactggtgggatggggactgagagtccacagcccctgaggctgcctgtctcccaattcatcaagtcacaaaataagatgaggagctcctagcccacctctctggggtcatctccacagctctgcagagtggctggtcttggggccaaaagaggtgcgagggtaattgacctatattggggggtgagtttgcattatttttccagagctgagtccgtcacagtccctcacagccaaggtgacccattaggcaagagctcagggttccgcctgagaccgtgggccagaggtatttgctgtccccctgcaggggacccgtgaaagaccttggccttgttactatactgcttcatacaacttgatcgtcccatcctaggctctgaaaactggtctgctcaccaatggtactcaccaaaaacttctttgaagatcccacctctcagctgggcatcatgtcccagtgcatgtcctaagcacatcctgtgccaagcacattttctggtcttcagttcaaaggtgggaaattaacacacagagagagggcaaagtaactgccaaagatcacaaaattaaaagacgttgaacctagggacccagactcccagcctattcccatgatggcccaagagaatattcccataggtggtatgggagtaagttgtttcggtctttctaatacttcaaataacctcattattcaggatggtggtgtccaagtggtgaaacagaccatccctggatggcagcactaccgaggaacacacttcttggctgtgggatccttttgctggctcactttggaatgccaacatgttccaaatctctccaacttaatgaaacacctgtcccctctaatgccatcagcagtaactgcacatggctctcacacttgcacacacatgcacacagctccagctggctcactgggtggttccttgggtacatctggctgcactcctcaatccatcctggtgtgaccgagttggaataaaccccccagtccttagctctctggaataagagaaagttttacaaaaaaaccctgtaatctggtatcaactgggcctaagataagcctcaagtaattacaacagagatagacaaatcgtacattcaaactgccaaggctttaaatgacacacacacacatacacacaaacacacatacacacacagacagatggtattgttgaaaacttaaaatataattcatatttacaggacatgatttagaaattgtccccagttactattttgtaaattggtgcttatacatatgccgtatgtattctatatcaataatttttcctaataatgttattaccttgcacactcaatcccagtgaaccctgaaggaaaaaattctcatctcaagaatccaaagagctgaggtcaggtggggaagtcttagccttatggtgaaaaactagaacaggcagtcgaaggggcaggcaatgcttctatcgtccctttttagaacactgctctgtggccctctcactcttcctgcagatgtaggagtagaatgagatgaggagaaagagagaagaatgctttgaaataagttatccaaaatggcagacaggtcctcctccacttttccaggaacacctccctcccttcaacacacacaatatgcacacgcacacacacacacacacacacaatacacacacacaatatttatgcacgactgttacatacacacatttgaggagagaaggaattatgtaacacatcagctgttcattttcacaggcccacttgaaatggagctcaatcttataagtatagaagtctggggtgagcgtctaggaatttcaacaggcactgagaaaatgcccactctgaagcacagaacatggcctgtggaatgctcgaaagcttccagcctggagggcgacctgagatgttagtaccaagggcttcctctccagagcctcagtctccacatatccctcagactaacccctacagagctgggtatctcgtagggaaactaaattgagctcggaaatgcacaccaaccaaaaaaaaaaaaaaaaaaaagaaagaaagaaagaaaaaaaaaagaaaaaagtattttagatccaaaagggagcagtggcacaatgtcacgatgtaatacaagggcatgggttttggagtctgtggatgaagaaatgccttacctccctaagtttctttagggtaaattggagcaaaaatcctcaccttgcagggttgctgtgagggccttagaccatacatgtgtaaagcattgatagcacaaagttcaccatggagtagttgctcactgttttctcattttccattccctctcttcctctccccagccctgactgattggaagtcatttccgctttttcagcagacccagcctcagctgatgattcacctggttgctggaagtgagttctgtttctcaaccctgggattgaagactgactttcaataatttgattgtggagttcttagccttcctgaaacagggctccatttggatgctttgcaaagccaagcagagaacatgtccttccagtgagaaagtagcccatgggtcttcattccaatatacctctgtggtttctcaatgcattcgtccattctaatttttctgtctacctaaaatctccaagaatagaaagaccactttttccttatttgatcatcacatactgcctaaaatcacatcttgctcaacagtaactgttaagcggaagatggcagtagtgccaggaaattatcagaggaaaacagaaacaaaacacaacataagcctggtcagtcacagtttcccttgatcagtaaacaaccaaggtcggtggtgactcccctttgggagagaggacaccatttgccactgtcacaactggccctgtatactgtcgggttcagtggcagatcttctcattgggttctaatagctgctccacatgccagagccaccaaaagcctctctgccttgtccagttaagacaaagatgaacttctcaaaagttttttatgcccaaagctcttccaaaaccaaggggaagaaactctgtatataatgaaacctcaaataaagtcaatgacactgagaagtttacagagggctcctctcaataaatatccaagagggagagctgacagttgtcttgaccagtagagttcactgggctcagaaacaagggggggcctgtcctcaccccatctggcttggatcagaggacctgaagtgctctagttgggaatgatggcaaagtttggtgggattgtcagtctttgtaaaaactttctcaccttctctttggatgtgggcctctcagtagacctatctggtcccaaaatgccatcccccaaacttcacacctatccccaatcagttttgcagatgttttagaggaatctccacttgtataggtagaatcatgccccctccccaaagatgtccacatcctaatcctcagaacttgcgaataggttacctaacatggcaaaagggacttggaagatatcatgaagttaagaaccttgaaaaagagagatgagcctggactatccaggtaggcacactcatatcacatgagtccttaaaagcagagaacttttcccagccttggtcagagggagggagacttgactatgaaagaaaggccaaaaacatgtatcactgctggctttgaagacggaggaagagaactgtagctgaggaatgtgggtggcctttagaagctgaaaaagacaggaaatagattatctcctagaacctccaaaaagggatgagctcctggaaaggcatgaagacctgccagtgcctggattagcccagtgagacccatgtcagatttttgacctatagaactgtgacatagcttggatatgagtccccgcccaaatctcaagttgaattgtaatcctcagtattggaggtggggccttggggggtgtgattaaatcatggggtggatttctcattaatggtttagtaccatccgcttggtgcggtttttgtgatagtgagagagttctctcgagattttgttgtttaaaggtgtgtggcacctcccccatctcttgctgctgccttatctatgtgacgtgcctgctctcgattcgccttctgccatgactgtaagcttcctgaggcgtgcccagagccaagcagatatacaccctgtaggaccatgagccaattacacctcttttctttataaagtatccagcctcaggtatttctttatagcaatgcaagaacggtgtaatacaaatagaccgttgtgtgtgttgtgtgaagttggtaaatttgtggtcatttgtgacaacagcattaggaatggaatacactgcccgttcctggtgaggtgcccctcttccttcatcccttcatggcccaacttctctgaaagtgctgctggctgagtcctcccatgggggcacctcacctgttactcccagcgatcaccttggccctgctcctcatcagtctccttgccaggacagcagcagcagcctgttctctcctctctccagtttcaaatggccctggttccttaaagggccttctagatcttgtttctaatccctgggaccgtttgagttccaaacatcacttgtcagaaggatagaccacagatgccttggagtgggaggaggaggaggggcgctctttcaaactctggttcccccttcacccacttccccacatatggacttgtaaaacaccagccacctcgctttccataccaaacaacagtacacgcaagaacaaacaagcagggccacggcctttcttactggaaccaggtatgctttctggcttgtttgttttctcagaatttaaaaatacatcgagtgtgctttattgaactgcccaaaaagggacacacctgcagcacctcataaacttgtttgatcaaacaaacaaaagccaaaacacttttctgatggagtatttctcggaacttgtactctgcagaaaacactctgtaaagtttgcttgtaaccacgctccattatcgtctacaagcctcagaagtctgaggaatctgagcccaccctgacctttctttccgattcaatctgcatacttgctttttgatcatgaaaataaaaaaattttgccctgatacttttttccccatatcttcatttatttttcttggggcctagcaaggtcttttggcaagaaaatccagatcttttctcgctcagaaatattttccttattggatttggcttgtttcttaacttgctctggtcagttgcacaagagcatcaattatctatattttgctggattcttcatatctaccatggcttcccttatgattatcatatttttaattccctccttgggcacaaatgcaaatctttagaacaaggaaactgggagctgaaaagagagaggtaagaatttcagaggaagaaggaagcctctctcaacagacagcagcaggggcaatggcaggagccagggcagtgcacgggacacacccccagccgaccgcctcccaagcctgctggggctatggaacccaattccaggctgtcagcagagacaaatttagcaccgatgatctcatcttgcagaacagccccagggctcagggaaacatcactggaaaagctgggaagtggacgtcactgctagtcccataatgtaggtgaaaggcacagggcccctctctcagctcactaaaagggagcaccaagaccacaaggagcaggtacaggtgatggtgagggcgtggccagcggggaacaggctggggggtctggggcattactagcctgctctcctcagagtccccacaaccccaagcacagtgagctgaagttccaggacaggtccacagatacggacacacttcgtttgagatgagtgacaaacagtactaaacattatcattgtggagttacagcttctcctgtcaggcccacatcaggatgttacgtggcagagtatttacaaatgcagcagcaggcagaaggtagagagagtgggggcacattccctcttatttactgaaaataagaccaaatccctgcaaaggggggcaaggatcccttgtctcttgcagtgagtcagtggcagaaaaagatgagaacttgtcaccaggtgcaaaccccaaatcttgccactggctcaagctacctctgcatggctctgaagttggtttttctggcttccttagccggacacttttgctggtcagtttccctgcagtttcttagtgtgtctggtggtcagattctccctcctgttcctggagcaaagaggcctcagcggctcccccagtgtttcccaaaagcagtcccaggagggcagtggcggcaggtcctttgctgggatggggacccctgtctcctgcttctgtagctaatggacagcatcccatgaacctttgtgaagaaggaaggtatgaaaataactaagaaaagcagacttgacacctctcacaaagaaataaatacatttctaaatgtcaaataaacataggtacttacagaaggcaagaccctccaaaaagagtggttcgtatcacactgctaatggggatggatagtgatggcaaataaatattgtcacgttaaaaaggccaggtttatattcaagcacaccagggccactcctgtgtcagtttcagtcatattagagaagatcagctccctgagaacaagggctaggaagctaataaattccatactgggaagtgccatgggaacgtaatgaggggttatcagagaaattagaatgtgcaagactccgtctcaaacaagaaaaaaaaaaagaaattaaaatgtactgagaatttggggtggccaccaaaataaaacctctcccacccaagacagcatgaacattattgtggttaaaggaaagaaagttcaacaagcaacttagaacagaactgacagcatctcttcaagtgaagacttcagagaaagctgcaaacagaaatgacaaaaaacaaaacaaaacaaaacaaaacaaaaaaaaacagggcaataaacacctagaaggcggcattagggctgtgcagcagagcccaaatgcaaaggcagcattagcagtggaagcaaagaatccttacggggtcagacccacagggctgagccaagatcagatctctctgtctcacacacacacacacacacacacacacacacacacacacacacatgcacacaccagctgcagcactagggcgtttgggaaagacacaaaattagtttagattgtaaaacatttatcctgtagaggcaacgtgagatttttttctgtagttcttttaattaaaagtgagctcataaatcaaagcccctgtttccagcctgcaggaggtagtaggagtgaacctaagccttgcagagctgagcctgccccgcccatcctgctttccatcacccaggttattcaccccaattacaacaccgcacatgttacagggactcagtgagtagccaagggtggctctgatgaattacatctcactttcttcactggggtctccgaagttctcccaaagagatattgagcacatgtacacacacacacacacgcgcgcgcacgcacacacacacaattaaatcctatcagaactggttagtgcatctatttggagcatctgctgtttcccctgcagagccccacctctggagaccttcccctcctctgcatttctaccttgcctgggctcacatggctgtttgcatttgtgagtctgaagactcttcttagaagttttttaaacacagaaagtcttatggatccttgccatcttcttaatttgttttaattttttcctcctgggtgaattaaagaatgttctacagacatgaagtctcactaccctcagctcattcataagagagatggagggagggtgcatacattaatatgctcattactccaaaggtgacatacgtgtggataaagaatttgtcccaaaccagaagtgcagccagaaacaaagttaagatttcctggatgtcggttccaagattttaagccacacccaggcctggctcttaacaatttagagggatggctggccccagacacagaccagggcagacacctgggcatgaagattgcaggagtcctaggagcagtagtgggaggcagcagggtggcccacagtagctcccgttgcccctcccagccctccttgggattgacagaatggttgccgtgaccagcggaggaagcacattgatttcccattttcaagctgccccccagctccaagcatcttagagctctttatgtgcccatactcacatgtgttcacagttttagtgggaaatgaggacaaagaaacggaaccccctctaagagagaaaatgttagagatagagatgaacttcatttcagcttcctgcccggtatctacccttgatgccaggaaccgctctgtcactgcatcccccaatcccactgcttccttctgcccctgcccccgcacagaacaagaatccagacaaaagcacaggtcaagggagaaataaaggtcccccttcccctgacccaactccctcagaaacaatcagattcaaggcagagagattaaattatcactaagctaattatgggactcacacttaggctggctgccgggaagcgaggtcagcaagcaagagacattaacatgcaaattgaaggcagatgcaaggagcacttaaaaaaaagcaaccgggagactgattccccccacacccagaggagaaagaagccactctggtggttgaggcactgtccatctgggcaatggtcagggcatttgacagctaaatagctctactctgtcatcatcctgaagccaaagtgggcgagtcagaggtaaactgattaggtggtgtgccgctaatctcccagagagaacatgagggaggtggatgcaaggcagagcccagcgggagcagccccaggcttgagtgcagagaaggctctgccggttcctatgcttgcatgtgtgggtgcctccctgtgcgtgggtgaacacaggtgtgtgtgtcagctgggtgtttgtgcatgtttatgactatggatgtgtgtatggagaggggatacagaatcaggcatgtgtgagtatatcttatccacctgaaaatagaaggtgaagagcttagacagaatcaaagtgcccctcctagcataatagccaccgggcaactccttaagagctttctgagattgttaaggcccctgcaattgctgtcaccagctcagccatgaaaatacatattatggtacccagttatggatgactgatgcttccccaggcatcatcaatatgatgcgagtttaagacatgttggccaaaaacttggcagtctacaaaatgactttgagagataaaaatcaatgtttttcaatgcaatctgcaggatagcttcctccactcaggattctgactctgcaagtctcttgccttttccagagaggagcaggttggcagggaaccctgatacggaggcatgtgagcttgttttaagtcagtagacagctttgggttccttgtcctgagaaatggaatttaatgggcaatatcctgcctgtgtccagagtgaatttttggaacccatggttggcaaggggggttcagaggggaagtgggggaatctctggagcttaaattacttagggaaaattaatttggaaactttatttaattataggtaaaagaaatgcttccataaatttgggtaatttaattatccaagagacatctgctgaacacaatctaatcattgtatttaagtagaaaagtgccctcactcttaacaaaactaattttggggagatacaaacattcagagcctgactaatgaaagaaaaggaataatttcagtttcagttttaggaggaaaaaagtaaatcacaggaaaatcatctgagagaggatttagttttttaaaaatcttcaacattatatctggggttgatgatataaaatcagccatatcctatattttttgcacatcttctccaatactaagcaaagaagagatcacaagctctttaagtcaagaagtgcctagcgcattttagatgaccaagaagatagttcttgactgaatgttgatgttcacaaaaataaaccttatgataaactgtatggacagaattatccacaaaatattcattgcccttctctcccacctccctgcatacatacacaccagccccctccccaggctccaggcagggttatattttccacaccattcactttggctgggccaaaaaaatgggagtgggccaccaccaagcagtagctttaacaaccacggcacggttctgccatctctcttttcctttggccatgagatcaacatgtcccagacaggggctgcccttccaagtctcccagataaataacatggagcagggctgcagccagcccagggtgcacatgaacgtgagttgaaaatagccttcgttattgttgttgtaagccacctaaacttgggggtcatttgttactgcaacataatgtagtctaagctagctgatacacacacacatgcacacaggcactagaagaccctaagccccagtggtccatcttcaaatacatttttttattcagcatttgttaccttcgggcagtactgtgggggcaccttcagtttaattggaagaaggtataaacacactggggaaatagatccagctatattaatgaactgtattttctatgtgaagaaaatgaacaaattcctttcagaaaaacatctcagctacaatgttgaaagcttctattgcctataattttggggtaatcaaaatgtggctaaataaaaaccaaatttataaaatggatacattatgaggctattaattttagaaaataattctccattttagaaagagattcattagtttcctacaatgaatccacatttcctacccaaaaagagataaagaagcccacagcctggttgaggcagggaagccatcagtactatcagcatccctccagccatggcccttcctaggtcacagagcctctagggtccccagctgccacactagctctacttaaggtcaacattgtacaagttcaggcccacctagggcataagccaacactgcctaactaaacctccctggatctaagaaagactcattctctaagtgaggtttaagatgtatctttctctcccaagtctggtgtgtctgggaaaagacccagaacaactttgatcataaagatgaaataaaataaaatattccaggtatgctaacctgatgcattgaaaatatggttataattacatgcaacatttaaaaaaatatgtttactcatcacaagtgatacttgtagtagaggaatcctgtctgagacagaaaatcatggataagttttatgctctgtgggggaaggaagaacaaaagggacagagctgaattatcactggaggaaatgttggtctgttgcagaaagaccaatgtaaagaatgtattgacttatagatttttaaaggtagactgaagatatctaatcattttcattattataaaaaaccacgatgtatataaggcacccatatatgatcttaggtagaatcctgcctagaggccaaaatggcaatttgtatctgagactcccatgggaatacctggaacacagtaggattttgtttaagttttggatgcaatgatgagggcaggtcgtcaggtggcttcaacatcattctggcctctcaggtccaacaatacctgggaacactcagatttagccacctccagccccagaatactcatatcttggtggggaggtaaaagtggttaagcagaaagacaacccatctctttccttccaacctccttgccaccaaagcctcagaagccttctccagcaggggagaaactttttggaaggcagctcaaaaaagtctcatggccagacatggtagctcatacctgtaatctcagaattttgggaggccgaggtgggaggattgcttgaggtcaggagtttaagaccagcctggacaacgtagcaagaccccatctctataaaaaatgttaaaaattagtggagcatggtgacacatacctgtagtcccaggtacttcggcgactgagacaggtggatcgctagaacccagaagtttgaggctgtcatgagttaggatagcaccacttcactttggcctgggtgacagagcaagaccctatctctttgggaaaaaaaaaaaaaaattcccaaaaggaaaactgggactaggtgaggcactgggagtgtcagagggcagccccaaggaagggagagcctgtgaggtggggtaaaaccccaaaccaacacccatttctcacagatgcaacccttggagagcctttcctaaaaggactcaaaagggaaacccaggaagccaacaaaatagagctgggtccccatgcagctgtgccataacacagggcaaggggaatacggccttccacccgcaccttagtgagcccgggaccccacaatgagcaagggagagaatgccgcccggcagtgggtgtccaggagtggttttggggggaagaggattgctctttgtagattctttgcattcttttattaaccatttttttgggatagggtctcactctgttgcccaggctggggtgcaatggcacgatctcggctcactgcaacctctgcctcctgggttcaagcgattctcctgcctcagcctctggagtagctgggactacaggcatgtaccatcattcccagctaattttgtttatttttatattttagtagagacagggttttgccatgttgcccaggctggtctgaaatccctggcctcaagtgatccaccctcctcggcctcccaaagtactgagattacaggcatgagccactgcgcctggcctctttgcatttttttaaaaagaggtttgactatataaagaactatgtacacttctgaagtagtctccctaacctcccattcaatcatactattaccccaagtccccatatctataaagaaatagcaaagccaacacggcctcaggccttcctaactccacatcatcctgagcaaattaattggtcaagataacatttgtgagcacaccttcactaagttaaaagtacaatactacagagcgacaggaaggaaaaggtaagaatggagggggtgaaagtgaggaaagtaggcaaaggattgtgagaagagccgagaagctcaggtttgggggatagacactcagaaggaaaaagaaggttggatgtgctggtggtgacaagtgctccaggtgactgggagtcacaaggagactggctaattaggccctccattccagagcacttgcaaagcaataatgacccgtgattaggaagaagctgtcatcctccaaatgggtcaagacagggaccgtggataacccgtcacaggaaaaatcacccagaaccacagcacacagtcccacaggctctaggagggacaattccggtgagaaaccaagacaaagatgggcccagtctgtcacaggaaaaatcacccagaaccacagcacacagtcccacaggctctaggagggacaattccggtgagaaaccaagacaaagatgggcccagtctgtcccaggcagcaggccaggggtaagtggaaaagcacagctcggctgcctcctggaaaacctcctcccctccctgtggccacctcccactcggccacgggatccaagctccagcataattgctctcagaaggaaattgcccgtggaggcaggttggtgatgtgagagcagccatggaggcaggagtcccgtcgtttctaaggtgggagcctcttccttggtatttaaatttagccagggcccttgaggactcgaaatgtgaaggccgaggcagccagctgaggctgaatggctgagccagggacctgagtcctcagcatgtcaggtccacttccatgcaagcaaagctacaggcaaggggctgcagaagggtggatgagacaagtccagttttgtttttcttggtgacaagggtgagaggattagaactgctttaggaagctgaatctgccatctaggatccatccaaactgattttcctgtccctaaagtgctcccctctttaatccatcccaggaagatggattaaagaggggaaaatcagtttcaaccgccctagcatggacatcagggcctgagacagggcagagacagaacagagggaatgaaaggagggttctgagcaacaggctccagggtaggtaccagaggtccagccaccacctcctccctccatcagggaggtgacctaccctacagcccaggagccaggccttaggtagagtctgtgatattactcgatacgggtcccaggacaacctcggattagaccgtgtgacctctggggagttacccaaccccttttctcctgggtaaaatggaaggtgtaacatttaccccacccccaaaaaaaaacattgaggattacatgtgacaatcaatgtaagtaacatgtgaaaacatctagaacaatcctggtgcctacacggtgttcaaagctcagtagttccctctgcaccacctcttttctgccagccccaaacactaaggaaacgaccccttcctaagatgctgggtgcctccccacagaggccaaaggcagaagatatggattctccatggccacacagagttctcggcagctactgattcaaaatctaagcatctcttgtccatcatcgagcactgccctctctccagatgaacggagcacctgggactgcctgctgagcccccaggcctccttgttgaggaagtttcctcacccctggtcctgtgggtgtggcgactgcttcacagcctcctgtttatcctctggattctctactgtgtttgcacaatcaaagccacaagccaaaagacaggattcagtgcctgggccactggtgttcctgaggaaggccgtgtccttttccacactactaaaaatgaacttgaagtttgaaagtatgggttcaagtcccctcaatggctgagaaacaaagccctcatgtagaaggcagcctccaacatagcccccagtgatccccacctctgggtattcatgacctacagagtcccttcctggagtgtgagctggacccactagctggcttctaagacataatacagcaaaggggatggggtgtcacttctgaaaccaggtttcaaaaagacaatggcttgcaccttgctcagcctctttctcgcccccatctctcagacatcgttctagagaagcctgctgctgcactccttgttgtgcacgtggcctcatggaggggcccacatggcaatgtagggatctctcaagtgaggacctgaggcttgccaacaaacccgggagtgacattggaggtagactcttccccattctggtctttagcagtgggatgactgcagccccagccaataccatgaccctaagccggaggacccagctgagccatgcccagattccagaaccacagaaactgtatgtatgataataagtgttgttcaaagcctctaagttctggagtagttcacggcaatcgataactaatacacctgtgtctcctgggccaggagagaaggtatggagtgagtgtgggagcttcgagaaactttttttttttttttgagatggagtctcactctattgcccaggctggagtgcaatggtgcgatctcagctcactgcaacctccgcctcctgggttcaagagattctcctgcctcagcgtcctgagtagctgggattacaggtgtgcaccatcatgcccggctaatttttgtatttttagtaaaggcagggttttaccacgttggtcatgctggtcttgaactcctgacctcatgatctgtgtgcctcagcctcccaaagtgctgggattacaggggtgagccaccgcgcccggccgagagacctcttttaaaaagtcaccatggatgcttctatgagaagccagaactgctgcgaaaagcagcaccatgacatcatcaataagcaagcccagtggacacattcccaggaagttccctaagaacaagtatggactttcagcagaccccaaatcagaacatcaactcatgggctgtgaattggtccaactgccactgccttccccatcagagtggctgaggaaatcatagcaattgccggtaacaaagacctcccctggctctaccctcgctaggagtcttcactggtattgacatcaagattctattctcctatccagagtctagcaggtgtgagcccagcagtaaaaggaccacttatggttgggggctcattccctcttcttgcctctgcctcctccctcttcctctgtacatcatgtctttcatcctttcccatctttgttgtcttggttacatggccagactcctaatatgctgctagttttcattttaatgatatgtttttgtaaagcacaatattttacttcaattgcatgtgtcactggataaattcctctagtgcgtctgacatttgtgtatcagctgactgaatgcgctctatgatttggggtgtttgtgcagcactttcttcaattttaatgtgtttgcattttaatttatgatcaggatctttctataccaatgtgtgtatatatacacacatatgattcaaaaaagtggcacacgtatcaataaatcttgaattggcaaagctcatttaagactatctctttaaatcatgtgcactagcaatgatcacttggaaaacagaatgacaagtgttcctgagaaactctttgctgggatttcaatgtgtgtttcaggaggaagtcaggaggagaatgcaacaatgcctagctattggctgcagtagaaatttcacgatgagaacacctccccgggtttattcaggtcagcaaggagggaccacttgagatcccccagggatgtgcagggaaggtgggtgggcccaagggcagaatagtgagaaatggaaaaagataagaaaagagggccagtgtggccacacttacatcaaaagggtgattgagtgagggcttaatagtgttcaagaatataaaatatgtccaagaggatatcaaccagcttagttgctcttttagtcaactgagtaaaacttgggaagaaagcttaaaacatagcagaagagattgaaacaaggtgggaggaaggcccatgagaagtggatacattggtctgaggcaagatcagtctgaagggccagtcttagaattcccaggctggaaagactaacgacagaatgccgtctgtctgtggttgaacgtgaaatcagaggagggagggtggcacgctggcacacctgtgggatcttctgcctggagcccttcaacctcagcctccccttcacacaacccacagggtaaggtctatgcaggtttaatatttgcaaaaccagggatggaaaatgcagacacaatatagcaaatagagggtcttttcctgtcatggaaatcggtcagccctgatgcttctgcatttctttccctttgtgcttgtgatcaatcacacatgaacccatggcagcttgggctggagaaacatatagcacaacagaactacctgaccgaaccctgtatcaaatacatatgccctctgccctaaccacatgttcctagtctatttggtgttccaacattgtatctccatttgatttcctgacacttccatccatctgcagggctttctgtgctatgaatatttatttttagttaaagtggattcaaatttccagagtaattttaggaagaattcccaggtacatttaggaagcaacaaagcagaggctggactctctgatctgatattgctttgtgacttgagcactgaagatacacacacagcatctgttcctgagaagcaatgttcgccccaggtgggtctccctccactccaatccactcctgggtgattcccccttgtggacctgtgccgaaggactagggaacaaaagcaaattaattttaaaacaggcttgagaaaaaaaaattaggaagattaaattaatctacatgacaattcccaataagaatggtttttgtactatatactcctattgcctcttcatgggaatgtgcacccagtacctattcagagaggctggtatggattagtctgtgcacagacacatggatgcatgtcccgcaacaggctaatagcagggccagccagagttccgcttaaccaacatccatacagcgctccacccccttaggtgtgaacagtttaacctagcaaaaacatccagggaagacgcaatcaccagcgagaggagcaatcacacctcaagtggaagtttatgatgttttggttcacaatgaacattagtctctcccactaatgtcaggcagtaattcaccactgaacagcagccataaaaatgatcgcttagtgaaaggaaagcaagaggcagagaaagcaagagagggaaaagattccagcagaaatattcaagcaaagaaatctcgtgcttctgagacaacactgagctgattgtcccaactcaagccaaagatttaggtttgcttggccctaaagccagtcaagatggcatttgccttatgatttttacctatagtggaaatgttaacagtctgtaggttattgctaagttcctagacacctgcttatgactgtagtatttataggtcatatttcttaacacacatacccttaaagctcaccacaggaagaggctgccaataccatctgcaacacacacacatcagaaaacatcaaagacatctaaattggcactttcctcacctcctttccccccgcttcatgtgacgtgtgcactaaaggagtgaaattacggtcgtcaaagacaaggttgcaaatgattgggactcatgcctttcaagcaaaataaaaagtaattttgagagcagcccacggatagctcggtctagctcctggacccctgaaacccacagcaaacacccttactcttagcatccccccaagctctctcctgcccacctacccccatttccagtctcttgtcataccgtaaagaactctgaaaggtccttgatacacacaggagattattacagggctcagagaaaccaactctgtaattatggctacagtatgatttccattattctcacgccctggcctcagtcacttgcaaaacttccagcaaaatcctcctgcagctccacaacttgtcacggctgggcctctgcccaaaaggtgactgtggtcctgataacctctgggaaaagcaagtcagaattattacaaggaaaggggagtggtgcttagtgagtgagtgggggtggggaattctattgttcaagaaaaaataaataaatgggccacttttgctttttattatttcaaacaacagactcggcagcccagccttcctttcccaactcagactgttcccctgggccagctgtgctgagtctgcaggcacgggagccgggcttgagcaaaaccattaaaaggctgccactccaagcctgcagagcagaaagtttggccgccccagtggcctggctttccccgggaggaccgaaggctcattccccccaactgacccttgcgctcttacctttcaaatgtttatgcctcaccagccccaccactgctctggaaattagatagaatatcccaggtggctgaaacagaactgttcttatatcaacctaccaaagtaaaagatgggaatgccggccgcggtttatgaagccccagcctcttggtggggtattgcctgtgtcacctgtcactgcctgcctgaccgactgctggactctgtccttacctgcctcaggagggttgtctctgagcgccttgctggcccaggctcctgggggtgtcctgatcccaaactcatggtgctgcacttgacctccctgtcggggaacagatttggacaggcttccacaggcaagagagtaccagtcaccaaatgcctcaacccacccttggacaaacagcacaaaaatgcaagttgactatcttgggtttacaatgcagccatggtcaggaaacaccttcctttttccaagagaaaataactgttttgttatgtgcactgaactctcaatgttcatttcattgataacattcactgcccaaccagctcagacaatcacacacacacacaaatcctcatccagggtctactccatcctgccagctagtaaatggtcctctggcagctggtaggaaattcagcgggtaagactcttttagggcaaggcaggaagttacttctacattgcactgagattgagctcaccggagaaaagagttaaagcatcccccatactgcttgctgacttatttactcttaatggtgctcattcacccattgcagcaggtgaagcaggtctcagtgcatgaattgtacacagtaatgcccccggtatttagaattcacttttccagcagaccaaatttgccaaatcctactgaagaatcgagccatctgattcacctgcccaaaagctcatgtacttctctcctcagtgtggactgacgcgtgtcagacacaatttcagagtttggctatctggtttcctagcccaccaaagctggaagctgcagaatgagggaggaggaaaggtgctgaagtcaaccaggattcctggcagcaactggaagtgatgagtggccaagtgcatgagaggaagacccgggaaggcagcaaaaatcagacacaggagctgtgtggggataacatgcccatgtctcacagcgtcttccctgggcatccacaaaactcagttcaatatgtgaacaaaaatcacgaggagtctgaggcagcaaggaaagattccattgcgcttaccattttcttcacagaacggaggtatgaaatacaattctttgcagggaattatgaaatacaattcttaaaaatgtgtacacaatgattttgctgttttttagttgtgacactgaaggcggtccactcaaattaggcagttacttcctcctgggcagcacctgctgtgtggtacatcatggacaccattcttgcagagtaccatggtgtttccccagtgctcattgttttctttcccagtcattacccatagaattactccacacacaagttcccaagtcacaaacacactctggggtgcccgcctcttgtcctccacatgctcccattccagacacaccacctgtccgcagagatgccaacagaaatgattgctgggctgttacattgttggatggtaaaataggcatagtcctctaaatatgcccagaacatttcctcttgaccatccagagctagcagccagaaatacagcaaagggaaatggagggattaaggcttagtctcaatctttactcaatctgaatcacacaatgtccagagaaccccaaaagaagccaaaataaagcaagcaagagctccacatggaatcatcaatatttcctgggaaaggactaaaatgcaattattggccaacaggaaacaggacctcctgcctaccaccttagaaggacttttaacccaatcaagaagggcatgcactatagggccagttccaactcatgagatgagaagcctgaacacaaaacatccctgggcggatgactgctcccaacacagctgatgagccaagatcgcccaggactccagaacctgccagcttccggaagatgcaggggaaaggtcaggtccccagatcataccatctgacctcaccagagcaattttcatgttcccattgcacccgtggttttctcagcccacaacttggctctgggccccatttgcaactttaataggtctgcactttcctccatctgttccctgaatgcattccagatgatgcagcagccagaagggctggagcaaggggaacaggcatgtcccttccccctgcccaccttccccaattgctcagacctaataaagcctttgccttaagggcacaagcccaaattgaacacagcatacaccatttagaacaacactgcaaggctggtctgacacctctcatgtgcacaccagctctagggaggaggtgaatccacacactcaccccacaacctcagcacagaggcagagaaaggacaagatgatcatcatgacctcaacagcagcgtatctccttagctcaaatctgtatcacctgcccacacgcccaagttagcaaaaagatgtaagataacatccagcccaggagggacagactgtcttcacagtaaccaaaagtactgcacctcattcctaccttcttcagcttgccacttttggtgcccacaaaggccagagagtggttcttgtagacatatgcgatgacagacgtcatgcggtccctgtcctccgtgaagacgggaattccacgcaccatgtcggacactcccaggggagcattcatgtccaggccacagaagttatcgtcaatggttaagagctgcaaattttaaaaagagaaaaattagaagggagcgtcaaggaaattggcagagatattaagtcaggaaactatggaggtagaagaatccttagagatgaaacatctggtaacaatccctcttttttacatgaaaaacgtcactccagagaaactaggtgacctgtgaagagtcacctgagtgggcaggtgcagggacatggcagaaaacacaggtccgcaggtctcctttctccataatctgtgtgtctctgcccctcatccaacccctcccagcgccatcttgggagctttgtccatcattattatcatcatcatcctcacgtggaaaagcctcacgtggaaaagccctgggtcagcccagatgagcaggggctccaggccgctctgctcaggcacaagagggatgtggtctccgtatctatacacaaagaggaatgtggtcttcgtatctatacagaagagggatgtggtctccatatctggagcagacacacacatgaggactcaaaagtgtagactagggaactgaaaacattagcatgtaagtagcactatcacaacagaggcatgtgcaggcaatcagctggggaaaggagcaatgggggaaggaatgtgctgattcaactcaatgtgccacagctggtgctttatgagctccgacctcaggctccctgtgtcttttagagcattgtgaagaagggcagccctggccctgccatgcctacaccagcacttcccaaagtgccatccatggaaacccaggtccccgatatgctctacagataaaagggctctgcaggcaaatttctaggaagccttttaacaccatctaagagattcataacgattagttacatgaaaggtctgaaaagtatttttaagaaaaagtatgtttaaccttatctcagcctctcctaaacattttattcactgaaccttttcttccttttttttttttttttttttgagacagggtctcactctgtcacccaggctggagtgcagtgacatgataatggctcactgcagccttgacttaccaggctcaagcgatcctccaacctcagcctcccaagtagctgggaccacaagcatgtgccaccatgcctggctaaatttttgtattttttgtagagacagtatttcatcatgttacccaggctggtgtcaaacccctgagctcaagcaaccaccaccctcagcctcccgaagtgctagcattacgggtgtgagcccttgcacccagctgctaaaccattttgactgcaacacctactagtgttccttaaagagaatattctccagatatcctgtgagatactgaccctgactcgcttgctcctgactccaggaagtataatttcagaagtcaggaagctttggggccagttcccccactgtatttccagtggaatctctcttttttataccaggccatcaggtcccccttgaaacagagggtctcagctgggctctggggtgctggggagtggtgaagaccctggtagtagctggtgaaaagccctcggcactccccacaagcagcttgggtctcacacacacacccctctggggtgaattttccaccgtgtcttggaagggctatgtggtctcagaagagttactccgttttcctgtgcttttattttctgctctataaagatgacggaaacaatccccgctctttgatgggctaccataaagcctattgcactcgtgcctgtaaatgtctttggactttgcagagaaaggggtgaaataaaatacaaggtgtcacttttttaaaggcttcaatccagccaaaggaaagggcatctggagaacagcaggcaggctcttgccagggagtgtgtgaaaccaggccacaggcgttcacctggccccagcaggctcctccactccctcccagaagaggtgcgggcaggcactgtccctccagagaaggtgacctgctcagcatctgaagcctctctgatggctccccttcttcctacagagtagggacagtcagagcgaaaacggggagagcgtgggcaagcctgagcaggccacgtgtagagcagacatccactccaggcctttgatagcctctggcctctcttgcgtggcctggtccaccagcccaggccaaacacagctctctccccttcccttaaaagaaaaaaaaaaagaaaaattattgaccaggcatggtgactcatgcctgtaatcccgccagaggcaggcagatcatctgaggtcaggagttcgagaccaacactgtctctactaaaaaaacaaacaaaaaattataggagtcaaatttacaagggagtgttcaagatttagtctgatctttaccatttttccctaaataaggagatggggaaggagacaggaggcagagggttaaagggaggagtagaagaaaggaaggacaaatccaggcaaaggggagaagatgccctgtgcctgctggatatgaccatggcaacctgccaggccttccaagggcagcctggggtgctaggggtcctcgtggcccttgaatgttcctgcttctggttcacaaggagttcgcatccccaaatttctcaggcctaaactgtgctgcagggacctctggcgtcgcaaactctgtacatcacccattatgatccattttctgagtagatgtggctgaatgattgttcacactgcacagggtggggacactgaggcagggacaaagggagtccttgtttcacagttccccaccacctctgccacaaacataggcctcattagcctgaggaggcttcaggcctctcagctcccaaaattgcatttctgaggggtcaggattactgaatacgattcttccccttggctgggcacgacagaaggacatcaacagccacgtacaaaaagagagtatacatttggctggttacatcattcactaaccagaaagtcagggacctgtgactctcttcctctgcagaacctcttgaagcaagaagcccaggcaagatctgggacaatgacagatttctccctaagtttccccgtggcttggcttctctctctctgaatggggccccaagtgataaaggtgccattgagtcctttgaccaagcaccgtccaggtcttcatgattgctgaggtccccagctgtggcaggaggtggccctgctctttgtttccttgaatctggggtgatgggggagggatttttaagattgaaacagtggaaaaatcacaggacttgggttcaaatggcagctcagctgcttcccaattgcacaacttgctcctactgttctgtaacctgactttccttggctatagagcgggtaagcttattggagcgatggcacctggtgagctgggaagcacttcaatgtaagatatttcatgttgattttttgtgtatagaaatcctgcctggaacaggggtagaatggctgcagggtgtggccctagcatgcctcttgaccacagcatgcactgcaaacacagtatgcattgctgggtctgagctgaaaccaccagctaattacagtacctgaagcagggggagggagggtcccccagggcctgtagacctgggaggtggacatgtagagaacagatgccagggctgcctgggcccgggaaggtgaggctaattggtgaaagccttcaacaggtgagggttgatgtggcttcctgagcacctgggtgatgggggaagagaatgtttgctccagccctggctgagccttcccctgggccccattaacagtgagattagagccacagccagaggagccaggtctggactctgctattatcaggagcccagccatgccctaggcctggggctggcctcctgtcactccacaaatacacaaaatgtttggccatggttatgataacccttgtttattagagagcaactctactctcacaaggaaaggaaataagcacccattaaatgagaatttatatggagcccatttggacaaccctgtggacagacctagaagccctgagagggccacactctctgggtccctatccagaggactctggatcttttttcactggctcaaatgtcctcatagaatgcatggggtacaaattaagatggctgatccactgtgctccaaggactatgagctcaaggacaggggccacgttttatgcatctttgtacccctagcttagtgcctggcttataataggctaatacaatggatggatagatggatggatggataggtggatggatggatggatgggtggatgggtggatgggtggatgggtggatggatggatggatggatggatggatggatggatggatggatggttcgttggacagatagataaataaaagcctgagcttcacagtggctaacagtactgaaccagaaccaaagtgcttaggtttgaatcccaactctgccacttaatcctgtgtgaccttgagaaagtcacttaacctccctgtgccttaatttgttacctgtagaatggggattattacaatagtacatactttgttgtactgtggtgaggattaaataatttaaaacatatagaacaatgtttggcacttagttctatgggagtgttcactcttgttgtttgttgtcattagatgggtcagatgacctctgcggttctcagcatctttgaggaaattcatggtatctatctcagaggtatcatgaaaattaaaggggctaatgttgtgaagatgaaatagcaaaggtagttcttcccaaatatcttccagaatccgatagacatttggtcacaaagctgactgaaggagcaggggaatggtctcagatccaggagactgagcgctattcattagaaatgcaaattcttgagctccaccccagacatattggattaaaaagtcttgggtgggggctcagacatcttcatcttcacacctctccaggtgattccaaccccctcttgctaaggtttgagaagcactggcctggatcaccatggagggcccttcctagctgagggcactacagaacacagcatgtgcctagcatcccgactcgggagcaggaccctgagctggacctggatgcagagagccctcacagcagcctccccaggggcctgccacgcagtgtggtggtggtggaggtggtgtggggagctggagctgacactccgaattacaatctaatagcttatggcgcttccctcgtgcaccgcagcaaaggttaccgtgcaattacgtgtcgccacatacaaatgacagagcagttacggttactttaccaattacagggaaattgctcccactctgcagagagattggcactctgaaaagctctatcatctccatgaaaaggggattttaaatgcagacggtttccttcctccagcagttccccaggctcaggggcagagctgcaaagccactgccactgcccaaggaccccagaagtgcctggtagtctctgtggagactccctgggaagggctggaggaggaggtagacctggggaacagtggggggatctccccaagaactctagacatcacccccaaccctaggcctcaatgacacactcttaaggaaccaactatcacccactctgacagccacatcaatccatcttgaaggcagcaggtgatgaggcggggtgggcccctgatccccaaatcctcccctgaccccagcctgcacagcccctggtgtgagtcctgattgcacctcctctgccaagcaaagctgttttagccccggccctggcttgccccacctttgcagaaacctcacattgagtccttattacagaaaggtcagaaccaagccagagctcaatggcccaaatgcagtgctaatgaggtgaaggtcagcaggtccatccccctgtgggccaattagcttagctctgggacacagtctcttccatagccacaggctgccctcttactgcaggcatccactgtttacaaacatcctaagctgatcctgaagaggcagaccaggtgaccagcagggatgtgccatgcagccaactcctccagccacctatgtacctgccctgctgctctggggcagcagcagccatctgagccccaggatggaagacaaaatcagatctggtcttcccattgctctgtgggcaactcctgtggtccaggagagagaggatttctcccatctgggagaaaaccagctctcctgcccttcctgaatggaaaagtatcatctagcctcatactcctccacagctgggaagtccccactcctgtccgttgcatagggtaagaagacatcagagattttcccaagctcacccatggtggggccaactggatctttagaccaaccttttcccaccaaacctttggttccttgggctattggaactccctgcgttcagcaagggaaataggcactagatgaagacaaggctatttacttttcctcacttactaatttgcttaagagcatttatgaaaaacctactaagccccaagcactaggtgagcccctaagaatagaaagatgaaaaagtctcagttcctgccccaaagaactgcctctttcccagtgtggggatggacagacctgggccatgactagacaaagccatctgggccctgcttcagttatgtgcctgggggagtccagagaatggaccaccaactgccttggggagcaggcatgactttgaggaagaggcgaggtctgggctcacgtccaagttctctggcttatgaaacagtattctgcccctctttcacacatcatatttcagatgcggaaaataactcaggatcataaaatccaacagccccattttacagaaggggccactggggcctggagagtgaggtgcctcccctagttacctatcaagttgctgagaaaataggtaccaaaaccccaaattcctggtgacagaaaaaacaaaacaaaacaaaacaaaaaagcctgattttttttttagatggagtcctgctctgttaccagggtggaatgcagtggcacaatcttggctcactgcaacctccacccgccaggttcaagcaattctcctgcctcagcctcttgagtagctgggattacaggcacctgccactacacccagctaatttttttatttttagtagagacggggtttcactatgttggccaggctggtcttgaactcctgcccttgtgatccgtccaccttggcctcccaaaatgctgagattataggcatgagctaccacacctggctaaaaaactgatcttaagcacgggtttcctctggggttgttagagggtggtcccaaagacaatctattccaggatcagaggaaggcaggggactgctggggaagagactatgtgtccagtccctttcccagcaccagggatgagtgctctgccatctccagaaactggaagcaaccaactctcccctcccaaggaggcccctgaccactcacttaagctgggcttcttcctttcctgggtctgtgcatcccaaaggaaagtgagaaatgacgttttgaaaagaaattcaagttaggagaaaaagggaagggaagcccatgagctgcctattgatacagaaaagaaaaggtctttatattcttcatgttgagcagccctaaatttcttcccattaattacacttatgcacacttgtgcacgcacgcacacacacacacacacacacatacacatatcctggttgctgaccatagcacacctccactggaaatggggaatcagtgaattacacatgtgggatttctttttaaagggagatattgatcagataaactgtaatagctcatgtctaaatgcaggctccagttgtaaagctctgcagtacagggagataatgatcacccacttattgggaaccgtatctcaaatatgacggctgacccctaaggtgttcataaatacacaaaatgcatccaccccttgagatgacatcgtgtttactccacaatacctcctcaggggtagaggtaagtggagagtgtccacagggaggtagaaatatctctgggagtctctagtaggcttaggtttagctcctcagaaagcctattattctataagatatttccatgtgcttgagtgatgattctgtaacaaagaaatcaaaaagacctgactatccaatcctctgattgctttcctgtaatgcctaaactttctcttttatgactcctagccctccccagaaggtctgccttcagacacgtgacattgagacacaggacccacgctggccctatgagattgaagtctcttgaaagcaagccagagaagtcctataataggtgaaagttgacccctgcaccctggttgtgagcacaggccatggaaacaatgctggagtgagggctcatacactcagttactaatgcttcatctcagaatgattctttcgggtgtctttttcaatgagattgtagggaaaacgaatgtgtaacagaaagagggagagccagcaagccacagtcacaacaacccagttagacaaacacatcattgcaggggcttagagaaaagtgtattggggttggaaaaacaacccaacaaattatagtagttcccctgatccttggcttcactttccatggtttcagttaccgcagcttcagatcaaccactgcccaaaaatagaagagtagagcacaataagggatttttgagagacagaggagacaatgttcacataatttttattatagtatactgtcataactgttctattttatgattattattactgttaatcttttactgtgcctaactgataaattaaagtttattataggtatgtatgtatattagtccatttgctgataaagacatactggagacttggaagaaaaagtttgatggacttacatttccacgtggctggggaggcctcacaatcatggcagaaggcaaggaggaggaagacaggtcttacacggatggcagcaggcaaaaagagagagtgtgtgcagggaaacacccccttataatatcctcagatctcataagacttattcactatcacgaaaacagcacaggaaagtcctgcccccatgattcaattacctcccaccaggtccctcccacaacatgtgggacttcaagatgagatctggatggggacatagccaaaccatgagagtatgcatgggaaaaaacacggtatatatggggtttgggactatctgtggtttcaggcatccactgggggacttggaaagcatctcccaaggataagtggggactatcatatggccccagttctcaagaaccaagagctttgcttctgggcatctcaaaaaggaggagagcagaccagaaaacaggatagaaagtcattgtgttttaggaggtggggctggggattttgatgcaaatattcattaaatgaatgcatttaactacctatggaatgatgaaagccatttgctaaaagcaacacttcttttaatactcattttgaagtttctatgtgtgttttgggaccatctgtggcccaagcccaccagatatctaagtggtctttcactcatcatgaaaacaagctatccttctaatagggaactaatgtcactaaattgagcagttttccctggagaagggcattaagccaagcacacattctgcaggccaggctgtaaccaatagcgagctttagcagtgcaccccttctaggggttgctgagcatagcagccaaagacaagcttcagctcagaatcctaggggttgaacccatgaccttctcctcattagcttagctgccaagagcctcgtgttcctccctctgagaagcagacagggccatgccctgggaatagtctggacaggccagagctctaggccagcctaccaagagaattgaaattctgcagatggcattatccctgggggctggtttagcaaccaacaccagacccatgggaaatcccagggaagtttctcagcattgcgaatggtaacaaccaaaacctactggggtgccacctctctccttttgtactttagctccagagaaccccagtggctacctgtcaggggcagataaatcccatgccaccagtccatcaatcccaaatcccactgtccctcctggagtctatggcaggcagactcagcagccacaagggctgtcattgaagtgagaaataccatgatgattaagtttgtgtgttttctggtgggtgctgggaagcagtggccctgctccccaggctgagttatggggtaggtcattccctcattagtggaaataaattttattagccccactctcacggcaatgtatcttcctctcttgctcctcgggtctaggtgtgggtctgggtaatgttgcctgcgtgtgggataaatcagccgaacaaatcccattatattttggaacactgacggagacacagtaatggcacagagaccagggaagggagtgggctgcttctctcccactgaccccgtttcctgcccatagggccacacacactagggaaaacatgtaaattgagaggccagatggagaagagctctctcagttgtctctttctccttctctccactgactttcttgataaaagaaacaagcctggtgtggtgatgtgcagtccttcccttataccttacaaaaactaagggacatgtgaaggtaacagcagcaagcactggcccaaaatgtgtcttgtcacccaaatgcattatcttatcattcataacctgtgctatatagaaaggaaggcaattggagggaggccgaggtgggtggatcacctgtcaggagtttgaaaccagcttggccagcgtgatgaaaccctgtctgtactaaaaatacaaaaattagctggtcgtggtggcgcatgcctgtaatcccagctactcaggaggctgaggcaggagaatcgcttgaacccgggaagcatgggttgcagtgagccaagatcgcgccattgcactccaccctgggcaacaagagtgaaacactgtctcaaaagaagaaggagaaggagaagaagaaggagggggaggggaaggggaaggggaaataataataataaaggcagctggagcacatcctagggcctgagataccaaacaccacacctgcattaagcacagcccaaatctctcaaaagcaggtattggtgaaggaaaaaaaattctaagcatgaaatcactgcaatattattacgcccctttctgtccccttgggtggttattataactaaaggaggagacacaggatgatgctatgaagatgtttgagtgtcctatgaatataaggggctgtgtgtctatcgttattaacatctgtatatttctctttccttaggagcttccggactctttattaaaaggatacttttttatcatctccttcttgaagataaaatgtgtgattcaaagcaaaagggaaactgcttgcccagtgatatctcacaagctgggactggctgagacccaaagatcctgactcctagaccagtaacccggccaagacgccaccctgtgaggacgaaaggaattgaagggaaggcccagaagtccagatctggattgttaagtagggctggtctatgtgcccattgaacaagaggtctggcttcccattttggcagggttatctcacactgcatgaggcgtgtgtgtgtgagagagagaaatctcattgtacttgctgctgagcagagtgtgtgggggtgagggagaacaagtcacagaaatagggagacagagaaaggctaagagaggaccgtgcaccaagagtgtgagtgagtgagcaagaggagagaaacagagaaagcaacagacagcaacgaggaggacagacatcaaggacagaaagaatgggtgtgtgcacatgggtgtgctatgggtgtgtacgccactgtgctcgggctcatgacatgcagtccatgtctcagtattgtgagagcacacatcctcaaacctgactttgtgctaagctctcctggcagcagtctgcgttaaaattcagcctgtgtgactcctgggtcccgcctcactccctgctgacccgatggcctccagggtgggcatcctgggagagtacatccagcctaggaagccagcctcaactttgctcctgccaaacccaacacatcgcccagggctcagctacctgtcacacaaagcaccatgcacactagtctgggatgggacttttactgcaaaccctgctggccaaaaagagggaggtgggcgggcctttcacctaaatacctgagacaggtgccatctccgagagagtgggaagacttgattctataaagattggggctgtgatatgtcaggcacccagtgctaaataagaaatctggagtacagggtcatgggccatgagaggtgggcactcagaccaatgtgttagatttttgatgtgtgcatttattgggacatgagtgtggcatgggccatggtgtgtatggcaagtgtagtggagatgagagaggaaggatggtgcggggaagaggaggagttccaggtctagagaggacaagagctgagcagaaaaagcaagcctcgtctaatgccataaacaacaggatacaaccccatcaagtctgagccctgtgcttcctgctgacagggaaaagaaaacaccccaagaagacctgcagaagccaggccccagagcctgggatgcctgcctggccattccggatgctcactttcgtggagtttcaggatctcaggcgccagaccaacctgagtaaccacccagactggaatgtgaggccagcccaagtccaagggggtgaccctgtctcctgctcaggactgccatgcctaggaaaccagtgagtcaaaggaacggcacgtggaaggggacctccatcgccacccagtcatgcacacagcagggcaggaaggggagctttgggttaaaaagaaacagctccatctcctgtgcctgtgtggcccttgtgggactacacagggctggtgggtaaactccagagtcaggtgggagctgggtctagcaatggttctcaacgagaggcttctggaaatgtgagaggttttctagtcttgtagtggctgggaacttccactggtgctcagcactgtagggccccggatcacaaacgccctacaatatcaggcagtccctgcaccaagaactgcccaccccagacactgctagcacactcttgtgaaacaccacgggaagagcaccaagctgagaattaggatacagaacagccttcagtttactaattacatgaccttgagtgaaacacttgagttttgtgttcctccattccctcaactgcagaggatgcctgcccttccattatcctacagtattgttgggagaagaaaagttgtgagaaagcccttgttaaccatcaggtaccatgcaaactccagtgtgttatttccagacagccgggaggtctctgccctctgctcccactactggggtttgacaggtgtcagttggtgatgctggataatagtttctgctccaaggacccaaattttctagttgagggacactcaggtcaaggcttgacagggagattgagaagctgatttctgcaccttctgcatgccacctttctccacaccgcctaatcagtactatggccgagactatctgactcccatacccatggctcaatcagttccaaagtcagggaagactgaagtggagtgaatgacagtcactcccatgaccacagccattgttcccatcacccaggccataatgacctgctggtgtgcatctctctcctccactgtgtgggctcctggagacagatgccattccacaatgcttggtatccaccaggagggagtgcattgccaagcccttccctagggctccatatatgtttcaccattcattagtttattaagaggtgctagttcgttagtgttggatgaggttgccccaggaaggtgaagaaaggagagaaggtatagataaccctatgcctggggaattctgggatgccaggtgcttggtcaaacccagcatcttctccagccagctgcccactccaagtcaggagtgtcaggtcccccccagagaaggacagacagccatcaccttctcctgcataaggtcctggcacatgacagaggccacaggtgtgggctccccagccttactgtctgtcacatgctctgcagacagggggcctcagggagcctggatggcagccttcaaaaggggctggggatagagatgcaccagtgataagccacagaaactgagaaatgaaatcactgccattccccacatgagtgctcattagcaaatcagtctcagcttgacctctagtcccctgagtcccaagacaattggggctctgacagaccctctaggaccccccctcatacccatgtcctcatgagatcctcagagttactttcagatactaacccacttgttctgggagacctctttccacccaggctggagaaagccaggacaggggtaaagcatggctcagagggtgaaggcggaagctgctgttcccaccctccactgacaccagaaagccccagctgcttccctagcctccacacttggtgcccactcaggaatgtacatttgtgacaggttcgtttatgtccacagcaacacattcccatgaggaggccactcctggccaaccagccctcatctccaatgggagcacagccggccttccctgattcacctgaagttgaggtacagctgagctctctgggggctgcaggtcagcaggttctaccccaacggcccaagacttttccctctgtgcggtcctcaggctctggcctgcccagtgctctgtggatgctccctggcacaaggggccttgtagtaggggttcttcttcccattccttcctatcccccaaatgaacacagccaaagcaggtgctgggaccttgtgaaggaggcaggtggcccaggagttttgcggatcccggctctgagttctggaggtgtgagttcagggggaagaatgtgggtctcaggatgtggaaagggctagaaaagcctgaagagccccatgggaggagcattctaatttagagagctggtacagcctggagcacagttgacattcattgctactcaaatcccttcttcaagcttttagagttgtaactatgataaaacccacaggggaccccttaccctacaaaatacaagtcctaaaagccaacctcctgggccttgccctgccctctgtcatcttcctacaacagaaacaccacaggacagaggtcatctgggactgagttctcaattcacagggctcaagggagtgtcagactccgtgacaagagagatctccagagttcatcttgttcatcctccacctctaggcaggaagggaacaagaaaaccaacccaacagccttgtaaatgagttgaggaagagctgggtttgcaaatggtgccatcggggcaacacagagcctggcctggccgatgtcgcacgaaacacgtgtggtctgagccgactccaaaggaatcgtaacaggagggtgggagcaaaggaactcgggtatctgccaaatcaaaggaaactgatactgtgcattaaacaccagcctggcctttttcagactggctggagagacagccccaggcctgtgcagagtttctggcctcctcctttctactctcggccctgaacttgcctgtaacttgaaagggctaattaaagccaaaagaaaaatcaaaagcttgttatcttgctccattactccccgtcccggcattagcctgtcttgcaaagctgttttccctctattctctccaaggctaccacacggtgttaggacctgcagctctgcagacttccatgatgaacttggctttttgtattgtggcaggaagcaacggcagcacgaacacttgcccatgggcagccagacggacgcctgcagctgatttttctcccaagagcatcgcccaaaaagtcagggttttaagaaagttttctacaggaaactgtcagagattgccaactcctctggtctcaaaagaacttgttgttgtttagtaagtgcacagtataaacttgccgtcttctaacataggcctgcatatgtgtgcatgctcgtggggaatttattacatgtatgcatgtatgggtgtcctgcaggcaagggggattctcttcaattggtggctctgttactcactcctaagatgtgtgaccttgggcaattcattcagcttgctgagtcttgagatactcaatgcaaaatgaatttttaggccaaggctctctaaaggccttctcaacaccaacattctaatacatctcaccacagacccatgtttgagtgtctaatagacatgtccagaacagcctctgtcattagctgccttcgtttggaagcagtccatacccccgtaagttcacagacctgtctcatggactctcttaagtggctccactactgccccaaacaaagggctccaggggcattcccaaaggttgtcacctgctaggaagactcagtagataaagtggagtcccctccattctccagtctggctctgatttgtcaactttttgctgccctgcttggtccatagcacctctcctatttcctttgtgacatcagggaactcctggattttcaagacctccaagaagagacgacatctcttagtttcagctggcccagtgcctggaagacttgacagtggaaaacagcttaagcctaatgccagggcaccatctttctcctccctcttccctatctccaacccaaatcccaaagaccagagtgatggcctctccacactctggctggggagggtgccagtccccactgagatctgcctggcacatagttatactttatgaaaggaaatttacacttttttaaacaaccaaaatacatttcctaatatggaactccaccaaagtttaaggagtcaagaatcacatcagtatggatgcgtacttctgtccaatggatacattttcctttcttcttctccccaaattaaaattagagaattgatgttctcagactaggttcataatctttaaaatgcacagttataaaaggaaaaggacaagaacactgaagatgctgatagctgagccttccaagtcacccaaagaatgatagtgaaaaagcaggaccattgtgaagaggaacagagtcaagccacaagaagggggatgcttttcatggtggggcacacgtgagctaggctgtgacaggcaggagtctgtgtcccctgcttcacctggggtaacccagcaaggccatacccaccagccatgcgaagacccctaagccaacccttctcctgctctccctctggctccccacagctctcccatcatcccatgctgctctccggctgcttcctgactttctcacatgtctcttccaaggcactgtgcacacagaagatgctcaataaacacaatttgtcccttcccatcccttttctaagttagctttgctttctctatgtgttcactgcactcttacctgactgtgctctcattttagcatttcctaaagacatacaaagggctaaaaacacacctctcctgaaattccatatctatcccaaatgtaggatgactcctcacattctcctctccttctaccatatggtttttattctaagctcccaggaaagttatttgcaggcttggtgagtacaaagggcatgtacgtgtcttgcactacagcacactgtgatctagactccagccatgcccggtccctacgacatccatttgacacaattcctacctatttccagcactccccgtcataactagtgagccaatatgaggcagagaaaagtacactgatgggaatttatgtttcagctcccactctgactcttatacattcaatgtcatagttgcagaatatttggtgacactctgggtccaatgagactcagagatgggatgggatatactcacttcatctgcaaaaggggaaggatgatacacatcccatgggggctacaggctggggttctcatcctacactcccaaccatcccagcgcgcagccctccctgtactcaccgcactgctgcaggggatgtccttcaccttgagccaggccaggtccagcgtgccctcgccccggtaacaagactgcagccgctccttaatgcggtcatttatctgcttcaagatgaagatgcacagggccgactcatccagggatttcattttccgcttctggcccttggagaagacggtgaagagcaggtcatcatctggatggactccaagggtcctgccaagcacggcccccgctttggacaggtaggcagcctgcagcaggcggtactccaccccactgcgctcacagccaatgggcacctctacataggagttgaaggctgtgtcctccttgcaaagcctcacgagcttggatgtatacacctgctccttggtggtggagcctggtggagacaccatctcaggttggagggtcaaaaagtagacaaagttgccactgctaaaaccatagacatagtagatatcaaagtcagggatgatggtgaaggtgtccgaagggatcttaatcatcgaggccacgaactcatcatggaagacgtacgcgaacatgccatccgcctcagagttcttggtcagtttccggctggagatggtgggaaaatactcgggcttcccatccactgccgtggcaatgaacagcttgtcatccaggttgctgtaggagacgatcactccaaagactgagccgctctcgttgacacctgacagatagtgctccttcttatgataaggctcccccagcttgaagaggtcctccagcctcagcagcttgcagatgccttggtacaggctcccacaggcaatcagcctgttctccttgtagtctatgaggagcatcttgttgacattgttggtggtggtcaggggctcattgcaggtctggacgatgcggggtgggtaacacttggggttgtcctcgtccggccctgtctcatgcgtcaccaagaccttcaggtcgctggagagcttgtaaatccgattgacggcccccaagtaaatgtgtcctgtcctctcatccaccaccaggtgattgaaaccctcggcgggctctcctcggaatgtgacaaatgaccgctgcttctgggacagcggggctggctgccgggtgagcaaagtggaggagcccatgcccaccatgaggaggtgggagagaaggcaggtccagttccagggcatggctttcatggcagaggcgggtcccagtggcacagcagcactcaggcacagtcgtcccctcagagggccaggactcagcaatgcagtctcccctactggagaaagggaagacaatgagctggataacaatgccagtggcttcatttcaccccacagcttgtctgcctggactttcaaaatgttctgcacacactgagcagaactgcactggggggtgctggaggctgactgagtcaacccccaccacgggcatgtgacacagtcagagccgggtggcagcagccccaggaggacacatcagtaacgataatggtggtgatgataatgacatgataatagcagtgatgatgatgatgatcatgattaacagccattatctactgagtgcctgaatttgtgtcagacactgtccagcactgtcacccgggtcaggtgccaccagcaggcagcatccgcaaagactggctggaggagaagagggagggagggagggagggagggaggaagggcaggaggcggggctgcctgcactggctgcaagctttgtccggtgttccccacagcaggcctctgcacacagtttctccgtctccaggctctgtgaaccacctcctgctggaccccatctggccgtagaggtggtaacagagacctcactattactatccacccatactacattgccccttaaagagccacacttttatgaatagcccctttattaaccttttctcaaaggaccaaatttgtatgtgctgtctattacctgctgggaccctgattggtagacctccgaagtacatcctattgtagccacattttatagctaaggaaagcaagcttagggaagtcatgtaacttgcatagctataagtggtagaggtagctccaaatatgagtagtgtaaatgtgcacaggttcgcaatcttaactgctaaaccatctcagttcaccccaaccttgcacagttggggctgtaccgtggtccctgtcccatgcagcagaagaattaaggttgatcccttctcggggctgtccattacagccactacctccagttctctgtgtctgtacctactactgcaggagaaactttcctctgtgcctcctctgctggatgaagaggccaaattaaaaacccacatcctcaatctcgtcacactgcagctgcaaccaggtcctctgggttcactgcccaaccctgagccctaatgttattttaacaaggcagatcttggcttcctcccctagcagggcctcctctgagaggttttcattaaagggagagaaaaaatgctttaagaagcagtcaagcaaataaataaacaaataaatacaaaactccccgaggaacaagatcactccccatcctgagggtctctttctattcaaggtgcttcctgcatgtgttcccattggacagctttatgtttcttccagttcgagagaattcagggcaggaattgccaacatcctatctgggggcatctcagctctgtggaatttttctcattcacccccaaacacctcaaaagtagagaatgagaagaggtagatcactaagcaatggaaaattccccagcagggagcaaacgctaggtcagatggaaaccaagagaagaaggaagaaaaccaaataaagactttgcattgtcagccagcatcctaatgaaaagcacaggccttctccagtcaatatcagaggaggaagactggttagtggaacacaccacaaccaagagcagtgctgaaagccaagggccttcattcattcacccatgtggcaaatgtttgctcagaacacacacaaaatgtgcaagacactgtggggcccaaggagcagatcctcaacgaatgcgtagtcaaatcaggccgataccaccagaacctgaactgatacgcacgacaaaaagtcacatggcatacaagagagtgctttgaaagttcctaggaggaggaagacttctaacttagggtgagagagggcaaggagcaggctgcaggaggccttggggagggcatggaatttgggctgagctgtgaacttcaagaagacagtcagagcacgaagggaaagaccttctaggggaggggtctacatagcagaagcatgggcatatcacatgagggtgtgtacaaggaagagtacgtctggagaacatagttcatgaatgaatcaggtggaagatgaggctgaaaagagagagcttcagccttgccaggatgtcactgggaagttgagactgaaatgcacagtgttgaagacagaaatgaaattgtagaggaaaagagcaaaggcccccagagaggagcctctccctttccatttagccttagcctttgcagaaggagagtttggagctgagggtctgtgaactccacagggcagggctgggtctgtcttgctcgtcaacacattcacagctgcacatatagaggaggctcaacaactgtttcttgactggcagaaagaggggctggaagcatagacgaataccaatatctgtggagtatttactgcaccccagagcccatgcaaatactttcacatagcttggctcacataatcctcaccactgttccctgggatcagaattgtcttattcctatttcaggtgaggaaactttagctctgcaaggacactggttaagatgtagcagaactgggtttgaagtccaggtttcaatcaatgcaaaatccatacttttctagaaatgcacatttccagagcccagaagatagagcacttagaagcccttgttaactcatgtaagccccaaacagaaatcctgggatatcacctaccagtatcatgagaaaaacaaagtcctctctgaccttcaggggctaagctggtagataacaccgatcaggtgagttctgtggtttacctctgaaagtattaatgactgtaaagcagcagctgcacagagcctctgcctagcacagttaagtgcttaggaaatgatagttgctgtcgttgttatcgttagcaagattaaaataggattagaaagattaggattatgataatgagatggttcctggtggtacatctcaagatgagtgatgaagagtcaagatggttcaccttgaattgcttgtgcaaattcaaatatcaaagaagaatctataagtttttgatctaaaagagataatccagcttagtgattcccaatccctgattttagagacaaggaagttgaaatccaagaggtcagatgaaattgcaagaggtcacacattgagttgaagacagtgtaagactgggtctcacactgtccatcccatgctctttccaccaccccggcctctcttctgactttatgtgaattcactccagcagctgcttccagcctttgtctgaaagagactgctctttgggcaccatatgctctgccggctaacagggccctcaaaacgtctctgccaacaaccaaattccagcagggctgataatcccccttccagacaggcaggtgcaggtcggggctccgccaccaacttttctgaggagagaacttcgcacagtctctgtatcacaacctgccgtatgctggggaatgtgtgcctaccccacgacctgccttactgtacatacacatggatccatggccaatcagcagctctctagtctgcaagaggtgagatgaagaatcctataattacgaatttactgagcagaaaggtgccatggctcattctgcatcttctattaggcactgaaaggagacacagttatgcatctcaaacacttatcaccctcatctggggatggtgagattactacacccagagaggaggggggcccacagaaacaataacatgtactgggaataaccagcctttcattttacacactaagaaagggactgattaggaaacaaataagagagaaatggaagagaaaaggggaaaataaggatgtgagctccagcttgcctcaccaaagaccccaccaggaaccaccacagaggtgacaccccgccgagcttgggacccacagatatgcagagccaccagccccctgtctccctgagctgtctaaggctgctccaatctggcaaagcaagagtttccaggggggtttcccttccaggatgtcaattcttgtaagcggtaaccccaacctaggaaacccccaccccaatatcagagcctacccaccatttcgctctcaagtcaccatttagctagtttcaaaaccaagtattagaaattacattcagcccaactctgattcttaaaggcaagtaatgggaccaaataaccttcacgattgccccaaaggattcatcgaactacgtagagtgggtaagaaggcaggagaactgaaagaccccgtaacccaactcaaacatgctacagttttcccttctttgaaatcagattttaattttgagtagtctcaggggagatgggactcatttatagaagctgatcatcattttgattaaagaaattggggttgtctttgttttaggcagcaagtttcaaagaactgaaactaattttcatgaaatagcaccatcctctcagattcctgagtggtagagaggaaagttattatagagtcgtttaaaatagcaattaccctgtgaaattactttagagtttacaaagtgttttcatggatattaccttgttctgaatttcttgttcatgacaaccctgttaggtagatgaggtatttataagtatgccttctttaaagataaggaaaccaaggcatgaacaggtacagctcttggctaaggtcacacatagtcacgttgggcattggagagctgagctcttcaggcctcactcagttattcacaatatattccctggccccttggacagagtcctggtcctcagaccttttattatggggtaataggattctcagaaaatgtgccctaagatggcatttcaaaattcacgtcacaacacaccatgaattaggtgagtcacaggtgttttttgttttagtttttgttttgttttgttttgttttgtttttgagatggagtcaccatctgtcacccaggctagagtgcagtggcacaatctaggctcactgcaacttccacctcccaggggttcaagtgattctcctgcctcagcctcccaagtagctaggattacaggtgcccaccaccatgcctggctaatttttgtacttttagtagagatggggtttcaccatgttgggtcaggctagtcttgaagtcctgacttcaagtgatctgcctgcctcagcctcccaaagtgctgggattatgggcatgagccactgtacctggccaggtactcttcttaatgaaataaaatagaagggaaaatactagtatgtcacatagaaaagataagcactgtttggtgagactttttttttttttgagacagagtctcactctgttgcccaggctagagtgcagtggtgtgatctcagctcactgcaagctctgcctcctgggttcatgccattctcctacctcagcctccccagtagctaggactacaggcgcccgccaccatgcttggctaattttttgtatttttagtagagacggggtttcaccatgttagccaggatggtctcgatctcctgacctcatgatccgcccgcctcggcctcccaaagtgctgggattacaggcatgagccactgtgcctggccggtgagacttttgttttacccactatatagcaaactacatattgaatgtgatgtaaatatgtgtgatgtaactgggtccctgggatggttaattttatttgtcaacttggctgggccacggtgcccagatagttggtcaaacattattctggaagtttctgggagggtgtcttgggataagattaacatttaaatcagtctgctttgagtaaagcagactgccctctataatgtgggtgggcctcatgtaatcagttgaaggtcatgaatagaacaaaagactggcctcctctgagcaagagggaactccaccagcagatggcctttggacttgggtacaatattggctcttctctaagtctcccatctacaagcctaccctacaggttttgaacttggtgcctccaaaattgtgtgagccaattccttaaatcaatctctgtgtctctatgcacacacacacacacacacacacacatcctcttggttctgttttctttgaagaagcccaactaatatagtcatggtcaaaaaaatttgaaacacactttcagagacggtgcatacctgttgtttttgctgtcattcatttatcctctgggcatctgtgcctttgcccaaacacttctgctggaattgactccacctctggttcaaagcctgagccactcagcacagaacgggggtcgggagggcatagtgattggatcaggaatgagaaactggttaaatcaggtctccgacaagcaacaggctttggatagggatactaggggagaaagttctagctcttccaccagatgtaaccttggagaggcaagggcctaagaaccgctagtgccatcttgtaatcacaggggtgagagcaggggacaggagcctggaagaatgaagccaaagtactgagaagagcagaactaagccaaaggatagagagtactgggtcccaggcctggcgacatcctataaatgtctcaattgtgtccactgaagccagctctatgcctgtactttccggttacgcaagtcaaaaaaaatttttccccttttgcagaagccagtttgggttcggttttctggcacttgctgatgtaaggatcctaacctatacacagaaaaatcccaaagagtacagtgtctcccaccacaacctctctaatacactatttttccatgggatcaagtgagcaagccaaacagatctgtgccttccactgcccacagagataaactatggttttacagatagcgaggcacaatcccaggtgatgttcgaacgtgtgtgcacgtgtatgtaccaactttcagaatcaaacacaacacttccctatctgctgagcatttgccttaggagctgcaccagcagagctcttgggaagtcttcaccaattcatgcttccgggccctgagttagactcattgttcaaatgaaaccttctctgatcaagccactggtctaagatgcccctactatatattagtgcaggaaccagtgccaccagagtctcacattttacaaactctgttatatttgtccattgatgctgtctcctagcataaaaatatgagctccttgaggacaaggattatatattgcccctcttttctccagttccaagctcagagcctgaaacacagtaggtgtataatagatgtttggaaacacgtgaatgaatgaatgaatgaatgctccatagcagagtatatgagatggcagtgggtatcatgtacagctgaagtacaaagtaaatcttggtgcttcaagtaaatctttgagccagtcaattcaaacagggaccaacctaaaaaactggttgtaccctgttctaaaccagggtttataaatacttaaaatactccattttgtccttttatttatttatttatttatttatttatttatttatttatttgtatttaaaggtaaagctcttttttaatttttattaggacatgagttcaaatgcatcagagaaactacgtctttcgtatatgatttacatggagaccaaccggtccaccagctggaatatcataaaaagctgtcttgtgttagcaaattggactttgagaaccaccatcctatgcagcaaaggaaatcagtatggacctggttgaacagaagaagctgagcctgaaaataaaattgcagcatggaaaacagacaacaacagaaaacagccacaatgcaggagatgccagttgctagaagtcagcatgcactcctgtattcagccaacgactattgatggagcacataccacatgatgagttctgggctgggtgcaaaggatagatacattccagagcaaaaaacagtgtccctgccaggagtggtgactcatgcctgtaatcctagcactttggaaggccgaggcaggtggatcacttgaggtcaggagtttgagaccagcctagccaatatagtgaaaccctgtctctactaaaaaacaattagctgggcatggtggcacatgcctgtagtcccagctactcgggaggctgaggcaggagaatcacttgagctcaggaggcagaggttgcagcggtgagccgagattgtgccactgcactccaacctgggtgacagagcaagactctacctcaaacaaacaaacaaacaaaaccagtgtccctgctctccaggggctgagggtcttctagaggcccctctagctgtcccactggcaagctctgcagatcctccccttcccagcctctattagaaacccagaacttcctacaacactgtacaacaggtcatttaatctcaattgtgcaggtggattgggaagaggaagctaacttttcacaaataacatgcgcttccctatgcgtgaggctgctggtatgaagtcagtgagaggtggccatcagcgatggatgacatttcccagcctctccatttccacatggtatccaggtgtgactgtgtgaatagcaaggtcatggtgacatttccatgccaaagcagggaagaaataagtgtgttttctctacggtttctttcaccacccagctggataaagaggaccctgaggccctataggatggtggagcctcaagatgaaagattcgtgcacccaccaggaacatcagacaagaaagaaacctttactgtgataatactgaaactgtggatttgtgtgtgacaacagttaacctcaccctaactcacaggcagaaacacagcaagctcactgcatctcagagctgggattcaaacgtaatgctggggggctccaggcctctgttctttgtggtgcatcaggctctggccctaggaagagttctctttagatgtcagcagccccctcccttgtttccaaagccagattgcaagtgggtaagcccagagatagaggagatggccaagctaacatatacaggatagagaaatcttcctgctcaatggccatttccaagtttggggctcagggaggtaagtgtgtgtgcagctgagggcagtgagggagttggggagcagcaacaggcctcatttccatttcatctaagaaacttcaaacacttattgatccatgcaaacaaaatggacacatgctatttgtagatttctactccaatttgtaatccgtgcattcaacatagcgtcttcagtaaggtcagtattttttcatgtctgtattttttttactttaaactcttggtttctagaagtgggagccatgaattattttacaactttccctggagaattctatttacacccatctagggcccaatcatgcagctcgctacagtctggggcccatgacagacaactgaccccatgtacttggccacctcactgcagctccattcgtcccggccttcactgtccccttgccccttgttgctagctatctcagaaatgagtgtcacattcatcaaaggaaagagccagagggtagggttgacacagcaaaacccatcactaccactagggggaaaagtcaagtcaaagcaactgtcttcccaagagaaggtcactgctggctttgggcagtctcagtgtgggtggggcctggtggggtcagctcagccacaacacagccttagtccagaaagcagcagtccagcaggggccatgggagccctccttccggtgtgcttccctctgcctctgcttctcttctgagagatgggaactgtgaaattgatgactggtgggagggctggagaaaagtataaaagatggggaagagggagcgatggagggccaggcactgatgtagagtcttggcgccaccaggcaaccagcccggtcccagggaaatccagcaccaagctcagctacgcggggctcccttcatccttacttcctagtttattaaaaggggatgaggagaagtgattaccatggacagagcctttggacccagcctggaagaagcctctgcaggaggctgagcctgtgagcctctccattcagagatcatgtcccagccggacctctgagatgtttatacatggtttccacgccctccttcctttccctcccccaggcctccttgtccttggcctggagggtgttccctcagggtacaaaaccacgtctccctggccaagtctgccgttcccagtagagtcgagcaggagctccagccgaggcccaggcagccccatgtgaaactctccattaccacgtggagatcgccttgagattccaggcactgtgccttgggacagtcactaggcaatggctttctttactccaagtgtggcagcaaggctttaaaaacacagcactctcaataggatcctggcttggggaggatagaatcctaaacttctttccagcatctcacttaaagaaacaggccagccaggaatttggagtcagatgccccagctggagttggtgtcaagacctgctctgcaaaatggcacaggctggcacctatgtggccactgtctcctacccagtccatgaggaacactctatccagggtctgtccaggggtactggctcctggtcttcaaaggggacccaatggcctctgagtgcacagaaatggggggacaccatgggaagttgctaagctgtagcaaagggagacttgctgtcacgtctgctgccccaagacctgagtggaccttgggaaccacagaaaaggggcttgggggtcaccacaggctggggatagtcacctctccagtaatccctgtctcgtgcatgtggcctgaggcttgtccagctgacattttcaccaggagaggaggctcactgcatccctgcctgccactctaacctacactccctgtagcctctctagctgctctggcctggccccagtaggcaaagccacattcagtggtcttcacccaaatgagctccttgctctcctttcatggtaaagggaagaagtgggatgtttttggctcacagccagtcatgcatcagccagtgtcacccataaaagcctcctctcagaattgccatggccaaggatactattggcatcaggtcattctaaccagacacgtcctgctaagtgacagcctttctttcttgttgcctcagtttccccatctgtaaaatggcgtttctggaaataggatggggaagagagatcacccagtttcttcttgtgctaaatccagaagtgagagtgaaatgttgtaggcttcacagaacacaggctatcattgaggttgggaagtttccacaaacagcctttgtggaggtgcagggcagagccacgtgatgtgatgattacaacacccaggggtggtgttcactgggtgacaaaaagctggtgctgaagtttctctccaaagactctttgcatctttgcttaagttgcctttttagctgcctgaatctagattgtggagagcctcaggaatgcctgccagggttgaattccacagtctgccctcagagaactcaggatactcatctgttaagtggatgtaagtcacactctttggagtctattttctcccttagataaaaaggaccaagcacattcttaacagctcaggtgttggtccatttcactgagcctgacaagcaagttgatctttctgggaaaggcctttgcttcttccggcctctgaggacctgggtccgcagcaggaggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttctggccccacagagtcttcactcgaggaagcccataatcccaccaaacattggcactgtgggggagcaggctatttggggctcactcagccaaatggcagggcttctgttgtcaccaacatctagtgggagtgcctcactccaggccccttttgtccctctaccccctctcttctttctcaattccccgaaaaatcaggaagtgaacagttgtctcccttgctggtctatattcatgtaattagtgctatttaattccacgatgagccaaagctcataaaatacaaaacatatttcagctgtgtgctgaaaatcttggcagaaatctccactgcagccggaagctgaacggagatatatttgctccttgaaaaaaaaaaaaaaaaaaaaaaaattcagaatgacggcaacaaagttttggggccaggcactactacctgagaatatgtaagggggtagcagaatagaggattttaggacataaagtttggaaataatctctatcaccatgacaacactaaatttaagaaatatttagtatagatcaagtaacaagtgtaatatatagtgtacatgccagaagaacatgtcatacatcataaggaggttgttttggtcccactcattccttactcccaagaattaacacgtgctttaaggatttgggtcccagtctccgagtcatcctgcctttcccattgggcacacacctgcaagtcaaatggccaagaagatgtgcagtttctggcaatgattccaaattaactaacacatcctcatctcccagctctttttcccctgacccctggactgtgatgaaacctcaccctatctctgtgtttgtgccagcaacacctgggcaaggaacaggaagtctcatccccttcctccccaacttcacaaaaccgggcacagaagggtgaagcaccggggactccatcctctcaggtgcccatgactgtaaagtagatgtgtcctcaacaagccgacctctacctctgaaatcaacaccaggtcctaacttgccagggctgctgacataacagattccctcccctggcacccctatgacttggtcatgccctcttcctttttcaggtgacaggaatacagaaaggagcatgttggtagagggcccagggcagggcctggcagaggggagattcatgttggatgctactgacatccccctttcaggacctgctcagaagctgtgtccatggggaaagagaggccatgaggtggactggggtgtgataaagggtcagatccactgcaagacccaggaggcctttcagtagactcagcagctcttctgaatccactctgtggatcagttccacggacacagacacagcatgctccatgcagaggggacaacacctgccagctcccactgccctcctactcttatgccacccaaaactccatcataaacacaaccatcaccacctctcattggtggaatgctttgccttctctaagctccttcataggcaataagccactcatggctccaaacatatatgaccaccccaacccaacccattaggattattgctgaggcatgactttggatgtcagagaatctcattaactttcccaaagtcatgcctttcctctctctatgcctcagatcttcagttgatccaatactttcctaataaactccaaagctggctgggtgtgttgactcacgcctgtaatcccagcactttaggatgccaaggcaggcagactgctgcttgagcccaggagttcgagattagcctgggcaatttggtgaagccccatttctacaaaaaatacaaaaattagccaggcatggtggcacatacctgcatttccagctactcaggaggctaaggcaggaagatcacttgtgcctaggaggcagaggttgcagcaagctgagattgtgccactgcactccagcctgggtggcagaggaagactctggctcaaaataaataaataaacaaaccccaaagccactcaccagagtcatcactggggattgtatagcaaaagtgggaagggaaatttgtctagaaggcccatgataaatgcacagatgttaactgggaagagagaaaagccttctgacttgttctggcctgtcaccttgataggccttgaaaacttgtgcacaatggagctcaaggaggtggcaccattgggcaagctctcgggggccaagggcttgtcagaagaaactaaccagcaggcagggaagatggcccatgtcttcatgcattcgttcaccaacacttattcagctccctagactctacaccgggaacctacattctgggggtgcagcaatgagtaagacaacaaggtttttggtctcacagagtttacatttaatagggaggatacacaataaacaagaaaaataactattttcagatagtgttaagacctaaaagaaaaaagaagcaaagtcatttgctacaagataactgttgcaagcgtgacctcagagagaccaaccctggcttctctagttggaatagccatggtttgtatctctgaggtgacacttgcagggggactgaatggccagggggagccagccatgcaaagatttgggagaggagctttctaggccaaaggaaatgtaaatgcaaagacactgaagcagacttggcaaggaaaaggcagaaggccgacgggctggaaggcccagaagagcacggaaggatgggtgatggggtgggagagaagagagacagcagatgccggagggtatattccaaatggcaggaaaagccatgaaaaacttctaagcaagggaatgacatggtcagggtctatggctagcaagctcagtctggctgctgtgtagagaatggtttttgggtggaagaggagttcactgaggagtgacagcagcctgactcaggtgacagtgtcagaaagcgagactggttgctccagcaggggttgctggtgatgtggaaacaaggggggcggaagagagggacttagtcacacctccttgatttttggattgaggatctgggtgggtgctggtaccatttaactgatatggggaaatcagggcagtggagcagagaaggcaagagttctttttaggatgtcaaaggtgaggttgtctagagggcccacctggcccaggttgatgctcaagagaacaatcaagggaggtgactcacagagaaccacactgtgtgttctgcggaaggcatctcatgtaaatgctcctaggaggatgctaatgtcatccttattctctggaagacaagctgattctcaataactacaacgaagtgaggctaagatatcaacctaaccctgcaaaaagccccatagagatgggggccttgtaactgtgacggcccctgggtagatgcagagattgtaccaagggtccttggctggaagaacgggatgtcaatgaaagaattttacttaggaacctagaatttgatgcttatttttttgtgaaggaagaactaccacagcaaaacttgattttaccaaagggaaattactgatgcttatgcagtacaggctactttataaacttcacaaattcccaaccaaagttaataacattaaaggattgaaaatggaaaaggggaaacagcattgatcatatacttcttagcaaggagccctctcttctctcaagtcataaagagtgccctgggttccccattatataaaacagtgaagggctaaaggccagcctgaaggaaattaggctgaaatcaaaataactcacactaagagcaagacttttttttgttgttgttgagatggagtctcactctgtcacccaggctggagtgcagtggcatgatctcggctcactacaacctctgcctcccgggttcatgccattctcctgcctcagcctcctgagtagctcggtgcccatcaccacgcccagctaattttttatatttttagtagagacggggtttcactgtgttagccaggatggtatcgatctcctgacctcgtgatccacccgcctcggcctcccaaagtcctgggattacaggcatgagccattgtgcctggcaagacttttttcaaaaaaaacatattaacatgtttaaaactcgtgataaaatatacattacataaaagttacaatcttcacaacttttaagcgtacagttcagtgacattaagtatacccatgtcatggtgcaaccatcactgccatccagagccatttcatctgcccaaactgaaaccctgtacccatcaaataccaactctccatcccctcaccccctgcccctgacaacctccattctacattctatgtctatgaatttaactatcctaggtatctcatatgagtgggatcatttagtatttttcctttgtgtctagctgctttcacctagcttaatgtcctcaaggttcattcatgtggtaacatgtagacaacatggtgtctttttgttttgtttttgagagactcggtctcgctgtcaccgaggctggcatgcagtggcataatcacggctcactgcagcctctaacacttggactcaaacaatcctcccacctcagccttctgggtagctgggacagcatgcacaggctgctacaccaggctaatttttaaaatttttgtagagttgattctcagtatattgcccaggctggtctcaaattcctggactccaacaatcctcccacctcagtctcacaaaatgctgggattacaggcatgaaagatggtttttaataaagatccattttgtggggggcaccagaaacttctgggttttaagtaactctggtttacagttgccagttcatggacacaggtgagaaagggaagacctagagaaaacttgtgaacaaatgcctgtcaagcctttttgggtgaaaacatgtccctttcaccaacctgcatctccagacccacaggattataataatatagcactgagaagaacaccagtccctcccaaggctctgccctgaaagggtcccctattaagcaagtatgagcaacactgcatcaccctcctggggagccatgatgcatgtcagctcactaaaagtcctcagaggtggtgctttgataagcaaacccatggaaggtttgtgaaacagggtttctcaaacttgtttgaccaaggaagtttttcttgcttaaaccctattatgacctctgggaacactgttccatggtacacaccttgggaaatgctggcatgttggtttccattcctcaaggcactttcacatctattttctcactgagtctttataaaaaccctgtcaagtaaattgagaaacttagagcaatttgcttcacttattgaaaagaaaacccaagctctcaagatttagtactggaaggaaaatctctaggtgaggagaagcaacgggtgcgagtggtatagactgcactccttgatattcccttcccaccaaaggctcatgcatggaacacattgcatcctccatcaccatggccccatggagacatagcagccctcccgttaatctcctggcagatgcctgcacgcctgtgacaactgccttctcctgatcctcttagcacagatgagagaggtcacaattttctcagattataagaaatctgacaggaaaacaaatgtagagaaaggaggaaggataaaatgagtctatcggaacaaagtgtaggtttcagtttcatcccctcctagctcattcccagactcaaaggccccgccaacccacacacccaaattgctgatttgacttctaaggtgccctgcctgaatggttcacttccttgctgcctgtagtgcatgtactcctggcgcccctgttggggctgctgttttatttggggataatgactcttctgtcctgccctatggggtaaggctatgcttgtgagggttggacatggcttctcaagaaggaggtgaacatttatggtggcagtcatccaggtggctctcaaataggtcactaggactgatggcacaccttcacaggtaggacagggccctcccatccctctttggtgcatagtcttcatgcctaaactttaaggggtcttgagggtctggctagtggtcaaagacagaccctgccccacggtggcacaatgggtgttaaacagggccactctacaagagacactgatgaagcaaaataaaccataacttggaaaccccattgacttgttatagtaactgtctctatttatttcacttttatcacccccaggccccgggttaaatcctgttaaatgtccagccttatgttagccatgctcttagaagttaatggacagttgtaaatccaaacttaggatgtagattattgggaagatgcattccgttctctggacccaatgtggccaaagctgcagttactggcagaagaaactgaaatctttagacaagagctgaggctgcaggacctcagcacctcctcaagtagacgttcttcctccattgccaagtctagagtctgagttttattttgctcagcaaggtaagagttaccttactgagaaaatcttgccatccacctctcaggagctactctcccagatacccaactgccttcaaaacttgtaggcattttaggcaggaattaccatccccattgagcagatgaggaaagtgaagtttaaagaggctaaatgcctttctccacgtcgtagagattttcccaggaaactacagtgagtaagggcagcacaatgtgtcacagtgtgaaacagactcaaaaaaaaaaaaaaaaaaaaaaagaattggaaagaaatgaagcaacctctagtgaacggactaacaagattcagtccaaagtgaaaaatcaatgacgcaaaggctcagcctgcaaaaatcgatgaggcaacggaccaataacctgtattcccagctgaattgacacccgactgcattacagtcatatttgtatttgcccagacctattccccatgccacctgccagcatactgcccacatgccagactcaacctccacgcacgtgcccacctgatccaatctgaagagcatcttccaacagccctgagaggtaactgatagagcctgcacacagaggcacgagaacagagcccctggaacaaggagataaggtgaccttctgagagttaatttagtaacaatcaagacatctgcatggaagcaccagatatctgcagaaaccaccttacaagggcaaggtgtccccaggtctccactgaaaaagcagggaagtgaagcccaatcagggtgacaaggtttcttccccaggacaagaatataacttaagaaggctataatctaaacagcttgaataaagaaggtattaaccaactcgggatggtcggctcggagaacagagtaagcagcatgagtgcttggtttttaatctcatgccagccagggagggagagttgtggttgactcaccaggaaggtgaactcccaggaggcgcagcagttggacacgaggcttctccatggtgcggactacattgttctcaagaacacccagcctcctagtcccgatccatgctcccccaaggagcagccaacccaccaatgtgtctttcttactggaatattcccaactgtattcaggagttcaccctccacacatggccgcaccccagaagcaggcagccatgattggaataagccaatgattcccagcatcaaccaacagctgtgattggattaagccagtcatgctggtctccttctccctgccagtgatgagtttaggaacagccatgccacccaagcctgatgaatgggactgaatgagaagcctgccaggggcttcaggaatataatttttttgctctttaaaagagactcatgtgagggagcacctctcttccttacttgtccacctgtttacaatgcctggaactgtggcagacttcttgtgcccatgagagaggcaccactgatgtgcctgcaatggctgaacagagagaagggaagtgccaggagtaggatgatgcaggggagctgctgaatgaccagttttagagccgcccaacttgggtcttcttgtgtgaggccaccattcacttatggttcacactattactgggtcctaccagaaggcgaaagcatctcactgactcacccagtaatccctcaggctacagctgtgctcgctgatgatactttgctgccatgaagactatgaagggtgtctaggacagcaacagccattctttcattagctggataagagcagactccagcaatgaataagatggcattttatcttaaatatcaatatccttgggactagaatgagttagtcctgagaatctgttcatctctgggtacacacaccagcaaagccagccccagtccataataaccccaccctggaaggccctacctggcagccactggctgcctcccattgcaggttggtgtcaccttgtttaacagcaatcaaagggaataacagaaatagcagaaaacacctgctaccttctcatccccactctacctcatatctcctcaaatcctccctactctgcatacttattttcatgtctttagatgagctatatctttcttacccacctcgtggcattttggaaagaataaaattaaatcaatatcaaaaatacaaggtgttacagaaatcatggaatttgggacatgaaggctgtgttgaaaatcttttcaacttactatgcattggattcactgggaaagtttttttaaaaacacagatttcagcaccccacccccagtaactctggtctaaagggtctagggcagacatcaatattttttaaaagcttcccaaataggtattcttttttttttttttttgagacggagtcttgctccgtcgcccaggctggagtgcagtggtgcgatctcggctcactgcaagctccacctcctgggtccatgtcattctcctgcctcagcctcccaagtagctgggactacaggtgcctgccaccatgcccggctaattttttgtatttttagtagagacggggtttcaccatgttagccaggatggtctcgatctccagacctcgtgatccgcctgcctcggcctcccaaagtgctgggattacaggcgtgagccaccgcgcctggcccccctaatggatattcttatatgcagccagagtggatgagaaccactgataggcaaaccctgtcacgtgcagatgaggaagcagtcccagggttcaaaatcacgcatctgctggaaagaaagccagggcccttggggtctgatctcttgagccccagactgggtatcttttcatcatgcttctgtgtcaactccagggtatttagatcattattattaatagacagagagaggaagcacaggaggaagactcaccaagggccatgaggaaacttctagggatgatggatatgctcattaccttgattatagtgatggcttcacaggtcaaaacttattcaactgtctaaacatgcagtttatggaatatcaattatatctcaacaaaactgtatttaaaaatagacccaaaaggtaacaaacataaagagacaacatatttgcaaatcaactatctgataagagtctaatatccagaatatataaagaatttctacaactcaacaacaaacagataaaccagtttgaaaatgagcaaatgacttaaagagatgtttctccaaagaagatatataaatggtcaatctgcatttcattagccattagggaaatgcaaatcaaaactacaacaaaatacaatttcacatccactagaatggctataatcaagaaaacagaaagtaacaagtattggtgaagatgtggaaaaatgggaactcttggatactgctggtgaaagtgtaaaatggtttattcagctactgtggaaaactatttgatggttcctcaaaaagctaaacatagaattaccacatgatccagcaattccactcctaagtatattccaaaacagaaattcagacagatatttgtacaacaatgttcattgcagacaacgttcaagagttaaaagatagaaacaacccaagtgtccatcaacagatgaaccaagaaacaaaatgtgatatatccttacaatggaatattattcggccatataaagaatgaagttttgatatgtctaaatgaatgaaccttaaaaatattatgctaagtgaaataagccagacataaaaggacaaatattgtaagaatctacttatctgaatctcaagaataggcaaattcctacacagaaagtagaacagcggttacccagagctgggaggagaagagaatggggagttattaatggcaacagagtttcagttggggaagatgacaaagttctgcagatggatgacaactttagttacacaacatcatgagtgtaattaatgccactgaattttacgcttaaaatggttaaaatggaaaattttatgttttatgtactctaccaccacaagaatttttaaatacagacacactgtagtcctctgccatccaactctcacaattactgtctgtatttgtaaaacatgttacagattaattaataacaaggaaaaggcttatgaaactataatgcactaagaactctacatgaattacctattctatttctcttaatagtctataaggtagatattattatgatctttattttatagacaagaaaactgagtcacagagagcaggaaatctgtcccagaccacaaagttagtatgtaatagaatagtgtttttcatctggtaacttcctagaaatgcaaattctcagacttcactccagacctaaggaagctgtgtttagacaagactgccaggtgattctgaggcatggtcaagttttagaaccgctgtaatagagccaaaatcgagttcagttaagaacctgaactttcgagtgctgtgacaagcagcagtcattcttaacaaagagcagtggttctctcacttaacgatgcatcagaatcacctgagtgcattcttgcctggagtgattctcacctggagcccatcttgagtaggctgatttggtgggtcttgggaagggcttggtaatttgcattcttaacaagtttccaggtaacactcatagcccagggaggacactttgagaatcactaatatacagaatctcattattatccacattttacagatgcggtaactcaaaatccgacattgtaaatcctagaaccacaaaaggggttagttattggctgggcctagagcctcagtccaaagtttttttcactacagcataaagccatcaccccagtgttccagatgcttccaggtgtcaacttggcacaacctcccttaaagccaacacaggttgaagacataaaagacgtttttacccattccaacaaactggcattagagtgatctaaaaaactaactggcacttgtgccaaagaaacgcagtaagaagacagaaaaaggaagggacaataataactagagcctagtttgggggtcaggactctgtcacagtggaatctaaaacctgaccatgcttcagaatcacttggtggccttttataaacacaggttccacaggtctggagtgggacatgagagtttgcatttctagaaagtttccaggtacaaatgcgttgatgcagttgggaagaactagaatatgggtcacttcctctttattcttatgaaatcagttgcctcttatgtaagtgaaagaaaattttctttcctgccttgtttgaaaaaatatgacatcataccatcctttatgcacaatgcattatccttcatatgttttattaccatcacctgtaatgttctatacatctccagattctcctctttccaaaccatttgtcgtctctgatcatgctactctgctactcgagaatcttcgatggctccctattgcctacacagtgagggacagacttagcattgtattcaaagacctccatcatctgacttcatggtttccactctaatagaactactctctattgcccatgcatgtcctgtgctttcctgttgtcatgccttcacccagttgttccctttacctaagattcctttttcctccttccttccccatctctacacttacaaatgtgacctgagactaactatttattccctctaggcctcagttttcttaagcataaaacagagatgacagtaggatcttccttgtaggttgtgatgaggaataagtagagcaatcagtggaactggttgccaccaccacaaatccctcctaacttccaaaccgaagggatttctgtccttcctttaatttccagaataatagaacctgtatacacattatcattatcatgttctactttgcacttgccataatgtttatacctgtattccctttgcagctaaggaaaccccattaaggtgaagatatgcttcttattttcagttgcatgcacagtactcagcacagtataaacacccactcaaagtaggaggaacaaatgatcaggactgttttaccttaaattgcttcctagagctgcccttgcagtgctctgaggtcccatcataggtagccaaatccttgggtggaacataaactcaggaactggagaggtgcaaggcccccaacatgaaaagaattaacttgtctccagacatcacctgttcaaagggttccctggaatccacagaggccagccttagcccaattttccaacccaagcaccttctaataattcaaggattcccatccacatcaggactcccctgtgcttacttaaaacaaaaaaccttggctccacaagaaaaccatttttctctatttgatgctctgggcctctgttctccttttgctctgctagtctaagaaactgcagctgccctgcccacctcggggagctctgatcagtggaagccgggcttcttgagcacacagcctgcaggaccagagagctctgctctcccttctgtgcctgctgccagcacccagcccttcctcccttcaccgcccatcttggagccatcacctatcccacactaacccacctccttgaacaaggccacctcatcctctcatcttagaaccaagaactctggtttgggaccacttcccacagaaccagacccctgtggggttgctctaaaggacagaataaggatattactattattattattattattattactattattatgttaacaagtcaccaggcaacaaaggcaatgagattcaaagacattccttggtggctgagtgaaggctgaagaaagggaaataaaatggttgctttatgagaactcccaaggccagcaaagaggaagaaaagaaaaaaggccagtgaagaagaagccgcagcttgagtgtgtgtagtagtaaagaggagaggggaacaggaattcacactgaaacagaaagccggtcagcttcaacaaggagaggatacaagactacttggctggaacagggatacctggtgagaaatccaatcagcaattccagatcttccctgactctgctccaagtctccccaagtcaccagccccagggccaccgcccctactaactacttccaccattagaccccctcccctctgtgagagggcccatgaaacagcagcaacttccaagtgagaggagccaagtgagagacctgaggttccttccaccccagccctccctaccctggcgtccacatatctaagcctgatgcagagaccgagaatctggctccaggggccctgtccacgggtgcctgcccgtgagtgttgtgtgtgcatagattctgtagtggcggaatggggtgaggaggcacaaagagcctctagcctgagagcagccgggagctggagcaaataggatggacactgggttggctggcactcaaagccttttattttagtagtctccaaaagaagggctatggaaagaaaatactagaacttctatttaaatctatttgtacctcaaaagactgaaacataacagctctactaatatttgatatgaagaatgggcgccattactgggcgtgttgaggggcatggatcttacaggtgcctgagagcagatggcaccatgatgctgaggctgacacggcgcccccattccttaacctgccacagtatttagcaagatatgacagtatacctgagccaattcaggaaacttacgatttactgtgttatttcacttcaataatccagtgttttaaaaactaggcaagtggctttaaggccttcctatcaggagaatatggatagaaaataacacataaataatgcaggcactggtaatcaataagaaaatgaagatgtgatccttccacacctagtatagatcttcatcatccatattacaagctgcaggaccaacttatcagaccagaaatcaacccgtctccaaataaaaaagaaatcaaaactatgaagactattttgatatctggatttatgttcaccatcattaatgatgaacctcccaatgagcgctgatttacttacagacaatgcccaatggatgggggcacatgccaaaaacatcagagaccaaacgtcattccccaactttgttgagggttctcctggcttgcagaggcagaggaggggctgtggtctggttggtgggtttccatgggagaacagcaagagggggccacactcaggaacctcaagacccagcccttggtaacggccttttgtggctgaggccaatgagcgtatctcccctcctaccctcttcctcatatcagctgcagagttggggctccagaggaaaggaaaggggtcccttggtattcaggaccctgattcatctcatttacctcgatggcagccgccccatagcccacacctcactgtcccaccaattcactaagaaagccaaaaggaaagtgtgaccccgagagaatagaacccaggtccttttgttcccaggctcatgcattataccttggccaagatcccctctgcaggccacacaggcaggatcttttcccgatgattgaaaaatcaaggcatcttcccctgcaccaataggagctaattacagagaacttgccacaggccaggcacgtggctgaacacttgacccccatcatctccattaatccccaccacaaccctacaaggtaggtcttattacctattagacagagggaaaaactggggtttacagagagtagatcattttaaaggctgcagcccagactcaaagccaggctccagaatctctgctcccacctctctcctgcttcccacagcaattgggcatgccaaacttggagaaaaacttaccttcgtcttatgaccttggacgagttactctctgaacctcggaccctcgtgcataaaatggggttataataggacatactgcattgggcttttgtgaagattaaatgagttaataagtgtaaatgcttcaaacagtgctgcacacatagtagctgctgtattggtgtttgcggttattattgccatcatgactgtgttacattgttctccctagtaagttcagtttttcttcccgtcgttccctataagtgactaatttttatccttttatcctagtcttgatccttgcaacagaccaagggagaagttgtgcattacagaggacaaagactaaattcccctccctaagcctacctccacctctgcatgcaccccactgacacatagaggtctcaacaaatagaacgacgacctcagtggtgcagaaggaaggagaaggaggcttctgaacaaggcttccttcagcccctgcagggcccccatgtggcaccgccaagcttctcctctgagcaaacctgccagatataggctgatctaccagggctccagacacctggagattaattagaaggccagtccttgggcaaatcagcccagaggaccagccacaaggagctgcagagagaggctggtaggctgtaatcctagagccagccacggagctatgcctggtccagcagctatggcagtggcagcaactcatacaccacccctaagcgaggaaatgctgccctaaacgtatggctgacttttacaagtcgaaggtcccaactccaggaagttagggcagaaagagacagtcatgaggaaagtatttctgaagaaaagcagattattttgagcacgaactgctgagtccccactctgtgtcagcctctgcttcttgccaaggagtgttgctaagctgatcttcctcccaggagcattaggctgatttaaaagatggcaaggaagcaagcaactagagaagtccgggaagccttgaagcgacaggttacgtataaactgcacttgggggctgctgcctggaggagcgagctttctttctggattcttccaaagggcagaagcagggcctgcaagtggaggtcagaagacagagatcttgatcctgtctgagaccacgccgtccacagggccagcctggcaatgggtcaagctaccccagacatatccaggcagcagccaggtgtccttttcgtgtgcaccagactcccctctaaggcaggaggttggagcaagcaatgcctaaaatgagctcttggctgtgtctggcacctaccaagcacgacaaatgaaaactttggtggaattaacaatctaatgataagatttggtggttcttttttggcctgacacaatgaaagtagcctcttaggaagaagccttaatcctctaagtccatacattgccctgaaggggccattttcagcacccaagttcctatttcaaaaaagttaagatgtgctttaagggctttagctaggattctctagttagagacaaacaccagaagcagaactgcagggtgtctcgggactgaggcacatgtgcctgaccagacccggaagagggtgggaggcatctactcaacatgctctactgtgctgcatggaagtgggagtgaggaaggccagacaggaagagagaagtgaagccaggccctctgagagtgaggtgtcaaattcacaatgacagcaaagcctctggtaagaatgggagctgggaaattcttaaaaaaagaaagtctttatctagatcaagcccttcctcaagccatgaccttctgttgtcaatttcatggagaagtgcacgggcagtgggggccaccacaacccgcacgctcagcctggacacacagcctgggatcatttatcaaaccagcagaggggaaaatcccccagcacagagcaactcctctgcaaaatgtagagcttcgctgatcctgcccgaccccaaacctgctcacatttcaagtcctccaagaaaaggatcagacaatcgctgtcctctcttgcttccccttctccagtcctcccaatgctgccacccacatggaggagaaatgtgtaccaggcttgcagacacagggtggcagtggagcccttgcctgcttccacgagcacctgcaccaccttcctctcatgagcccagagacatgtcagtgtccacacagcagcccagcaagagaggaaaggagtcctggtgctcccgaagcggagacactcgggccccatgaagttatatgatcagcacaaatgcaccggcaaggtcttaggcagaggcagtctgaagcctggagcatcaccagcttcacaggaagggaatacctgcttccaggcaaggtgaatggaactgaagtgtccccaccgtcaggaattcagacagagcaagcaccaagattgtaagtgagcattactgcaaaagcattaaagttgggggctatacctaaggctgccctggactccaggcctggctctgttatttgctcattgtgtaaacctttgaaatttctgaatctctcaaacttactttatctataaaatggatttcaaaaatagaatccatccctcacaactataaggtgtttagcatctgcccctgcacatgataagcagtgggtatcatattatggctggaagcaccttcaggccaggagagccaggatgctgtaggctgctgccgcaccccttgtccattatctcccggcttcccacactttgattccagctgctgccatcatgaccaaccagaggcagaccttgttcccctcctaacatcctgccctaagcacgagggaaagaaaatccctttccttggctcctctttgaccaagttgacattgtgaaaagcagagaatgaaaatctgatagtcacagaaaacacaaacacagtagaaataattaaagctcctgaatacaggtttcagatcctgtaataactcacatcttctatgactttttaacatcccagcccctgcctgtttccctgtgactgctgccaccctctcaccctccttgctcttctctctccctgctacaaggccccaggacctattgtgcctacttaggatcctgcctctccatcccagggctgtgggacacagggagtctcaagagattgacagtggagtacaacccaagtgagactctgtccctgccacaaagaccgtgccctgtccaaggccacgtagagccatacaatatcccttgatgagtgtgctgtgtgtacatggggagagggacagaccctccacctgtcttcccagagctcacaatacattccaaattaccggcagttacgaattggagggctccagtcagtggttctcaagttgcaattggtccccagagcagcaacacctgggaacttatcagaaatgtaaatctcaggcctgcttcagacctacaaaatcagaaactctgtagctgggttccagcaatctgatttttccaagccctccaggaagctctgaagcacactgaagtttgaaaagccactgacctgttatagtccggctagctgcacaaccttgagtaatacacttaagtctttccatctgtaaggtgggaccaaaaccagtttcatcatgtgttaagtgggaatgatgatggaacctatttcacagggttgttggttacaaagattaaataagaccctgcatagaatgtgcttagcaaattgtaagcactcataaatatttgctaatattgatcttcctaaaaacctaagagatgagttcttccacgatcactaggcaactatcaaggatctcagtgaaggcttagagagtttttgaaaggaatcgttcaaggtcactcagctatcaaagatatcttaatagccattccccagagaacagagcagtgttaactgaaggcaaggtgttaacaatgcctttccttctctctgacttgcaaaaggtctcctctggggccatttcccttccccgtgggcatctagaaatgtatggaggctttgtggttgactgagtgctcttggcttttaggatccagagggtcagggatgctcctcttgcactgtgtaagatggctctgcataatgaagaagcatcctacttacaatgccagtgacatctccactgagaaacactgatcaacccagagtttcggagctatccagagcatgcagcatgtctctgcctagagaatacgctaaacaatcacaacaattgctgtggagggctggacgtctcatgggacacgtctcctgctcaagtcctactgtggatgttgcgagggccagctctcactctagacatttcattgtcttatttaacatgcaattgcttcaaatctcatttaacatgcaattgcttcaattgccctagctccaatcaccccttcccaaacctgggctagatctccagctccgtgggcccaggcaaacattttccaacacggtgttagtaggaattccccaaatttccccaaagttcatacaggaaatggatgttggctcaagagagcagaaggtgtagtgtggaccgttctttttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggtgtttcaccttgttagccaggatggtctcgatctcctgacctcatgatccacccgcctcggcctcccaaagtgctgggattacaggcgtgagccaccgcgcccggcctggaccgttcttaaaaactttgtgctatttattatttgttactcagaaagggagacggaggtaaggatgagaggagaatgttggtactgttcagaaacttaacaatcctggctgtcaaaaatgccaggagtgaatgtaatcagtagaatcaataaagatttatttcaaaggattcccaaggaaaaagtgccagacagagagccagaggggagaaaagtaacagcagcacacaaaagcatgcacgattcacaggtttcccgaagcactggatgaaatgtggcttggatgaagttggccatttcccctaacttaacacctctcttcccatacatagcccctttccctagagactcctacctagtgctttcaccagcttccccctccccataagagtagcaactgactgtgctaaaatgttccttgccccacaaaccattaagctgtcaagctgagttggtgaacaaacccagagagagccggtgctgctggaatgctaacggtgaaaaccgcaattattctttctgctctggacaattcctgcttcaactttactggccccaggtcatattttgtgatctttggatgctgatggaagagagacggcttgatagagaaaataaccagggagattatgtcttgatagagatggaagtaactagtagaggttttttcgttgttttccttttgacatccacataggtgtcatataatggcttctggttataaagccccctatccaaaggaaaaacaacttctccataaataccttgcccacgtcagtgaaatagctgtgttacacacttgagcaccattttcgaggacactttaaatagagcatgggttgctgctttcaatttaacgtgtgaacaggagctgctaaggcaggcagagatgataagttgtggggatgggctcagtttccattggtgcatctgctcagattctaacagatccgcaggcatttaaggcatctcagggacaagccaggtaagccacgtgagagactcactcaacaaatgaatgaacacctactatgcatgagtaaaaccagatgcgaatcacttcctctagatgaaatgggctttacatacaaattataacagttccaggaaaatctaatatatgtttagaagaagaggtgctttaaaaaaaatgaaataggtggtacatgacaggtaaaatactagacaagttcagaggagaggtgggtggtctctgtgttttcttgtgtaacaacctctactgagttttatgagaattaaaagaaataatacatgactggtgcccaggacagtgcctggaactaagtaagcacttgataatgatagcagtagtcaaacaagtaggattaatatggttgacattaagtttttactgataattttaattataaatccagttggaggtaaagacaggaggattatcagataaagcttggtaaataatgggtaacatctggacagatgaagatgagggcgtgggggaatagtataggccaaggtacagatgcaagaaaattaaagacttgctcaggaaataacaaatactacaatgtgtcttcaattttctatgtttgtactgtgacaggtctgaatgtagatttcttatttaacctgcttagagtttacagaccttcttgaatctctgtattgatattttctccttgttttagaaaattcatagccattacctcttcaaataatacttcttcattttttttctttctttgtagaaatccaattagatagataagactattctcactgtatcctcgatgtctcttacctaagttttctgtatttattatacttcattttggatgatttcatttgcccactgccctacttcattaattatctcttcagctatttctaaattatttaaaatacatccattgaattcttaatttcagttgctgtattttttcagttccaggatttctttttggttcttgtttgaaatctactatgtcatttttatagtttctagtttgctgccaaaacttgtaatcttgtcttatttctacttgaaaaatagtaagcatggttattttaaatccatggtctgataattgcactggaaattatccaggaaacctgtgagtctattatttctgctggttctcggtcatgttgacttatttccttgtgtgtcagcttatctttgattacatgctggacattgtattcaaagatttatttgtagaaataatacaatgactaggataaggtatcttcctccagatagtattgtttgcttctaccaggtaactgacttgcaacatagtgtaacattaatcccatttcagaaattgtcatttttcttagctactcaagggattcaaagcctgacttcacaacttgcaaaggctggtttacttgtagttccaacccaaaatgttcccatgcttaataggccctggactccagcttgtgtcctgtaatgccctgatgctgtcaaatgcattgcttagaccctcggctgcctctttagaagccagcaaaagtctaatccctctgattagttaacctcttgatttccagcttcttccaaaatttggccctatcaatatttaccaccttactagctttcatatgtcttcaagcatgcttttgaaaatatcttctccactttctgaatttttatcagtaggaaggtcagtcaattgaattagctagtctgcctttactagaagcaaaaacctcccagctggtatttgatttgactggaacattggatttacttttgggaggaaataaaagataaacccaaacaataggccagttccaaaacatggataaacttgaatgctaggctaaaaaggaaggatctttaataagcgatggggagccattgaagattctcaagcaaaggagttctccttgggagctatacttgaggaagatgaattggacacttacgtgccaaactgattagaggggcatgagaccaaaatcaggaaggagagttgactccttttatcaaactttcagagaagaaggcaaactatctgagctagggctatggtggtggcaacactaggaagacagagacagatgggaagtacagggttatttcatgagtgaggcacaccaactagaagatggtaacagaaatcagaatatggaaagaaaaccagatgaaggacagagggagaaaagtaaaatgatatgatttgcccattaactgagagtgggattgaaagagaaagaagaatcaaagatgatattgaggttttgaacatgggtagctcagacaagggaaagagattatgagggctaagccacaacccacccatcctctttttagtcatgagacagctcaaagaaaagatctgtttcaagtaagtgacagtggccactctccaacccaaaaccctcccagaggagagatgatttcatatgagaatagagaacctacccatggtgtcactacaatcaggcaggtgggacaacctcttggagagtcagagagcaacccattttgtgatattagagattctctaagtgaaattggctgacagcacaattcccgttttggggaaggagaaagctcccagagccacttgttagtaacagaggtcctggagcattggattacaagccaggaagttccatagaaaagaaggagcacacagaaatagacttaagtgtgcagagggtgaggggggcacaccctgtcactatgtgacaggtgatccatgggggcttctaggattctcactattggttctactgagtgatgaaaaggtgcccattagggttaacttcccaggtttttaggtagggtccgaatggagtggaaatgtaaacctttaaataattatggctttcttggcctagatgtctgtcatgcactacagatattttttcctcccttccatgtgtatgagtgaatatcaaaagtaggtacctgtaaaaaataaaaatagaaaactttcactttcattgcaaagatcttggagatgaaataaaataaaagtaaaatgtaacttgggaaagggctatataaatttcacaaataaatgactgaggttgacattgatctgaactggacctgtgctacaatagaggggactagtacagccacaccaggcaaagctctccacacaacctgtttgcttttcattttcttattgtctacaccaaatcaataagatctgcaaaaagcaaatgtagcaaatgtattttttttctccctattctgtaccaggactcctctccggcttcagacctggaatttaacaggatgaccacccctcccccagtgtcctctgtgctcctattgtctgccccaagaaagctcctactaattctctcaaaaggaccttacctcctgcagttacttcacatgctcctgtgggcagctttaatttatcccagtggaagtcaagatgtaggtttgtgtagaggcctgggaaacctatcaaaggagaatgaggttgaacaaaaacatcccagggatagactctcagctccctgtgggttgggccatgtttgccactcacactgaacccccagcacctggcacaatacctagctcataaaaaaacacactataaatacttgttgaattgttgaactgagagagctgggatgagaaaaacaagccaggcatcactttcttgtcaaataatccttgtacatttgccacccaaaggcagggcaatgggttgacccaaggtttttctttcatgaaacagccccaaagagaatcctccctataaatgtgctcattttttctctccaaatgcctttattccagaagaaagcaaaacagtgagtggatgactttcatttgttttttgcaggaaaagaaaaaaaaaatgaggattaagaaaatttggaactaaggtgttaagaagtgtaatagggtagaggaggctaagaaaaaccagtgttgctgtagtagggagaggtttgactgactgactgacaccatccaccacaaagtcatcaggcacctgcgggcctggaccctgcaggaggtggctgggtgtattcctgctgactgataggataactatgcacattcaaggctaagaagaggaccagcagttgccaaccaacccccaaaactgaccagtgctgagtagtcagtcacctttgataaccacaatcatcattagtgagtccaacaggggactggctttaacaccaacccaaatgctcagaagggtgcatttgactagcttgacctacatctggttcccctctgtgatgttttggccatcacccaagtacttgggatctttgtctctagctagagcttcaggaatagtagctcacctactcctaaaactaatcttcagaatgaaaaacaatggcagcactgcagaaaaagggctaggatgtggaaatgcaggaatagatgcttccaggaccacaaaaaatgcagcatctaagaaaggacaagtattagggatccctttcatatggtcttgatcttccctcctgctttgacagttttagtgggttaaatatgctaccctgttgggaggtaggaactgagagactaaaaatcccaatgcaccagtaaaatttttttaagtccagagaaagtagaactctggtgaaagccatttgtaagcatatctccagaatctaatatatctgtgtggccaaaaacagtgggcactgttaattcacaaccagacactcactgagactcaggaacagaagggggcaggtgctggtaatcccttgagtgctaagcttttttaataatacactggagagcagaggggagaagaaacagcattaatggaaatgattgaaacaaatgccccactagtggacagtgatcttgttttgggcttacaaaactgattgattatcagatccaccttaagcctcccttttgagaaggttctccatccccacccttgctcctaacacccttgtcgattctggttacatcagtctggaacaagggcagggactttgtaactttcaaaagttcctcaggtgaatctgaggacaaacaaggcttaggaatcatgggtccaacccatgagattcacaaaatgaaaatatgcaagtcaaatgccaaactggcccatctggtttcactattccaggaaagggagcccaaaaggatgctaatttgttacaagtggcctgaaaaatacatctatgttttaaatacttcctctcttgaaatagtaaactgaattacagcaagctagctccatggtgatattttccctgattccagttcacagagagaatttaaagtgaaaaatccttttcaaaaggaagatacaataggctgtgctcttcaatgatgcttgctctgggcccagtactgatgctgaccacttcacacacgtcatctcacgtaatctgtaaggaaggcatcatcacccccatcttacaaatgaagtcactgtctcagggagatttaagtacatttgcccaaactacaaactggtgggatgtgaattgaactttaatctgatttcggagtctttaccttgaagtctatacagtatgttgctttcttaaacccccccacacctacatctctgcttcagtttctaggtctttgtatgtcacttaacaagcatcccctccatgccaatgtggttgcacccatttcttcgctagggtgctcctgaatgcatgcaggcatgggtaagtgtatagtgagtagtaggagtcaagacaagaggctgggagctgtctggggctcctcctgggatctcctggtggggtgcagaactattccagggattccaactctggcctactgtacagaagaatcaagggacagacattccaacagccaggcaaaccagaaccacagagaaaacagggaggcagtcaaagccatcaggaccccacaaatatacccaccaggagaatcaaatcagggtctgcggaggcaacaagagagtttgttggtggcctagatttttactctttggaccactctgtatttcagcttcacgcagcagcttgcaaaagagccctggggatggcaagaaagcagaaagcacctctctttgtagccacaactacagatcccaagaccactatgaccaaattaggacagaaagccttcagtgacgcacacacaggccctggggagtctgaacacgagtagatctaatgctgttgaacaaaacgtgaaaccgaagaaaacacccagccacacagagccctttgaattggtggcttcactccagggctgcaagtggggagagagtgaaaagagacaaagcctggctttggaaagtctcaaaagagtttctaggaatgccacgtcccaaatcctgtggggtttgtgaggggtttggagagtcctgcttgttgaaaagcacttagttgtcatagtagaaagtggagttctagactcccctagccctcattacaaatcaatgagtagagtttaattctaattgtgagatgactgagaaaggatttttatgataagcagatgaggctagggcaatttcaagtgcaagtaaggtctttatttattggctttttaaaaaatgtcccaccattttgtatgtatttgggggttttgcttgtggagagagcccaggagtgggacatggaggtagacaacactgataacagtgagagacgctgccaggcagtctgagttctctgttcctagccctgggccaagagaaatgtgctctgacccaaggttaggcatgttctcacccaagaccaagaccaaggattctcctaaacattccaataaatacccaacgtagcttttaaaccttaatctgttatttcctagtttgcagagtaaaatataccctgtcagaagtgtttgaaccagagtgactccatcttgaataggggatgggtaaaatgaggctgagtcctactgggctacattcccagaaggttaggcattcttagtcacaggatgagatatgggttggcacaagatacaggtcataaagaccttgctgataaaacaggatgtggtgaagaagctggccaaaactcaccaaaaccaagacggtgatgaaagtgacctcgggtcgtccccactgctcattatatgctaattataatacagtatcatggtaaaagacactcaggccagcaccatgacagtttacaaatgccatggcaacatccacaagtttccctatatggtctaaaaaatggaggaaccctcagttctgggaaatctctgccccttttctggaaatctcatgaataatccacccctcgtttagcatataatccagaaacaactgtaagtatactccatcaagcagctcatcctgctgctctgcctatggagtagccatttttttactcctttactttcttaataaacttgcgtttgctttactttatggacttgccctgaattcttttcttgtgtgaggtccaagaaaactctgttggggtctggatcaggatgcttttctggtaaggcccctatcatcatcccacctaagaaaacaggaatcccagggaacctaatttcccctcgtacaaaatatttattaactactcacacccttgaggtgtcttggtaggaactgaaccacttagttcagacattggaagtgattccaaacttggctactcatgagaatcacctagggaacttaaaaaaaatcctgggtcccaaccctggtgatgctgacacatttgggccctcccaagatttttgaaagctggaaccatcaatgcaggaaaaaccttaaaagtgagtggaccctaaaatcttcctgggggcagatttccgtgcttctgggagggtcatttccctgagtcattaccctccttagtgttctggaaaatggcaaagtacatcaaatgcagggaggattcctcagcagtcatgacaattgctatttgggttaagttactgctacatctttaatattcccttggggtgagttgtttgtttgtttgtttgtttggggagcagcatgggggctaggatttttttcttaaaatgactttagaatgctcagcttatttttgtggatgggcagacaagttataattcaaaccacagtttgaacattaggtagagagaggtagagttatagtttgaaaattaggcagaagaagacagcacaggtgggtgagatcctcactttacaagaaggtggaggctgagcccaggatccagttgcagtttggagcaccaacccagactttggggttggaaccttgttctgctgtggctgttctgtgggttctataaggctagggctataccccacctgctgcccaagggtaaggtttaccctgaaggaagtgaacgttccctaggaagacaatgaaggctggaatgtgggtcttcattgcaactcagagtacccctgacccccacagcatggtggtgagcctgcccttcctctagggagcaggatgcccaggagtggggcatgaggcacccacaagtgaggacaggtctaagcctggagatgcctacagtggctaccttttgaagaagtgttaagttactctctgtgtttcctttattacccttgatccatcaaaaaaagttgtattcagacatacagcctgatctctttgtgctggaaggaatctggggaaggacctcttccaggctaggattaacagggagaatagcaatgagagggaggggtcagcatttcttcagctgcaggaggcaattagtagacacttaaagaggatctgagcacagctcagctaatttaaaaaatcagcataatttgagttttaaccaaaatatgactttattttgtatttgcaaggcaccaaggtctgctatacacaattaacctcccctgtcctcccctccctcaaggcttctgtctgacagactcagcgggaggaggaaaggaagagtccagctcctctgctgctgatgaccctaatagtcctcctaccccactgggctgcaatgaccacatctgcacctatagtccctcatccaatttgggacttattgcagtgcagaccttaatcctggtctctccctgacctcctggccactcacacacccagtatatctccatgctgtcccatagacacttcaaacccagctcctcaaaaacaagccccacctcttccttctcctgcattctctccctttgctagagcacaagcacccactcggtcctccgtgcccctcagctgcctcatctaattctcaccaagacccacttctgggcctctgccttcccttccacttagtacctcaggcccagtcctcatcatttctcccttggaccacagcagcagcctcctgacaattccccaacactcaaagtgcagtcctggcatgccgaacttggagacagcgagcttaggtgcacacccaggtccccagagcactcagcagctttcttcacacattttctcttcccttctctcttgaccagatacagaagagccagtgggaaattgagaagcccttaacaggatggtggagccacaacatggaaggaacctgggctcctgaatgactgtatggagcaaaatccccccacatactaacccatattgaactgtggtggtttgttacagaattaaccagccatgattaatagtgagcaactcaagaacaaaaagaacaaacctataatagaaaagcaatgcttttccattcacaaacctttcattacaaaatgccggtcgtgtcctacagccagagtagtgagtatacctcgctggaggctgcaagggccagccagtccccatacacaatcagagctctctgcaaaagacgtaataccaccagccctgtactgtactctctcaattgccctctagtttccccaccccaatattgcagtgtctatgatcactgaaggaaaatgaaatatgattctaggtgtcacctttcaaagggtgttagtgactgtcagctaaagtgatttaagccccggaaaaacctctgtgtccttttaacatccaaaactaatcctcttcacaccagacatcgatgttaaataaacagagatttccattaacctacacctctgtacatctatttttaaaaagcggtgtcactctcctttaaatgaacatactaattagtgtattaataaatagctgaatggaatcaatgagacatgtaatcaaggtctgaccaggagtcagggccaggttgaagggggtggggggaaggagaggagggaaaagaatcttattagcaggtttgctgaggagggacatgtaaaatcaatgctgcacatgcagccaagatgcagccgaagttgacagtagatggaaagctaagtgcttgctccgcctccttcctttgacaggaaagctcccggtgagagttaatgtgatgagcaaggaagacattaattggggcaggaaaagccattcagagatggtgtccaggatcacagctggcagagttacccagaacctcagtgctaaagccctgactcctagaccttgttttaaaacactaagaaagaacacacttacgagagttgatttagttctcagcaaacacttggtcaaaaagaagtcacagggggagttatttgtttggggctctttgttactcttaccccccttcaaaaattctggttcacaagcagtagctggaagtacctttgccccaagatgctaggcactgggaaatgaagggcctggattctctacaggcagccctgggggtgggaatggggcagcccgcttcttcatcagctcccaatttcctgtagcacaccccatagctagaaggctctggaaggtgagaataaaaagtccttctgcaagtgtgaggtttccagctgaagtggtatctgattacccgagccgctgctcactggatctcaaattagcactgatactccattttcttcatctggagacacaccccctttgggccacaaaacactggacagaagaaaagtggactttcatttccctaaagattaatatcaggagaaatgcctttctgtataaaatcaattaggtgcctgagaccctcaccccaaagccagctcagtgatgctagttgaagtagaagttgtgttaggataaaagaaactcaaaaaaaaaaatttgccttggggccagtactgcccattacaagccctcttaggggtgattctgccaggaggcaggggattggcttgttagcagttagaatgcttggctcaggattctggggtgctatgggctcccatgccatgaaactgaagttcttcctaattctggttgctggaaaagccagtatctctgggtggacctcacaggcagaaaacctgctgctctgaatgcctagctctggcacggcatccacacatggatgatctagaagccttgcagatgcgtcctgagatatgtttctgccagccccaggcatggcctgcaacctgctcaccctgaggtcagcatttcctggaatgacagggaggacacacataaaggaagtgtggggacatggcaggaggcagctctcagcagcccttaggctattttccacattactgcgaatggtattttgcccccaggaggttcataacagtcagaaggatctccaggttccccagacccatcagaaaagccaaggggtgatggtcatcagcccagggggagagcttcctgacagggtacatgaaaattaagtgcaaaagaggggccagagacagctgtcccccagctcaatctgaagcacaggcacctagagaatggccacacataggaccttcccatctggtttgagaggtcctagcaaagcacccctgcaccagtccatatcttactccctccattgacgtgctaaaagtctgccactggaacatggtttctttgggtcaagcatcatgctttctctttcaacaacctacaccttagtgtacctcctccatcacctctgtttttctgtggcccaaggataaacagaagagagtggagagggtgcaaacagcagggtccccactgatctacatggctatttgctgagaattagggagtgctgtcctctctggttgaccagaacttggtaaacagaaggcatcttgggggaagaaaagggcaactcttcctgagcaaagagatacaccaagccttggccaataaaacatgagcagaatttcagcccttatttgctcccagctcacaggtatacacactacagtgtatatcaccaaaagccctgtctaaagaaagaaagagagaaatagagaggagatacccaagtacttggggcaaaattcaactatttctcaattttgcccaaggatacccatttggagatagatatagatatagatacatgactattttcaaaccaaaaatatcaggacacacactcaagcaatggcacagaatatctgaaacacaggctgttctagtgaacacagggcctgtggtcactgtagaagggctgaagagtagaggatggcagtgacaaggaccctggggggacagtgtgacaatgaggtgccccttttcctttaggggacagagaagcaatggcaaatctccccatggtgtgctatgtggtggaaagaccacctccacaagaccagagccggactctctgctcacagatgtcccatcaccttcaaaatacactgacacactccgtttccagagtctccaagcttttgttccctctccacaggggcaaatcacctttctccacagtcaaccagtggttctttcctctctcagcccgagtgttgctgggaataatgcaatgtttccagcttaatcgtttgtcatcatgcagagatttcactgatttcaaagctaaggtgcctggaagaatcgagcacgctctgaaccagggtgcctcagggcagagggttctcactggctggctggctttacacaggagaatcccagaggcccttactcaccagtttaaggctatctttccaggaaaccagggcctggggctgaagacagctgagatgggcagtgttcataaatatcacctattggaggcaagtgaggacatccaagtatgcaaacaccatgtacactgaacacacctctctggtctctgatggaccacttcagctttctgacttcgttgcaggcaaacattagcagatgccccatcctgcaatgcttggcataattatcaggtaggctccaggcaataattactcactaatggttagccactgctttgagccaagagtctcctatctgctctccctacaccaaattcagagtcttgggtggtaaacctgaaggaaaaaaaaaaacaaaaaaaaaacagtaaccatcaccatggcctggcaaaaaaaccacattatctaagatatcactccaggtcctataaaaataacgtatgtttacatgtggatggctgatctgagcacagattgaatatataaacgtggctgttaattctagactctgagaaaattctgagtcttccaaaaataaaggaatccctacaaatatttttaaatctttttttaagaggtcatactctgacagagagccagaattaatgcaatgggaccagccacctgctcttcttcccttcccatttgcttatagaacctcaaggcagtagacttgttgaagcccagtgttagaaacagatgtgactatttataaaccaagaaaactgaagtgttttaatccaacacagggtggcaagaagcagaactgacaagctttaggaatctgaagaacaggcaacaattttcaataatattacctctccacttattgagcatttaatatgtgtcaagcagtgtgcaagctatttcccacgtattatgtcacttaattgttagagcagtcccttattttactcttttaatgataaggacactgaacctcagagaagacaggtaacatgctgacgccacacagctgagtagccaaggcttgatgatgtctgtaaattactttaaaatgcatcagcttaaacagagtggtataatgtaagttagttccaatccttacccaaggatggttagtcgacatctgaagtattgtaactaaccagggctggtgacttagcctttgaaagccttgcatcagagtctacactgtttgttaaaaaacataagagatgttggaaacaatttatcagcaggaaattaagcagtgtcgaatatgcataattggttagaaatgccatccaggcatctctgccctttgggcacaagaatctggcaagcctagagccctctgtggctccattcttggcctaggggtcctactagggtctatttcatctctcaaaggatgctgtcctctaatcccactagaaggtgagctgaaacctgcaaccacattgccacatctgcctcaaataaatcttccttgaaataaacttgtaagagttactaagtcagtgcctcccaaactttctcacttcctgacacttgcagaaagtgataatatttttaccacaccctggggccagagagggagcttctgctgctgcatgcccctcgtgccctctggctgtccacctgcagggttgaggtgacccgctatatcagcaaaccttgatacccttccccggcacactagttgaggcagacagcaggatccacactgagcttcaaaaacaggctgtatggctatttatgtgcctggttactaacaaatattggtaggtagggtagaattgagtctgcaacttgcttttgtaggaaggttgtggaggagaaggcccatagctctcacctgcctataatcactggaaatgagtccccacataatctgcccattgggcatggccaagttggcattaagttgggttgcagtgccagacctgtctgcctccaaagtctatcctgggtcctgggtgctcccctgcttctggagcctaaagaaagtgaatcaatggttatttgtcaaacccaaaagggaagctcttcagaaaatgccatgtcaaagggttccgtccttggcgctgtgctgtttcatacttttatccgtaagttgaatgaagactgagagtcacatttatcaaatttgcaacggacagattccaggacttgtgaaggtcaaatgagataatatgagagaagtcatttaatagtagagtaagactcaacccattgatgaggatgaaacaaagtttaagactatcttagcagcctgaaacagggtcaaaactggaaccccaaaaagaaattgaatgtgacaaacataaattcaaattttaggcttcaaaaaatattaatgaataaagtaccaggtggcagaagtttgtgtaagacacacatataatgagggtgggagaagcttagagacccactggttacgaaccagcagtgggatgggggctgcccagaaaccctgccacatgaatgaattttgacattgggctttgctatccacacctcctgcagatggtgacctgcacctgtgatcagtcacaaaattagatgtggagtcagacctacctgcaccatgagaagcaatgagctctccatcaatgtgcaaagcagttaaaagagaaggaaccctctatcacgtgctactgaagttgagttgttcccatcccctgcaaaggctcccaacttgccagcacagccaggatgtttggctcagagaaaagaggtggcaggagagtttatcaaaacctacaacttaagattttcttcacagaagatggaggaaatggcggcagggggggacgtaaagataggcaatcaattaccaaggagcccttgaataaaaatctctttatttccttgaattttcctttaatttatcttttttttaaaaaaaaaaaagttttcacctttgcaaaacctttggactttttgaccaaagacaacaggaagtcagccaagtttaatggagttttcattttgaaaaagatgttatctgcagctcctctgtgcctaccaagcaatatggtacgtctgtggtctagagaccaactcattaggtgctctgtttaccatcagctggtgaaaaatgataattgtatggaagaataatcaccaagacatggacatcactgcctgcagacttcgccaggaagctacttcccacttcctgtagatccgcagctgtttcaggatgtgtaatgccctctactgtcctaccattcaaatacttctcttttcaagctcagaaaaccaagtttaaggtagggagagagagagagagagagagacaatcaaacaaccttatgttgggtccagagggaactgcaaatgtgtctaagacaatgcctgctttcaagaagcttgcaattaagtgggaatatgagatgtaaatactgaaaatacaagccaataaatcatatattaccaggaaattcttggcaggctgagttttcagaaagtctctacgtgtactactgtctgcacacaaaaatgcccagacctggcatgtggctaagtctacttgtaaaatttgttacctggttaaatgctgttccatgcctaccaatatttttaagttttcaaatataagttttaggtgaaaatgccattctttcaaaacagtatgtgctggagaaatgacattttttcaaagcaaattttctatatttggtcatgtgatattctgtaagcttttttataaaggctctttagaacattccaaaaatgagcatcatcaaattaaaacaagagaacttctattacattgccacaaatcctagatgtaaataaaataccatttcactcaataatgattgccagaaatataaatacagtttagaaaaattatttaattagtttatttttaagtatttgccaagaaggcttcggtcttgctagtattaagtcctgggagaaggaacaaaggagagtgaaatgagctacagcaacttcatgcaattgggcctgggtttagcaaagctcactctctctcctccacacccccaacaatcggcctggggccaatgacagccaagattctttgtccaatttgacatcatgcacatggccagtaccccgcctctttcgcctttgcctgctttcttagatcttctcatccgagcataaagccagcagcccctttgaggacatctgataccccaggtcagtaagtagtctctaaaatgaaacataagaaggtggtacaagaaaaggggaaagtgtagggattccctacctttgttgcaggctctgagacagccttggagagggctcagctcaccaatcccaaaggccttacccgcagtggacaggggcatggtgaggggatgtaacaaggacacccccggtggcgtcaactgctctattccagtcctgaccacagatcactgtggttaggttactttccttcttagagccccaggccttgacctctgcctcctagtaaggaaacaatgtgccaccagataaacttggagaaactgctgaattccctgagaccaaaagtgcagctccgtaaatgtattacatgccgagaacagttgataaaatgtacaagggctgggaaaagaggcatgaggaggaatgaacagaaatcctgccacctctatggggtttttgaaaggttagagctcaaaaacacttaccctgccccctgtttctccccacaagacagcccaaagcacaagacaattttattagcagctctgagatacccagaagcaatccagagaagagggtagatccatcgtttcacttgatgttgtactgcaattttgcagctaaagacattctttgggcctgaactcccggggtccctcagtcttgaataactggtataaatgatgcccgggctagtcagaggccctgcactgtctggggcctctccccatccccaagtctcactaccttccgcagcagcacagagggttgaaagtgtctgggaagacttgaaggagttgagcatatctctctctctagcactctgctcaaaccaatggcctgttctctgcagttcctatgacatgaacactgtaatggaacacaggagcccatgtctacatctcctacaacaaatgaagaccactaaattataaagctctcctgcagaatgcaaagcatctgtcactaatatgctaacccattcattttttccccatgtattggaaagagagagaacagatactgcttgggttttactaagccctagactgtgtctgctattttaaaaataccttcatcatagatgtgtgaagcaaagatatgagaaacagggggtagaacctggagaggggctgccccacctaaaggcattcccatgataaaaatttttccttggcacttgacacgcctggaccaagccaaccctatctagtcgccaggtcctacctgcaggctttgattgtgcagactttgtcctacctcccagaatgtgggattagaccaacaggacattattcctaatgggcaaggtcaatattttaatcaccaatctcttagctcatggtggagttcatttccctagaccacactgttttgagcatgcgctcattgaagttggaggcacgcaccgaggaagggaacaagcagaacagaggcccaggtgcgctctgttccaagcttgctctatagcactctgggtgctactcaacctcccgggattgttctttttccactggaaagtagtgggactctcctaagggaaggtgaatacctgggatgctttcagaacaatttcaagtacattgtccaagacagtatgtttacgccgaaacatgaaccacttgaaaaatgcaagaatctctaggtggatcttcttgcttctttgtcaagtttctgccagatcccaaaaggaactcctaagtctgcaactgggtccagaagtaaacagcactaggtaagcatgaagttgaagctgccggggacacaagagccttgtatccgccggcctcctggtcacttccgcctgcaaatccacatatgccccaattcaccttgttcagaaaagaatgcagcactcctgccccaccactcccccgacagcctgcctcagtccagatttctccagctccactaatggcatcatctcccaccagctgcccaggcaagacacctgcaggacaaccccactgcccgttccttgctgcccaccaccttcaccgccatatccaccatcatctgtcagcgctaattcctacgatgcacttctcagatcagcccctttctctcctttgccaccccctttgatcagccccggctcaggatgctttgatttactgcaatagcctgcttccagttgttctccacgtggcccccgctgaaccttgctacagtacaaatctggtcttgttgattctcttccttggagatcgccaaggcctgactgctgcctgatggataaatcccttagctggatactgacactggtcctggtgcagcctctgccgtgttgccccttgccccacttcccacctctgccttgaactcctgcagaccccaagggctgtgctctcacctctctgtgctgcttcctccacgtgggacctctgcttatgagttcacaaagccaatctgagggatccttcaaaacatcctctaaaactcaactggatgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgtcttcctattcccagagcaccctcttcatgccccagtctcactctctgacacattgcatgtaaattctctattcccacgtatgttgtggccacactaagctgtgaactccctgctgacagaagtaggtctttcatctccacacaaattctcacatagtgcctagcacacagtaggcactcaataaatattgcttgaattgactgattgcttgatcaattgattaaatatttcataacatcatatcaacctctcttactaaaatatgcaaatatatgtgcatggcgcttggtgaaatgtaggcatcgaggaatcttacgaatccttttctttttctgcagtccccaattgaacctactactaccaggatggagatccccccggggacccaggcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggtgtgatgtgaggcctaagctcagttttcattctctttgtcttgattttctttcaccttgtgtgtaaatagactctttcttctgatgctcacccaaccctttaatatgcaaggccacattcatcctcacctcctgggctgcagacgcgaaacagcaagggcttattcctggctttaaagaggagaaactgaggcctagcccagagaggggacttgctgaaagacattcagtatacctaggattagaagctcggtctctgtattccctggccagtatataatacctcttcaattgctctgaaaatgaaaacctcaggattattttgcaggaggaaacaaaaataggcctggaaaaaccacagccacatttctgacaagctccattcagagggcaccataacttacataaatgatttcctattacaccgcaattgtcactgcaacacgacagtcttgcagcttccttgaagtgttctctttgttgttttttgtaaagatcctccagaaagaagaatcaaatatggtccaagcagggaaacaaagcacatgacatccgcagacccagattccccttccgcatgattctttctgaggaccaaagagaatgccatgaatagtcccccgtgggcctgagccctctcccacctgtcttcctcccaaagctctgctatatccttgcaaataggattcctttttttgaaaaaagaaaaaaaaatgaaagccaatggtttatgaagaagaaatgaagtggcaatttcccagcatggctgggaatcaatacaagctgttgtcagggttttcctttcaaagggtggctgccacacttctccaaagtcaagagcgacagagctccagtgcttgacttacaactgcttcatcatagcaagatatttttaatttaaaactcactgcagttgggttcgaactcagctgggacttgatttactgctaattcatttctctgattcctataattctaagctcagtcaccaaacagtttaatgctgatagaatcaccagtgcaatgctttatgaatgggcgtcaggggaattttgttagtgtgtgttagcaactgttattcactctggaaaggagcaccgtgcctgcaccaagcatgggggggctctataattgggcacgtgaattaccagtatccccaagtgattcaaacccaaataccactgagagggtacccccttttaccccaacccacatacacactcccacactctccctctctctctcacacacacacacatacaatcattacctatgtgagatgaatgccaggcagtgaaaacgctttccatgggaaatgcctaacttcactctccaggtcactacccagtggtggaaaccatggatttacagtctaattagaaatcctcagccttttcttggatggcaaagttttctcttcccaagagaaaatttgtttcaaccgtccaaagtttagggagatgtgtcttaataactcaagcttcctttgttaatttgataaagaacatttatctttgtcagttatattgaagcctcttattcaagcagttggagaaaaaaaaattgagaaggtgaatgtcattactcacatattttgcaaacatccatcttgatctgttatgtgcaaccaaaaagtgccacttgtgggaaacatgtccacaaacctgtcagagtggcattcacactttttgaatttgtttctttatgaaatatacacctgaaggcagatcacaaggccactgtcgctaaagttttgtgagaattcgcagtcatttctgggagtctcaaaagcaaatgacaaggacaagaggcaggcggtgcctctgaaagttggggtcacaagtccctacaagtccctattttatcagtacagtgaattcattcttctggttttttcacctctgaagtaaaccaaaacttgaaagcttccagttgaaggtcaccatctcccaaaatgcctttctatggaaccgtctttccaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccccccgccgcaatctatcagtgccaaaacccatagtgagttttacacagagagaaataatttaattccatgtgcatccatgtgcaagaccactgcacctacctgtccccaaccactatgacccaggatgctggagggtaactgaggggctcagcctgtacccatctggattcatctgaatcctctggaatagccagtcagtctgacttgatgtgatccctactctgtccctgctgcagagtaagaacccaccatattagtctggttcaccctagccttgatatttttaaggtcattcttctccaccttatcctactccatttattccttctatttttacagcaaatatttatcaattgcttccagtaagataggctctgggttgggcaatgagtatacaagaagtaagaaatgatccctctcaacctaaaacataaagaaatacatgattcccactgttttcattgccactgccagtagcagcttcttcaccattattaaaaagcatgaattgagttactgatgaaacaaaaaactgcttgaagcaggggctgaccctaccttctgggagctgcaactctcaggcagaaaccctaatgcaggcccacgtctctaggtcagtgatttgctcacatcaatcagtggttaggggcaagtgcatttagggaggaagatagggtcagtatctaatggacaagagagcagggaaagaggtcacaagcacagcatgaccattagtcctctccccagcctgaccctaaagggccttcaaagcacaagagtagtaaaaaacgttgatgaggggcaggactagctagaagcaatgacttacaggaaatattttatgcagaaatgtcccctgttgcattatatttcagtgctttcattatttcttaaaactgggagggtggcagaggtcattacgacctccccctgcttcccagcagccgtgccatccctgaaatagtcacacaccactatgcggaaggctggctgttgcttagtaagccccaaaacattagaaaagtcttcagaaatcggattggcacccattcttaatgtggtttctatttggggtttaaatgggataatagtgtagtcgactagtgttgacacagactcgtgaattctggggctcctaattggagtaccctgccctgtcttgccatctgactctgttctgaagaactttatgttctttgcatggaaaccattatcccagactcccaatttatgtatctgcccaaatctgctgagtcccacctgacatcacgccaccccaccccaattctgaactgcagccattttcctgttgaatccttgttatcattgccactgccaggagcagcttcttcaccattattaaaaagcaggaattgagctcttgattaaacaagacactgctggaagcagaggctgaccctaccctctaggagccgcaactctcaggcagatgccctaccgcagacccacgtctctaagtcagtgagttgctcacatcaatcagtggttaggggcaagcatatgtatttagggaggaaaacagagtcagtatctaatggacaagaggcccccagtgacgctttctgctgttcctctggccctaaagttcttgctgtcttttcttccttcagagtcaaaggctgggctcctgcaggggtaaccctgacataccttctgcagggagagccaaggaagccccagccccagggcctgacccacagaggctctagcttgacctggtattcccaaccccaaagtgaggggagttgactcatgcctcgtggggtgacttgtgaccagtgagctacagcagaccagaaggacctgtggattaactgctggctgtgcctcaccaccacagactattctgagacatactgttcacaccaggcttccctggatacctcctgagtgactgagccaccagctgcttttcactgggaaggcagggccagcttggtaatacactatttgttctccttccttccctacctctcctcctttgcttcatttttgcttccccgggatctcacccctcaataaagtcataacacatagcttcttccttgagctctactttctagggaacccaggctgtgactggagtgaaggacagacaggcaggggcacaaggcccaggccctccatagttttgacaagaatagtcctgcttgcatctgttctgtgcactggaattccatataaaatttcactggagcaaagattttcactgtatacatgttaaaatatgtttaatcaccgatctagactaacctcctcattttataaacaataaactgaaacataaaatgatttttcccaaaatgctttagttagagttatctacatctatttgtatccaaagcctagctttttccacaacagtggtttttaagcaaggggacatattggaatcatctaggaacctaagaaaatggacacgtgcctaagtagctgtctctttccttggaaagacaagggacaggataggctctgaagaaggctgagcaaatgctgaggccagaggtggactctgtacctatctggcacaattctgcttgagaatctattgctcacacaatcaccagaatccagtacttggtttacgtaatgcaaaggttcagtggaaattttcactgtagaagccacccctttattcacatttgacagtagtcatagcaaagtgcttgtcttagtccagtgtttctcagtggattccaggtccactacacagtttatatacttttgtgatttcacaatccatgtgagtgtattaaaggctctgagaagtcctgcagcaaggagtatctttagctttgctttacacccagggttttgcaaacttacttgactgcggaaacttttttgcatgtaatgcctattgactcccccgcagaatatactttgggaaactctagtctattttaagtattactttcaggaaagcaggcctgagatggagaggaagaaaacgaactccaactgactctagcaacattagctgacattccaggcaggctgcttcagttgcacatcctgacgtctgctactgtctcctctctcactctctaaccccgccacaagaacggaagcaatccaccagctatgccttgcttacttctttcctcttggcctctgggtcaaagccaaggaatgattggttcaccttctagtttgagcctccacactaccaaaagggaaatccagctgtgctcattcgagaagagttcagtgagtatgtcagataaggaactgatcttgagcgaagaccaggaaagcctttcaactgccatggttttcctgtcctaaatttccagcgacctcttcctccactgcttctctcctcatacttcataatgaaaatactctaccctgtaagacctcgggaattgattcagcgaggctgtgttcagcgcattgactgcggagactatcctcttagctagtgatctgttttgtgttggagtgacaaaacatcccaaaatccaatttgctgttgcgaatcctggttcatggaggaaacaccatagagggggaggggaagatccaagcttagaaggaaaagagaggatgcctgagatctctccaacacctgttggtttcagtttgcacaggactttacctcccaatgttttatccactcattcctactgctgcctcagaggggaggtgatgaaattccacgtgcaccccttctagccacctcaagttggacagaacttttactcacctcacagtgtagagaagtcaaagaaataatgcatggaataaaagtttgtcttttggagaaaaagaaaaaaaaaaaggcaagtaaccaaagtgcctcacttgtggctttttcctaaaatgttcagaccagagggactgaggttagccctggctttggagtgggacagaacccaaccaggcccatgggctccttcagggattcacacccacacctttttgcatcaggatgtaattcctaatgccttgccttagcctgcaccatctcaggtctgaattattttcttcatgcaaatggggacctatcaaaattcctctaagtgctacaggatggctatcccctgacatggtccgttggcaccaacatgcgatgagtctctgctgcaaccaccataggatccaggcacccagcaccgcatgatgtccctaggcactgatttcttccctgcttctggatcctgaagtcagaaactctaggagtaataaatgaatgaatgaacaagtgtcaagtacctaccgtgagtggtgtaatggtaagaatctttgcccaagagtgaaaaaaccatccatcccttagcaacctggcgccttggacatctcacctaaactctcttctcagccttagcttctatgctatcaaaatgggaataaacaatacctaccttgcacagctattttaaagatgaaatgaggaagtgttgtttccacaatactagcaatttgaagcagtcaccagggagaattagactcctatcagaattggagcctcatagagtctaaagtaaagatgggaacttcactcattcattcatttactcattttttcctgggagaaaatgggaattgccaaatgaggtgacagtcaccctcaggacctgagcattctgctagaatgatccatgcaattttataacctaccaacagccaaggagaagactcatcccccttgatgaatggggaaatcgaggctcagtgaataaatacatttgcctggcatcacagaggtagtgcaagagactagggaccagatattctaaacttcctcccaagcactcacccataaacctcccaagggggcagcagtacagtgagcacatatattctaaggaggaaaccagcacagtgatgaggagaaaggtcagattgctcacaagtgagacttggctccatcactaagtggctgtgtgatctgggacaaagtctttaacctcctgcatctcagtttcctcctggaggaaatagggaccgtaatagcctatctgggttgttatgaggcaaactacttaaatggtatctaaaccaaatgagtgctcaataaatattggccaccatcatcattaattatcatcttccattccattgtttttacaagaactgaagccagtactaacatcctcacagcctcttcctttgggaggctgatgccacaggaccggacaagtgtgtgggggcatacacagactcacatagggactcaggaaactcttcttccaggctgctccatgccatgcagggaagcagcctcctccttcaggaacaaggcctgggctcttgttccaggggaatcaggacccctgcctgcctttcgttttaaaatccatctcttaccactcagcagcagagcccccttcagtctccctgtgggctccaccttcctaccgcaacttgaatggtacagcctgggcagtgaggacaacatgaaagaagaaagaaaaagtctgtgcagctagaggggatcaggtgggagtctggggagggagcagtggagcttgcagcttttaaagagacagtgtcctgtccacagggccctgtgtggaccaagcatagctcgatagagcctataggccaattaccctaatcatgtgcatctcccaaacagccatttattagtgagacgtctttttaaaatgccgcttttaaatataaataacacttaatcatccagctgtcgttaaattcatgttatattgatttcttggagtgccgcaaatttgagggcgaatgggctggcggatgtgcgcacaaagccaagaggtagattagcaagtggtgggggcagagaagtgggggttggaggaaaaggaagggaggtgtcaagggagggaaatgaacctactcaatagcccagggtctgagccagtttcacattgggtagcactggacacaaataagaagagaggagacgctggcacatctgttgcatagtctaatgagagccaagatcatggtcgtgttttctgtattgctgccgcccccttgtaacccaccacagagccgctccaacaggtctctgatgtgcattgtctgcgtatgccttctctaggtgaggatggggagaagcagctaagaaatgccccctagctggctaggaggagagagatccacagcgatttctctgcatcaaagcctgatgataactatgaatcaagagtggttaatgacccagcccctttagctctctcccacttcgggactgctgccatcctagaaagcccccacttcattcccagcagccctcattgtgatgaaaaggatcccgaggccaagtgtatgtaggcagactctgccgtgcagatttccctgtctgcagggagtagcagcagcaggcgacaggaaggcacagagaaggagaaaggaaacaagttgactgccttggagtcctccagaaatgtctgcagtgtcccagtgggcatccaggaggaagtcctgggaggacagatgagagcccggggaggcgtgattgggtaagaaggagcagcttgtaggtgacccatgcctagtgctcacaggagagctgccttaagcaccgtctaccaggcagcgagggtctgctgaaaagaagcattcatggctggggtttttctagtgtgactcccttcccagtgagaaagacctcagagaacttaaaaggaagggcacagaagagtggcagagagggtgaatgacagcgtggcatgctccagggctgggcaagagagccaggaaaacgtaatgtatactccgctttacagagatgttaattaatgcctgccttgtcctagaaaccaaattggtacctaatgctaagtgcagaaagtgcagagattttctgaacccagatgtttagcttataaccagcataatgatactagctttgcattaaaatgatggatcctgaggctgcgaatacatgagaaaggaaagagggtagggaggaaagcagagaaaggagtggaggtctacagggaagacacagacatttcaggaagatcctgtaccctatccctttgcctcttccaggtcccatgagggactgtttacctgggaggcacccactgttgctggagctcattatttcttttgcaaaccatgtgctgctgtacgcgtaggtgggatctgcctgtccacgccctcaaggggcatgtggggagaaatgttccatttcttccacagcccggaagacagaggtggaccccattgtcacacatggcgggggcggggagctgaccacatttagccagactctgagaacgcatgtgtgtatatatattgggtgtgtgtgtgcacacgcccaccattcttaaaaagcaaataaggtttcttccccctactggggtctctccattgtgagagatttgctttattccatctatgcttttcaatcaatcaaagggcagctcacacagcacacagcgggaatacaatctccctcccggggtgtctgcgcttctccccagcctagccagagacctttgcaggagctgaaaaaagtttggaaatagcggagtcagggtgctgaaaaagccctttcattcagcccctatcttcaggatttacaaaaacaacccaaattctgagcctagcactgaggcctccttgttcaaaagaatgtttgctcctcttccatcatgttctgtaaggctcctaacatattttttccactggtgggtctgtgggatactctgaacacatgatcttggacagagggtacaagcttattcagttttgtgggaaaatgatatgatcatgttgcctagaaagctacctcaaagtgacagcaccagaaacacaggagcttgtacatatatattcaattccgaatttgatttggatctcatgttcttctccctatgacaactgagaccctaaattagttgctcttagaccccaagaagggaactatggaaaagcctcttagaaccccagccacttcctacctcctccagaaaaagttaaaatgagcagcctgtgaaattccagccagagagaacaagaatgaaaatgctttcgggaaataggaccttaaagcacgggcgtctggggagtgattctacaatcggagcaggcttgggctctgggggacgctggcagacccacgaatgccttgccttctccggtgggcagtgccgccacggtcgtgagggaggggagcctcctcttttggaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgca
